United States Patent 11,098,302 (IDENTIFICATION OF POLYNUCLEOTIDES ASSOCIATED WITH A SAMPLE) - sequence listing, part 78

SEQ ID NO: 268643 - DNA, 640 bp, Homo sapiens
  misc_feature: GYAE6OF02G3Y3M.28.57.F02.1.454.CMB.1.raw
  modified_base (299)..(299): a, c, t, g, unknown or other
  misc_feature (299)..(299): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggagcttggtccagccgtggggggtccctgagactctcctgtgcagcctctggattcaccttcagttatttatgctatgcacgtgggtcccnccaggcctccgaggggacggactggaatagtgtctgaggttattagaagtatgacgtaataacatattatatgactaaactcgtaggtaggaacgggctaagtacttcgaacctacgtacctaccggaagggtaacctaaacgttacccgaaagtaaccacgtacttagttactacgttaactaaagtcgggacacgtcccgtaggaagtcggacgtagggaacggacgtacggtcgttagttattacgtttaacggtggggtagggtacgaagggacggtacggttaaggtttacgggaaacggtttagggggttacggtcgggggacccgtaacggggg

SEQ ID NO: 268644 - DNA, 634 bp, Homo sapiens
  misc_feature: GYAE6OF02FKU3I.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttccgtgtaggctattttaaaggtgtccagtgtgaggtgcagctggtggagtcgtgggggacggcgttggtccagccgtggggggtccctggagactctcctgtgcagtcctctggattcaccttcgagttattatcgctatcgcacgtgggtccgacgaggctaccgaggggaaggctaggaatagtgtcgtacgaggttaacttagaacgttagtacgtacgaaactaacgtataattaatttaagtacgacctaaaactcgttacggtagaacgggactaggtaacttcgacctactccgtacgacgggtaactaacgtaccgaataacgacgtactagttactaccgttacaaaggtcggacgacgccgttagagaacgttcgaggacgaccgtgtcgtagttataacgtagtggtacgggaagaggtacgacggttaagtacgggtaacgttggggtcggtaggggaccgtaacgggg

SEQ ID NO: 268645 - DNA, 585 bp, Homo sapiens
  misc_feature: GYAE6OF02FQCJ7.28.57.F02.1.454.CMB.1.raw
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (371)..(371): a, c, t, g, unknown or other
  misc_feature (371)..(371): n is a, c, g, or t
  modified_base (379)..(380): a, c, t, g, unknown or other
  misc_feature (379)..(380): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctggagactctcctgtgcagcctntggattcaccttnagttatttatgctatgcacgttcgggtcccgcgaggtcctaccggaggggaacgggtactaggaatagtgtctgaggtatagaagtatgacaatanatatatannacaatctagagaggnagtatacactntcgcgagacactacacactnctntactctacgagtcggcacgtcgagacgagcgtaggacgacgtacggtactagttacgttagttacggtagggtacgggtaaggtaacgggtacggtacggttaagggttacgggtaacgggtttaggggtcgggtacgggggccggtaaccggggg

SEQ ID NO: 268646 - DNA, 776 bp, Homo sapiens
  misc_feature: GYAE6OF02JBUSA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttcggtccaggccgtggggggtcccctggagactctcctgtgcagcctcgtggacttcctaccttcagttattttactgcttatgacctacggttcgggtcccgacccgtacgggtcctacccggaagggggaacggggtaccgtagggaaattacgtcggttccgttccgaagggttaagtttaacggtaaagtaaagttcggtaacgtaaattaaaccaagttaatttaagtttatacgtaacctaaaacttcgttaagggtaggaaccgggactaacgtaacgtttacccaaccctaagttccgtacccgaaagggaacctaaacttaccggaaacgaaaccacggtacttagttacttaccgtttaacgaaaggtcgggaacgtacggtccgtagggtaacgacgtcgtaagaaccgggtaaccggtaccggtacgtttacgtacgttaacgtttacgggttacgggttacgggtaaggaacggggtaacggacgggttaaggtttaccgggaaaggtttcggggttacggggttacggggacccgggtaacggggg

SEQ ID NO: 268647 - DNA, 830 bp, Homo sapiens
  misc_feature: GYAE6OF02I4MY2.28.57.F02.1.454.CMB.1.raw
  modified_base (261)..(261): a, c, t, g, unknown or other
  misc_feature (261)..(261): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtcagtgtgaggtgcagctggtggagtcgtgggggagtcttggtccaggccgtggggggtccctggagactctctgtgcagcctnggtactctaccttcagttatttagtgtctatcgctacggtcgggtccgccgacggtcctacggaaggggaacggactaggaattacgtcggtacctagtacggttaagttaagaaagttaagtacgtaacgtaaataaactagttaatttacgttaatacgaacctaaaacgtcgttagggtaacggtaaacgggtacgtaaacgtactttaaccccgtaaccgtaacgttaccccgggttaacccgaaacggggtaaaaccccttaaacggtttaaacccgaaaaacggttaacccgtaacccggtacgtttaaacgttttaaccgttacccgtttaaacgaaagggtttacccggggactaaacggtaccgtagggtaaccgtaacggtcggttaacgggaaacccggggtcgttaaacccggtagtttaacggtttacttttaaccggttaagttcgggggtaaacgggtaaggtacccggggtaagggttaacggtttaagggtttaaccggggtaaacggggttagggggtttacggggttaccggggacggggttaaccgggg

SEQ ID NO: 268648 - DNA, 624 bp, Homo sapiens
  misc_feature: GYAE6OF02HDELM.28.57.F02.1.454.CMB.1.raw
  modified_base (267)..(267): a, c, t, g, unknown or other
  misc_feature (267)..(267): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (409)..(409): a, c, t, g, unknown or other
  misc_feature (409)..(409): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggtcgttggtccaggccgtggggggttccctggagacctctcctgtgcagcctntggattcaccttctagtatttatgctatcgctacgtcgggtcccgccgacggctccgaggggaacgggactagggatagtgtctanaggtattaagaagttaagtgacgtaanaacgtattattaattatacgactaaactntaggtaggaaggcagtactccacctatcctacgaggaactacgttacgaacgacctacgcgtagtactcttagagtggactacgccgtagacgtacgagtacggacgaccgtacggtacttagtacgttacgttaggtggttacggggagtaacgggtaggtaccgttaaggtaccgggtaaacgggttgggttgggtacggggcggtaacgggg

SEQ ID NO: 268649 - DNA, 741 bp, Homo sapiens
  misc_feature: GYAE6OF02JT1NF.28.57.F02.1.454.CMB.1.raw
  modified_base (343)..(343): a, c, t, g, unknown or other
  misc_feature (343)..(343): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagccttgggttttccttgttgcttatttttaaggtgtccagtgtgagtgcagctggtggagtcgtggggaggtctttcgggtccacggtccgttgggggggttccctacggagaccttccgtacctggtggtacaggtcccttcgtggtaacttccgtacttacagttacttagtcgtctaatcggataccgtcgggtccnccgtaggtcctacggtacgggtaagggtaccgtacggtaaagttctagttccgttacgaaggttacgtaacgaagttaacgtacgtaacaaaggtaacctaattactttaaggtaacttcgtaactaaacgtcgttggttaaacggaacgggtactacgtaaccttactaaccgtacgtaacccgtccgggtaacggtaactaacccgttaaacgtaaccggtaaacgttaccgtacttaacgttaacgttacgttaacggtaacgtccggtaagtactacccggttagaccgagtacgtagaaccggtcgaagtacgtgttaacttcgtagtaggacggttagtacggaagttacggacgtttaaggacggttaaggttcggtacggaccggtacgg

SEQ ID NO: 268650 - DNA, 792 bp, Homo sapiens
  misc_feature: GYAE6OF02FGZAK.28.57.F02.1.454.CMB.1.raw
  modified_base (279)..(279): a, c, t, g, unknown or other
  misc_feature (279)..(279): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgtgctatttttaaaggtgtccagtgtgacggtgcagctggtggagtcgtgggggagcttggtccagccgtggggggtccctggacgactctcctgtgcacgtcctctggtacttccaccttnaagttattactgctatgaccgtacgtcggtacccgccgtaggtcctaccggaaggggtaacggtaccgtagggtaaacttacgtcggttaccgttaccgtaagggtttaacgttaaggtaaaaggttaacgtcggtaaccgtaaaagttaaacctaagtttaacttaagtttaacgtacggtaaccttaaaaaccgtttccgttaagggttacggaaacgggacgtaacggttaactttacccgaacccgttaactacccgtaccgggaacgggtaacctaaacgttaaccgaaacgtaaccgtaccgtacttaggttaccttccgttaactaaaggtccgggtacacgtccgtaaggacgtacggtacgtacggaacggtaccggtacgtacgttagttacttaacgttacggtagggtaggggaaacggtagggtaaccggtacgggttaaacgttacggggttaaaccggtttagggggttaccggtacgggggtacccgtaaccggggg

SEQ ID NO: 268651 - DNA, 826 bp, Homo sapiens
  misc_feature: GYAE6OF02IGUV8.28.57.F02.1.454.CMB.1.raw
  modified_base (653)..(653): a, c, t, g, unknown or other
  misc_feature (653)..(653): n is a, c, g, or t
  modified_base (670)..(670): a, c, t, g, unknown or other
  misc_feature (670)..(670): n is a, c, g, or t
  modified_base (686)..(686): a, c, t, g, unknown or other
  misc_feature (686)..(686): n is a, c, g, or t
tcagagtacgctatcacgaccggtgctcgatttagctcgatatagttgggtctgggagagggagcccccgccctgggtttcccaggtgttctcatttggtgatcagcactgcacacagaagagtcatgacggtagtttgggctgagcgttgggttttccttgtgtcttaagtttttaaaggtgtccagtgtagaggtgcagcgtggtggagtcggtgggggggatccgttggtccgacgcccgggtgggggggttcccctggtacgtacccttccgttcccgtggttcgcctacggcccgttgttagggtacttttcctaaccctttcgtaaggtttattttaacgtcggtacttaagtccgtaacccgtacgggttccggggtaccccgcgtaaccggtccgtaaccgggtaagggggtaaacgggtcgttaagggtaacttacggtttccgggtacttaccgggtaaaggtttaacgttaaaggtaaagttaagtacgtaagtaaactaaacgtaaattattttaacgttaacgtacggtaaaccctaaagttaccggtggttaaacggaacgggactagttaccttaccgacctcgtaccgacgtacggtaaactacgtaacgaacgttaccacggttctattaaccgtnttaaaccgagtcggtanaccgtggacgtaacgngtaccgacggtacgaccggtagtcgttagttacgttaacgttcgggtagggtacgggtaaaggtcggtaacgggagggtttacggtaacgggttaacggggtttcggggttaacgggccgggtaacgggttaacccgggg

SEQ ID NO: 268652 - DNA, 585 bp, Homo sapiens
  misc_feature: GYAE6OF02HX5AH.28.57.F02.1.454.CMB.1.raw
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (456)..(456): a, c, t, g, unknown or other
  misc_feature (456)..(456): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagtattttangctatgcacgtcggggtcccnccgaggcctcccgaggggaagggacctggaatagtgtctcgtaggtattaaggaaagtatgacgaaataacattataattatagactaaaactctagtaggaagggcaagtattcacctatcctacgaggaacaattaccaaagaaacacncttagtattcttaacgaaatcgggacagcctaggacgagtacgtagacggacacggtcttagtatagttacgtgggtaggagaggtagacggagttaggaacgttaggggtggtcggggactaacgggg

SEQ ID NO: 268653 - DNA, 697 bp, Homo sapiens
  misc_feature: GYAE6OF02GB2I2.28.57.F02.1.454.CMB.1.raw
  modified_base (265)..(265): a, c, t, g, unknown or other
  misc_feature (265)..(265): n is a, c, g, or t
  modified_base (289)..(289): a, c, t, g, unknown or other
  misc_feature (289)..(289): n is a, c, g, or t
  modified_base (554)..(554): a, c, t, g, unknown or other
  misc_feature (554)..(554): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggtcttgggtccaggccggtggggggtccctgagactctcctgtgcagcctntggattccaccttcagttatttangtctatgctacgtcgggtcccgccgaggcctccgaggggaagggactaggaacttatgtctcgtaaggttattaagaagtaagtgacgaataacattaattattatacgaactaaactcgtaggtaaggagggacaaggtacttaccaacgtacttccgtacggaacgggtaacctaaacttaacccgaaaggtaacccacggtcttaacgttacttaaccttaacgaaacgttcggggacctaacggaccgttaggaagtacgngtaacgggtacggaacgtaacggtcgttaacgttaggttacttaccgggtggtacgggggtaagaacggggtaaggtaccgggttaaggttaacggggtaacggttttgggggttacggggttacgggggaccgtaacggggg

SEQ ID NO: 268654 - DNA, 719 bp, Homo sapiens
  misc_feature: GYAE6OF02H8RP5.28.57.F02.1.454.CMB.1.raw
  modified_base (260)..(260): a, c, t, g, unknown or other
  misc_feature (260)..(260): n is a, c, g, or t
tcagagtacgctatcacgaccggtgctcgatttagctcgatatagttgggtctggagaggagccccccgccctgggtttccccaggtgttctcatttggtgatcagcactgcacacagaagagtcatgacggagtttgggctgagcttgggttttccttgttgtcttattttaaaggtgtccagtgtgaggtgcagctggtggagtcgtgggggagctggtccagccgtgggggtccctgagactctcctgtgcagcctntggattcctaccttctagttattatgtactatgctacgtcggtcccgccgaacggccgtaccggaaggggaacgggtacgtacggtaagtatacgtctacgtaggttaagttaaggtaaagttaagtacggtaacgtaaagtaactaattaattaacttaagtacgtactaaactcgtaggtaggaggtacagtaactcctacctattaccgtacgaaggtaactaaaccgttaaccgaaagaaccgtaccgtacgtttacgtaacttacctttaaacgaaaggtccgggtaacgtaaccggtaccgtaggtaaccggacggttacgtaacgggaaacggtaccggaaccgggttaccttaagttacgttacgttacggtagggtagggacgggtagggtaacggtacgggtaagttacggtaacggggttagggttcgggtacgggaccgtaacgggg

SEQ ID NO: 268655 - DNA, 615 bp, Homo sapiens
  misc_feature: GYAE6OF02HOGK2.28.57.F02.1.454.CMB.1.raw
  modified_base (306)..(306): a, c, t, g, unknown or other
  misc_feature (306)..(306): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggtcttggtccagccgtggggggtccctgagactctcctgtgcagcctcgtggattccaccttcagttatttatgcttatgctacgtgggtccnccgaggcctaccggaggggaacggctaggaatgtgtctcgtaggttaattaaggaagttaatggacgtaaataactaatattaattactgaactaaacttcgtagaggaagggcagtatccactatccacgaggaactaacttcgaaactacgacgtcttagtacttactactaacgtcgggactgaccgtaggagagtctagggacgaccgacgtcttagtacgttagttacggttgggagggaggaaggtacggacggttaagttacggggaaggtttagggggttaggtacgggggagtaacgggg

SEQ ID NO: 268656 - DNA, 705 bp, Homo sapiens
  misc_feature: GYAE6OF02GD4F2.28.57.F02.1.454.CMB.1.raw
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgcttatttttaaaggtgtccagtgtgaggtgcagctggtggagtcgtgggggaggcgttggtccagccgtgggggtccctggagactctcctgtgcacgcctctggtacttcaccttacagttatttatgtctatgctacgtcgggtcccgcgacggtccgtccggaaggggaacgggacgtagggaattactggttacctacgtaggttattaaggtaacgttaagtacggaacgtaaattaacgtaatttaaattatttaatacggtaacctaaacgttaccgttaggtacgggaaagggtcgtaacggttactttaccgaacctagtcccgttacccggaagggtaaaccctaaacgttaccgaaacgtaaacctaccgtacgtacgtttacttaacgttacgaaagtcgggaacacgacctaggaacgacggtacgtagacggtaacgacggtgtagtactaggttacgtgggtagggacgtaagggtacggtaaggttaggtagggtaacggttggggttacgggtcgggacggacggg

SEQ ID NO: 268657 - DNA, 727 bp, Homo sapiens
  misc_feature: GYAE6OF02H8KLB.28.57.F02.1.454.CMB.1.raw
  modified_base (176)..(176): a, c, t, g, unknown or other
  misc_feature (176)..(176): n is a, c, g, or t
  modified_base (191)..(191): a, c, t, g, unknown or other
  misc_feature (191)..(191): n is a, c, g, or t
  modified_base (250)..(250): a, c, t, g, unknown or other
  misc_feature (250)..(250): n is a, c, g, or t
  modified_base (286)..(286): a, c, t, g, unknown or other
  misc_feature (286)..(286): n is a, c, g, or t
  modified_base (350)..(350): a, c, t, g, unknown or other
  misc_feature (350)..(350): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggngtccagtgtgaggtncagctggtggagtcgtgggggagtcttggtccagccgtgggggtccctgagactctccngtcgcagcctctggacttccaccttcagttatttangactatcgctacgtcgggtaccgcacggtcctaccggaaggggaacggtacttagggaaacttntacgtctacgtaagggtttactaagtaagtaatcgtacgaaaataaacagttaagttaacttaagtcgaactaaaaccgttcgttaggttaaggaacgggtacaaggttaactttcccaaaccctagttccccgtaccgggaaacgggtaactaaacccgtttaccgaaaaacgtaacccgtaaccgtgttaacggtttaactaccgtttaaacgaaacggttaccggggactacgtacgttaacggaactaggacctacgggaaagacccggtaccgtattacggttactacggttacgtgggttaagggaaccgtaagggacgtacggttaaggtacggtaaacggttagggtcgggttacgggacgtaacgggg

SEQ ID NO: 268658 - DNA, 645 bp, Homo sapiens
  misc_feature: GYAE6OF02GN69X.28.57.F02.1.454.CMB.1.raw
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
  modified_base (449)..(449): a, c, t, g, unknown or other
  misc_feature (449)..(449): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctgggtggagtcgtgggggagcgttggtccagccggtggggggtccctggagactctcctgtcgcagtcctcgtggactttccaccttcaagttatttatgctatgcacgttgggtcccgcgacggcctccgaaggggaacggacgtaggaatatgtctcgagtattaagaagtaangacaataacatatattangaacaactgtgaggaaggtcagtcttacactatcctacgaggtactaacgttaccaaanaaccgacgttatactacttacttacgaaagtacgggactacggtctaggaagtacgcgttaaggacgtaacgaccggtacttgttaacgttagttaccggtggggtaagggaagggtaacgggtaacggttaacgggtaacggttagggttaaaccgggtttagggggttacgggtacgggggaccggtaacgggg

SEQ ID NO: 268659 - DNA, 687 bp, Homo sapiens
  misc_feature: GYAE6OF02JHHOC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttgggtccagcctggggggtccctgagactctcctgtgcagcctctggattcaccttcagtatttatgctatgcactgggtccgccaggcctccgaggggacgggacgtacgggaatagtgtctacgaggttagttacgtaagttatagacgaaataaacgataattaattatagactaaacttcgtacggtgaagggtacgacggtaatttccaacccgtacttccgttaccgaaggggtacctaaacttacccgaaagaaaccaccggtacttaagttaactaccttagaaacggtgggacccaaggccgttaggaacgtcggaccggttagggaaccggtagaaccgggtattaggtactttaaggttcgttacgggtaaggggtaacgtacgggggaagtaaccgggtaagtttacggggttaaaccggttgggggtttacgggtacgggggacccggtaaccgggggg

SEQ ID NO: 268660 - DNA, 838 bp, Homo sapiens
  misc_feature: GYAE6OF02ISEDO.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagctgggttttccttgttgcttatttttaaaggtgtccagtgtgaggtgcagctgggtggagtcgtggggggaggtcttgggtccagtccggtcgggggggtccctggacgactcctcctgtgcacgcctctggacttccgacctttcagttactttagtgtactagtcgaccgtaccggtcggggtacccgccgtacgggtcccgttccggaaggggggaacggggtacggtaacgggtaaattacgttacggtaccgttacggtaagggttaagttaaacggtaaaaggttaacgtacggtaaacgtaaaacttaaacgtaattaactttaatttaagtacgaaaccttaaactcgtaggtaaggaacgggtacgagttacgttaccctaacgtacttacccgtaccggtaacggtaaactaaaccgttaaccaaacgggtaaaccacgttacgtttagttaaccttaccttaaacggtaaagggtcgggacccgtaagttacccggttagggaacggtacggtaccgaaccgggggtaacggacccggtaacgggtacgtttacggtttaacttaacggttttacgggaaggggtttaacggggaagggtaacggggaggtttaacggggtaaagtttacgggggtaccgggtttaaggggggtcggggttacgggggacgggtaaccgggg

SEQ ID NO: 268661 - DNA, 859 bp, Homo sapiens
  misc_feature: GYAE6OF02J079K.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggagcttggccagccgtggggggtcctgagactctccgtgtcgcagcctcgtggtacttctaccttctaagttattttagtgtacttagtcgacctacggttccgggtcccggtacccgacggtaccttacccggaagggggtaacggggaccgtaaggaacgttagttcggttactaccgtaagggttaattaaggaaaggttaactaggaccgtaaaacgtaaactaacgttaagtttaattaacgtacgtaaacctaaacgtttcgtagggttaagggaacgggtactaacggttaccttttaacccgaaccgtacctttacccggaaccggtaaaccgggttaaaccttaaaccggttaaacccaaacggttaaaccgacgttaccgttaacgtaacgtttacgttaacgtaaaacggtcgggaaccttagggtccctaaggtggtaaaccgtcggttaaaacggcgggttaaacccggaacgggttaactttacgggttaacgtttagtttttaacccgggaggggttaaacggggacggttaaaacgggggtaacgtaaggggggttttaaaaggtttacggggaaaaccggggttttttagggggaccccgggggtttagggggtaccccggtaaccggggggg

SEQ ID NO: 268662 - DNA, 825 bp, Homo sapiens
  misc_feature: GYAE6OF02IO47A.28.57.F02.1.454.CMB.1.raw
  modified_base (112)..(112): a, c, t, g, unknown or other
  misc_feature (112)..(112): n is a, c, g, or t
tcagagtacgctatcacgaccggtgctcgatttagctcgatatagttgggtctgggagaggagccccgccctgggtttcccaggtgttctcatttggtgatcagcactgcanacagagatcatgacggagtttgggctgagcgtggttttccttgttgctatttttaagtgtccagtgtgaggtgcagctggtaggagtcgtgggggaggcgttggtccaggtccgtcggggggtcccttgagtactcttcctggtcgtcagcctcgtacgggtactttccgtaacccgtttcctaaggtttacttttaagttcgtacgttaacgtcgtacctaaccgttcgggggtacccgtaccccggacggtacccgttacggaacgggggaacgggtaccgtaagggaagttacgtcggttcctacggtaacggttaagtttaacggaaaagttacgtaggtaacgaaacttaaccggtaaattaacgttaaattacgtaacgtaacgtaaaccttcgtaggtacggtaacgggactacgttacttaccgaaaccgtctacccgttacgaaggttaacctaacgttaccaaacgtaccgacgttacgtaaccgttacgtaccgtttacgaaacgtcgggaactacgggttaccgaaggtaccgttacgtacgttccgggaaacggttaacccggacggggttaccttaaccggggttactttaagggtttacccggtggttaccgggaagggttaacgggtaacgggtaaggttaacgggtttaaccggtaagggtttacggggtacggtcggggtaacggtaacccgggg

SEQ ID NO: 268663 - DNA, 657 bp, Homo sapiens
  misc_feature: GYAE6OF02HCJZR.28.57.F02.1.454.CMB.1.raw
  modified_base (556)..(556): a, c, t, g, unknown or other
  misc_feature (556)..(556): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggttttccttgttgctattttaaggtgtccagtgtgaggtgcagctggtggagtcgtgggggaggcttggtccagccgtggggggtccctgagactctcctgtgcagcctctggattcaccttcagttatttatgtctatgactacgtcggggtcccgccgacggtccgtccggaaggggaaggggactggtaatagttgtctagtaaggttattaagaagttaagtgtaaccgaaataaacgtaattaagttaattaacgtacgactaaaacgtcgttagtaaggaagggtcaagtacttaccaacctacgtccgtaccgaagggtaactaacgtaccaaacgaccacgtactagttactacttaacgaagtcggactaggcctagagacgtcgtagacggactacggngttacgtattaacgttcggtagggttaggaggaaggtacgggtaaggttaaggtacgggtaacggtttaagggggttggtacccgggggacgtaacggggg

SEQ ID NO: 268664 - DNA, 887 bp, Homo sapiens
  misc_feature: GYAE6OF02IC3D4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggttttccttgttgctttaagttttttaaaggtgtccgtagtgtggaggtgcagcgtgggtggagttcggtaggggggaggtcgttcggtccgacggtcccggttcgggggggttcccctagggacgtaccttccgttcccgtgtacgcacgtcctcgttcggtacttcctacctttctaagtttaacttttagtcgtcttagtcgtccgtaccggttccgggtccgacccgtacgggtccgtacccgggaaagggggaacgggtaccgtagggtaaacttacgttcgttacgtacggttaaggttagttaaggtaaacggtataacggtaacgtaaaagttaaacaattaagtttaactttaagacgtaacgttaactttacgttacgggtaaggtaacgggtacgtaacgttaaccttacccgtaaccgttaacgttacccgtaaccggtaacgggtaaacttaaaccgttaaccgaaaacggtaaaccgttaccggttacgtttaacgtttaacttcccgtttaaaaggaacgggtacgggtaccgtacggtaccggtagaacggtaacggtcgtaagggtaaccggaaccgtcgggttacgtaagtttacttaacggtttaggtggggtaacggggaacgaacgggggttaaccgtaacggggttacgttaacggggtttaacgggggtttacggggttcgggggttaacccggggacgggttaacccggggg

SEQ ID NO: 268665 - DNA, 914 bp, Homo sapiens
  misc_feature: GYAE6OF02IOUF1.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgcttatttttaaggtgtccagtgtgaggtgcagctggtggagtcgtgggggaggcgttggtccgagccggttcgggggggttcccctggacggtaaccttccgttccgttggtcgccacgcccgttcgttaggtacttcctacctttctaacggtttatttttacgtcgtacctttaagtcgtccgtacgttcggggttccccgacccgaacggtcccgtacccggtaagggggaaacgggtaccgtaaggtaacgttaagttcgttacgttacgttaaaggttaagtttaaacgaaaggttaaagtacggtaacgtaaaacttaaactaagtttaaactttaagttaagtacgtaaacgttaaaaccgttcgttaaggtacggtaacgggaccgtaaggttaacctttacccgaaccttacgtttaccctaccggaaaggtaaaccctaaacgttacccgaaacgaaacctaacccggtcgttaaccgttaaccttaccttaaacgtaaacggtacggggtaccctaacggtaccgttaggaaccggttacggtaaccggtaggggtaaacccgtaaaccgggttcgggtaaacgtttacgtttaaacgggtttaacgtttacggtttaagggggaacggggttaaagggacggggttaaaacgggttacccggggtttaaacggtttacgggggttaaaacccgggtttgggggttttaaccggggaccggggggaacggttaacgggggg

SEQ ID NO: 268666 - DNA, 741 bp, Homo sapiens
  misc_feature: GYAE6OF02F6L1V.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccaggccgtgggggtccctgagactctcctgtcgcacgcctcgtggacttcctacccttgtacgttaatttagttgaccttatcgactacgttcgggtcccggccgacgggtccgtaccggaacggggaaggggacgtagggaaattagtgtcctacgtagggttaagtaagtaaagtaagtaggacgtaaataacgtaattaattaattaactagaacctaaacgttgttacgtacggtaaacgggtcgaagttaacttcccgaaccgtacttaccgaccggtaacgggaacctaaacgttacccgaaacgtaaaccgtaccgtccgttagttaacgttaccttaaacgtaacgtgggtaccgacgtcgttaggagtacgccggttaggaaccggtacggacggtacttacggtttatacgtttacggtgggttaagggaagggtaagggtaggtaacgggttaaggttacgggtaacgggtttaggggttacggggtaccggggaccggttaacgggg

SEQ ID NO: 268667 - DNA, 763 bp, Homo sapiens
  misc_feature: GYAE6OF02I4KWU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtctgggttttccttgttgcttatttttaaaggtgtccagtgtgaggtgcagcgtggtggagtcgtgggggaggtcgttggtccagccgtggggggtccctgagactcctcctgtcgcgacgccctcgtcggattcctaccttacagttaacttttaatgctatgactacgtcgggtcccgacccgaggccgtaccgaaggggaacgggactagggaaattaacgtgtacctacgtaaggttattaaaggaaagttaagtacggtaacgtaaaagtaaactattaaatttaattaagtagtaaacctaaacttacgttaggtaaggtaacgggaacgtaacgtacgttaaccgtaacccaattcccgtaaccgaacgggtaactaaacgttaccgaaaagtaaccaacgttaccttagttaacttaccgttaaacgtaaacgtcgggaactacggaccgttaggaaacggtacgtaccggttagggaaacgtaacccggagggtaccttaagtacgttaacgttaacggtggtaagggaaggggtaacggtaacggtagggtaacgtttaagggtaaccggtttaaggggttagggttaccgggggaccgtaaccgggg

SEQ ID NO: 268668 - DNA, 764 bp, Homo sapiens
  misc_feature: GYAE6OF02JGOK1.28.57.F02.1.454.CMB.1.raw
  modified_base (568)..(568): a, c, t, g, unknown or other
  misc_feature (568)..(568): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgtcagctggtggagtctgggggagctggtccagcctggggggtccctggagactcgtcctgtgcagcctctggattcacttcagttatttatgtctatgctacgtgggtacccgcccagggccttaccgaaggggtacggacgtagggtaactagttcgtctacgtacggttataggtaaagttatggtacgtaaaattaaaccgtaatttaacgttaattttaagtcgtaaaccctaaaaacgtttcggtagggttaacggaaaggggtaccgaacgttaagtttaccaaacccgtagttacccgtacccgtaaacgggaacctaaacgtttaccgaaaacggtaaccaccggtacttacggtttaattacccggttanaaaacgggtcgggtacaacgtaccgtgtaacgggacgtacggttcgaaacggacggtaccgtacgttagttaacgttaacgttaccggtgggttaacggggtaacgggtaacgggtaacggtaacggggttaaacgttaggggtaaaaccgggttttggggtaaccggggttccgggggaaccccggtaagggggg

SEQ ID NO: 268669 - DNA, 781 bp, Homo sapiens
  misc_feature: GYAE6OF02F1MZB.28.57.F02.1.454.CMB.1.raw
tcagagtacgctatcacgaccggtgctcgatttagctcgatatagttgggtctgggagaggagcccccgccctgggtttcccaggtgttcctcatttggtgatcagcactgcacacagaagagtcatgacggtagtttgggctgagcttgggttttccttgttgcttatttttaaaggtgtccagtgtgaggtgcagcgtggtggagtcggtgggggagtctttggtccaggtcccggttgggggggtaccctggacgtaccttccgttccgtggtcgaccacgtcccttcgtggtaacttccacctttcgtaagtttatttatgtacttatcgctacggtcgggtcccgccgtacggcctaccggaaggggtaacggtacgtaggaacttgtcgtcgtacgtaaggttaataagaaagttaagtggaacctaaataaactattaagtttaattagtcaaactaacgttgaggtaggaagggctaagtactaccactactacgtaccgaacgtaactaactaaccgaaacgaacacgtacgttacgttacttacttaacgtaacgtacggacgacgtttttttttacgacggagtacggtacgtacgggtacggaaccggaaccggtacgttacgttacgttaacgtttacgggttaagggttaaggggtaacgggtaacggggtaaccgggttaacgggttaacgggtttaacggggttaaaccggggtttaacgggggtttacgggggtttaccgggggtaaccggggtaacccggggg

SEQ ID NO: 268670 - DNA, 768 bp, Homo sapiens
  misc_feature: GYAE6OF02G8COU.28.57.F02.1.454.CMB.1.raw
  modified_base (124)..(124): a, c, t, g, unknown or other
  misc_feature (124)..(124): n is a, c, g, or t
tcagagtacgctatcacgaccggtgctcgatttagctcgatatagttgggtttgggggtccctgagactctcctgtgcagcctcctggattcaccttcagtatttatgctatgcactgggtccnccaggctccgagggaagggactggaatatgtctcaggtattagaagtaatgacgaataacatatattatgacaaactctgtagaagggcagattcaccatcctaccgaggacaattaccaagaacacgctgtatcttacaaagtggcagcctgagagcgtagaggacgacggctagtattacttacgtggtagggagaggacgacggtaagttggaacggttggggttacggtggggacccgtaaggggaccgtcccggttggtccgtaaccgttccgtcccgtcgaaccgtccctaaccgaacccggaaccgggcccctaaggttccccggttaccctttcccccgtccgggtccccgtacccccgttggtaccccgttccgaacgggacccgtaccgtaaccccgttaccggaacggacccgacccgtaaaccgccggacccgggtcccggtcgggtacccgttccggtacccggttaccggtaacccggtaaaccggtacccgtttaacccggtttacccgtaaacggttcccgttaaccggttaccgttaccggtacgggtaaccgggtcccgggtaaccggttcgggaaaccgtacgggaccggttaaccggtaacggttaccggcgaccggttagacg

SEQ ID NO: 268671 - DNA, 820 bp, Homo sapiens
  misc_feature: GYAE6OF02JTHU7.28.57.F02.1.454.CMB.1.raw
  modified_base (162)..(162): a, c, t, g, unknown or other
  misc_feature (162)..(162): n is a, c, g, or t
  modified_base (291)..(291): a, c, t, g, unknown or other
  misc_feature (291)..(291): n is a, c, g, or t
  modified_base (625)..(625): a, c, t, g, unknown or other
  misc_feature (625)..(625): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagctgggttttccttgttntctattttaaggtgtccagtgtgaggtgcagcgtggtggagtcgtgggggagtcttggtccaggtccgtggggggtccctggagtacctctccgtgtgcgacgtccctacgtggacttcctaacccttntagttatttactgaccttatcgacctacgtcggttcccggcctacggccgtaccggaaggggtaacggtaccgtgggtaaactgtacggtaccttacgaggttagtaagtaacggtattacgacgtaaaacgttaactagttaaattatttaaggacaaacgttaactacgtttagggaagtaaccggggataacgggtacttaccctaaccggactttacccggtaacccggtaagggttaaccttaaaccgttaaaccgggaaacctaaaccgaccggttacgtttaacccgtttaagtttacccttaaacgggttaacggtaaccggggtntaacccggggtaaccttgggaaacggtcgttaaccgggttcgggaaaccggtaccggttaccgactttaaggtaacccgtttaggtttacgggtacggggaaggtaacggtaacggggtacggttaaccgggttaaagggtttacggggaacgggttttaacgggcggggtttaggggacccttaaaccgggggg

SEQ ID NO: 268672 - DNA, 673 bp, Homo sapiens
  misc_feature: GYAE6OF02G5KDC.28.57.F02.1.454.CMB.1.raw
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (331)..(331): a, c, t, g, unknown or other
  misc_feature (331)..(331): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcgttggtccagccgtgggggtccctgagactctcctgtgcacgcctcgtgacttcacctttcagttatttangtctatgcacgtcgggccncacggcctacgagggaggctaggatntcgtcacgtaggtataagaagtagtgacgaatactatattatatcaactaacgtgtagtaggaacggactaagtcttaccgacctacgtccgtacggaacggtaacctaacgttaaccgaaacgtaaccctaacggttcgttaacgttaaccgttacgtttaaccgtaaaggtcgggaactaccggtacgtaccggtaagaaggtaccgtaacgggaacggtacccgaacgggtaccttaggttacgttacgtttacggtggggtaaggtacgggaaggttaacggtaacgtaagggttacgggtaagggttcgggtttagggtcggggaccgtaacggggg

SEQ ID NO: 268673 - DNA, 828 bp, Homo sapiens
  misc_feature: GYAE6OF02IPYB5.28.57.F02.1.454.CMB.1.raw
tcagagtacgctatcacgaccggtgctcgatttagctcgatatagttgggtctgggagaggagcccccgccctgggtttcccaggtgttctcatttggtgaccagcactgcacacagaacgagtcgatgacggagtttaggcgtgtagccgttgggtttttccttgtttgtcttattttaaaggtgtccagtgtgaggtgcgacgcgtggtggtaggtccgtggggtacggtccgttggtacccgtcggtccggttcggggggttccccttaggtaacgtaccgttcgttcccgtggtacgaccgtcggcccttagtacggttaacttcctaccgtttccgaaggtttactttaacgttcgacgttacgttgaacctcgttaccgggtcctaccggtacggtaccgtccggaaggggtaacggcgttaacggaacttacgtcgggtttactacggtaaacggtttaacttaaggaaaggttaaacttcggtaaaacgtaactaaaccgtttattaaacggtttactttaaggtcgtaaaaccgttaacgttacggttgtaaacgggaaaccgggttctaaccggtttactaccgtaactaccgttacccgaacggtaacgtaaacgtaacctaacgaaacgtacccgtactacgttagttaccttacgtaacgtaaacggtcgtacgaacgtccgttaaggcaacgtccgtaaggaccgtagtaccggtattagtacgttagtaccgtttgggaacgggtaacgtagggtaacgtaggtaagttagggaccggtttacggtgggtccggtaacggtgggtaaccccgg

SEQ ID NO: 268674 - DNA, 699 bp, Homo sapiens
  misc_feature: GYAE6OF02F1EP8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaggtgtccagtgtgaggtgcagctggtggagtcgtgggggagtcgttggtccaggccggtggggggtccctgacgactctcctgtcgcacgcctcgtggacttccgaccttcgagttatttatgtcttatgcctacgtcgggtcccaccgacgggcctaccggaaggggaacggacgtaggtaaatacgtcgtctacgaggttaacttaagaagtaagtgacgtaaactaactattaagtattaagtagaacctaaacgttctaggtaggaacgggtcgaagtacttaccgaactagtcctacggaggtactaacgttccgaaaagtaccacgttacgtacttacttcctaaacgtaaagtccgggactaacggccgttagaacgtacgtacgtggaaaccggtcgaaccggttactaggttaacttaggttaccggttaggggtaccgggaaggaacgggtacgggtacggtaaggtttacggggtaaacgtttcgggggttagggttaccggggagtacccggggg

SEQ ID NO: 268675 - DNA, 640 bp, Homo sapiens
  misc_feature: GYAE6OF02F3PA9.28.57.F02.1.454.CMB.1.raw
  modified_base (305)..(305): a, c, t, g, unknown or other
  misc_feature (305)..(305): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtctgggggagcgttggtccagccgtggggggtccctgagactctcctgtgcagcctcgtggtacttcaccttcagttatttatgctatgcacgtcgggtccnccgaggcctccgaggggaacggacgtggaatagtgtactcgtagtattaagaagtaatgacgaataacatatattatacgactaactctagaggaacggacgatacgtaccaccaacgtccgtaccgaaggtaacaacttaaccgaaacgtaccaacggtctacgttacttaccttacgaaacgtcgggacacggtaccgtaggaacgtagtcgtagacgggtaaccgacggtacttagtaattacgttacggttgggtagggtaacggagggtaaggtacggtaagtttcgggtaaaccggttaggggttcggggtacgggaccggtaacgggg

SEQ ID NO: 268676 - DNA, 676 bp, Homo sapiens
  misc_feature: GYAE6OF02JHUT8.28.57.F02.1.454.CMB.1.raw
  modified_base (180)..(180): a, c, t, g, unknown or other
  misc_feature (180)..(180): n is a, c, g, or t
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
tcagagtacgctatcacgaccggtgctcgatttagctcgatatagttgggtcgtgggagaggagcccccgcccctcgggtttcccgaggtgttctcatttggtgatcagcactgcacacagaagagtcatgacggagtttgggctgagctgggttttccttgttgctatttttaaaggtntccgagtgtgaggtgcagctggtggagtctgggggaggcttggtccagccgtggggggtccctgagacctctccgtgtgcagcctacgtgattcaccttctagtatttangctatggcacgtcggtccgcaggcctcgacgggaggacnggaactagtcgtctacgtaggtacttaagaagtaaatcggataaactaacattaattaagttatagacctaaaccttctaggtacggaagggacctagtaccttaccaacgtactccgtacccgaagggtaactaacttaaccgaacgaaaccaccgtacttacgtaacttacttaacaaacggtcggaacacgtcccgtaggtacgacgtacggttaacgaacgggacgttaccggaaccttagttaagttaccttaggtacggggttaagggacggaaggaaccgggtacgtaaaggttttcggaaagggtttggggttacgggtacggggtacggtaaccgggg

SEQ ID NO: 268677 - DNA, 716 bp, Homo sapiens
  misc_feature: GYAE6OF02GPB8T.28.57.F02.1.454.CMB.1.raw
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (592)..(592): a, c, t, g, unknown or other
  misc_feature (592)..(592): n is a, c, g, or t
  modified_base (600)..(600): a, c, t, g, unknown or other
  misc_feature (600)..(600): n is a, c, g, or t
  modified_base (607)..(607): a, c, t, g, unknown or other
  misc_feature (607)..(607): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggatttgggctgagcgtggttttcctgttgctatttttaaaggtgtccagtgtgaggtgcagctggtgagtcgtgggggagcttggtccagccgtgggggtccctgagactctctgngcgagcctcgnggacttcaccttcaagttattttactgtcttatcgtctacgtcgggtacccgccgaaggtcctaccgaaggggtaaccggagtaacggtaatacggttcggttacctacgtaaggttagtttaaacgtaaggttaaacgttcggacgtaaacgttaaaaccatttaacgttaagtttaactaggtaacctaaaacccgttcgttagggttacgtaaaacggggtaccaagggtcctttacccgaccgttactcgtaaccgacggtaactaacgttaccgaaacgacaccgggtactacgttattccctaagaaacggtttcggacgtagtaccgngtaaccgngtaacgngtacgtacgacgtagtactttagtacgttagtcgggtagggaacgacggtaggtaacggtaagtttcgggaaaccggtttaggggtcggtccggggtaccgtaacgggg

SEQ ID NO: 268678 - DNA, 660 bp, Homo sapiens
  misc_feature: GYAE6OF02HV7W7.28.57.F02.1.454.CMB.1.raw
  modified_base (593)..(593): a, c, t, g, unknown or other
  misc_feature (593)..(593): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggaggtttgggctgagcttgggtttttccttgttgcttatttttaaaggtgtccagtgtgaggtgcagctggtggagtcgtgggggagcttggtccagccgtggggggtccctggacgactctcctgtcgcacgcctcgtggactttccgaccttcagttacttttatgctatgcacgtcggggtcccgcccaggcctacccggaagggggaacgggacgttagggaattaacgttcgttcgtacgtaagggttattaaggaaagtaagtgacgtaaataacattattattatcgactaaactctgtaggaagggctaagtacttaccgactctactaccgaggaactaactaccaagacacgtcgtacgtattaacttacaaagtcgggacacgtccgtagaggtacgcgtacgacggaaacgccggtactaggttattaggtttacgtagggcggtaagggngggtaagacgggttaacgtttagggtaaacgggttggggtcgggttacggggaccccggtaaggggg

SEQ ID NO: 268679 - DNA, 756 bp, Homo sapiens
  misc_feature: GYAE6OF02IEYOF.28.57.F02.1.454.CMB.1.raw
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggatttgggctgagctgggttttccttgttgcttatttttaaaggtgtccagtgtgaggtgcagctggtggagttcgtgggggagcttgggtccagtcgtcggggggtccctgagactctcctgtcgcacgtcctcgtggtacttccacctttnaacgttattttangctaatgactacgtcgggtccgccgacggtcctaccggaaggggaacggtacgtacgggaattagtcgtccgtacgtaaggttagttaacgtaaaaggttacgttagaacgtaaataacgtaacttaattacgttaatcggtaacctaaaacttcggtttaacggacggggaaagggtaccctaaaggttctttacccgaaacccgttaacgttaccccggtaaccgggaaacgggttaaacctaaaaccgtttaaacccgaaaccgggtaaacctaaccgggtacctttagttaaacctttacccgttaaacgtaaaggttaccggggacttaacgacccgttaagacggtaacgtgtaccgaacgccggtaagttcggtatagtttaacgttcgtagggtaccggaggacgacggaaggttagtggtaaaccggttgggttacggcggaacgtacggg

SEQ ID NO: 268680 - DNA, 761 bp, Homo sapiens
  misc_feature: GYAE6OF02GW8NX.28.57.F02.1.454.CMB.1.raw
  modified_base (174)..(174): a, c, t, g, unknown or other
  misc_feature (174)..(174): n is a, c, g, or t
  modified_base (207)..(207): a, c, t, g, unknown or other
  misc_feature (207)..(207): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgcttattttaaaggngtccagtgtgaggtgcagcgtggtggaggtcgngggggaggtcgttcggtcccgaggtcccgttacgggggggtcccctggacgtaccgtcctccgtgtgccaggcctacgtggacttcaccctttcgagttatttagtcgccttagtgtccacgttcgggcccgtccgaaggtcccgtacccggtaaggggaacgggtactacgggtaatacgttggtaccctgtaagggttattaaggtaaacgttaagtacgtaaggtaaactaacgtattaacgttattaagtgtaacaaacgttcgtaggtacggagggtcaagttctaccgaacactaccgtacgaaccgggtaataacctacgtaaacgaacgtaccgtacgtacgttctacgttaacgtaacggtacggtacgacgggtaccctagggaacgtacgtaccggtagggaacgtacccggaacgggttacgcggttaacgtttacgtttaacggtcggttaagggacgggaacggggtaacggttaccgggtaaggtttaccggggtaaggttacgggggtttcggtacggggtaacccggtaaccggggg

SEQ ID NO: 268681 - DNA, 672 bp, Homo sapiens
  misc_feature: GYAE6OF02H66TU.28.57.F02.1.454.CMB.1.raw
  modified_base (181)..(181): a, c, t, g, unknown or other
  misc_feature (181)..(181): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (577)..(577): a, c, t, g, unknown or other
  misc_feature (577)..(577): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgtgctatttaagtgtcagtgtgagtgnagctggtagagtcgtgggggagctggtcaggcgtggggggtccctgagactctccgtgtgcagtcctgtcggtacttctaacttcaagtattangtactatgactacgtcggtccncgtaggctacggaaggaggctaagagtatgttctacggtaagtagtaagaataactgaccgtaaagtaacaattaataattagacgtactaaacgttctaggaacggtaagggtacacgggttaactccgtaacctacgttaccgaacccggtaacgggtaaactaaccgttaaccgaaaggaaaacctccggtaacttacggttactaacgttactaaagggtccgggtactaccgggtactaacgaggtaactcgggtagtaaccgggagtaacccgngttaggttactaaccggtttgaagggttagggacgaaggttacggacggtaacgttaggaacccggttagggttcggttaccggggataccgggg

SEQ ID NO: 268682 - DNA, 699 bp, Homo sapiens
  misc_feature: GYAE6OF02I3BIL.28.57.F02.1.454.CMB.1.raw
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctggagactctcctgtgacncgcctctggacttccacttcagttntttatgctatgcagtcgggtccncgaggcctccgagggacggactggaattagtgtctacgaggtagtaagtaagtaagngtacgaaataactattaagtattacgtagtactaaactcgtagaggaacgggaactaggacttaccgaacctacttacccgtccggaaagggaaaccttaacgttaaccaaagtaaaccgtaccgttacgttaattaccttaccgttaaactaacggtccggactaaccgcggttacgaaggtacggtaccgtaaggaacgggaaccttacggcgtttaagttacttaaccggttaggtcgggggaacgttagggaaacgtaccggggtaacggttaacggtttagggtaaaccgggttacgggggtttagggtccggggggtaacccgtaacggggg

SEQ ID NO: 268683 - DNA, 771 bp, Homo sapiens
  misc_feature: GYAE6OF02HXAV7.28.57.F02.1.454.CMB.1.raw
  modified_base (193)..(194): a, c, t, g, unknown or other
  misc_feature (193)..(194): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgcttaatttttaaaggtgtccagtgtgaggtnnagctggtggagtcgtggggagcttggtccagccgtgggggtccctgacgactctccgtgtgcacgcctgtgtacttcgaccgttcaggttattttactgtacttagtgtaccacgttcggggacccacccgtagggcccttaccggaaggggtaacgggacttagggaaacttgttcgtacgttacaagggttaacttaaggtaaaacgtaagttacggaaccgtaaattaaaccgtaagtttaaatttaattttaacgacggttaaaaccgtaaaacgtttccgtttaagggaacgggtaaaacgggcctaaagggttactttaccccgaaacttacggttacccgtacccgggtaaagggtaaacctttaaacgtaaaccaacgggtaaacctaacggttccttaaggttaacttaccgtttaaacgaaggtcggaccgaccgtaccgtaggaacgttcgagtacggtaacggctaacgggttctaagttagttacgtaacggttggtagggaaggtaggtcgaaggttaacgcgggtttaggttacggggtaggtaccggggtacgtaccgggg

SEQ ID NO: 268684 - DNA, 616 bp, Homo sapiens
  misc_feature: GYAE6OF02H7OAJ.28.57.F02.1.454.CMB.1.raw
  modified_base (188)..(188): a, c, t, g, unknown or other
  misc_feature (188)..(188): n is a, c, g, or t
  modified_base (283)..(283): a, c, t, g, unknown or other
  misc_feature (283)..(283): n is a, c, g, or t
  modified_base (386)..(386): a, c, t, g, unknown or other
  misc_feature (386)..(386): n is a, c, g, or t
  modified_base (409)..(409): a, c, t, g, unknown or other
  misc_feature (409)..(409): n is a, c, g, or t
  modified_base (471)..(471): a, c, t, g, unknown or other
  misc_feature (471)..(471): n is a, c, g, or t
  modified_base (487)..(487): a, c, t, g, unknown or other
  misc_feature (487)..(487): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (538)..(538): a, c, t, g, unknown or other
  misc_feature (538)..(538): n is a, c, g, or t
  modified_base (555)..(555): a, c, t, g, unknown or other
  misc_feature (555)..(555): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtagctattttaaagtgtcagtgtgagtgcagntggtggagtcgtgggggagtcgtggtccagtccgtcggggggtccctaggacgacttccgtcctggtagcctagtccctctggtattccaccttnagttatttagtgaccttatgctaacgtcggtccaccgaggccttaccggagggaaccgggtatagggaattagtcggtacctgtaaggtataagaagtacgtnacgtaaataagataattacttancgaactaactcgagtacggaggtactaagacttacactatccgtacgaaggaactacgtaanaacgaactcggactanacttactactaaggtcgactagccgtagaggacnggtanacggaccaggtntacgtattaccggtagnggttcgggaagagggtatacggtagttaaggagttacggggtagtcccggggagtaacggg

SEQ ID NO: 268685 - DNA, 794 bp, Homo sapiens
  misc_feature: GYAE6OF02FZOL4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagcgtgggtggagtcgtggggggaggcgttggtccaggccggtcggggggtccctggacgtactctcctggtgcacgccttcgtggtacttacctacctttcgtacgtttattttatcgtacttaagttcggaccgtaccggttcgggggttaccccgacccggtacgggtaccccgttaccgggaaggggggaaaaccggggtaccgtaagggtaaaagtaacgtttcggtaccgtttacggtaaaggtttaagttaacggttaaaagttaagtacggtaaacgtaaacgttaaactaatttaattaagtttaagtacgtaaactaaaccgttgttaacgggttaagggtaacgggactaaggttaacctaacccgtaacccgtacgtacccggtaacgggtaacggaaccttaaaccttaaccgaaaggaaccctacggttactacgttacgttacaaacgtacgacggacctaggtacctaggacggactacggtagaaccgcgtacggtacttaagatttaagttcggtaggggaagtaggacgggacgtaaggttaggtaaccgggtaggtttaggggcggggtacggaccggtagg

SEQ ID NO: 268686 - DNA, 655 bp, Homo sapiens
  misc_feature: GYAE6OF02I6KWU.28.57.F02.1.454.CMB.1.raw
  modified_base (196)..(196): a, c, t, g, unknown or other
  misc_feature (196)..(196): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (516)..(516): a, c, t, g, unknown or other
  misc_feature (516)..(516): n is a, c, g, or t
  modified_base (536)..(536): a, c, t, g, unknown or other
  misc_feature (536)..(536): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagcgtgggttttccttgttgctatttttaaaggtgtccagtgtgaggtgcagntggtggagtcgtgggggagcgtggtccagcgtgggggtcctgngactctcctgtgcncgcctctggtacttcgaccctttcagttattttactgtcttagtgcgtacgtcgggtccgccacggctaccggaggggaacggacggtaggaatagtcgtacgtcgtaaggttattaaggtaagtaatacggacgtaaataactaattaatttattagtacgtaactaaccttcgtaggtacgggtagacgtagtacttacaacgtctacgtccgaacggtaacaacgtaccaaacgacgacgttactcgttactacgttaanaacggtggactactaccggngaagcgctaacgagggacgacgtacgtagttagtacttagggtcggtgggaacgggtagacggggaagttaaggttacgggaagggtttagggtcggggttacgggaccggtaacgggg

SEQ ID NO: 268687 - DNA, 633 bp, Homo sapiens
  misc_feature: GYAE6OF02FXOT6.28.57.F02.1.454.CMB.1.raw
  modified_base (278)..(278): a, c, t, g, unknown or other
  misc_feature (278)..(278): n is a, c, g, or t
  modified_base (408)..(408): a, c, t, g, unknown or other
  misc_feature (408)..(408): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagctgggttttccttgttgctatttttaaaggtgtccagtgtgaggtgcagctggtggagtcgtgggggaggcttggtccaggccgtggggggtccctgagctcctcctgtgcagcctcgtggtattccaccttnagttatttatgctatgcacgtcgggtccgccaggcctaccggaggggaacgggacgtaggaattagtcgtctacgaggttaagttaaggaagtaatagacgaaataacattaatattaatagaccaactntgtagagggcagtactacactatccgacgacgggacaactaccgaaagacacggtactagttactctataaacgtgggactacgtccgaggaacgtggtcgacggaaggccgaagggtccttagtacgtagttacggttgggtaacggtagggtaaacgggtcggtacgggtaaggttacggtaaacgggtttcggggttcggggacggggtccggtaacggggg

SEQ ID NO: 268688 - DNA, 800 bp, Homo sapiens
  misc_feature: GYAE6OF02JU02Q.28.57.F02.1.454.CMB.1.raw
  modified_base (679)..(679): a, c, t, g, unknown or other
  misc_feature (679)..(679): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgtctattttaaaggtgtccagtgtgaggtgcagctggtggagtctgggggaggcttggtccagccggtgggggtccctggacgactctccgtgtcgcgagcctgtggtacttcctaccttcgtaagttatttacgtgtccttatcgtaccgtaacggtcgggttaccccgacccgtaggtccccgttaccggaacgggggtaaacggggtaaccttaggggaaactttaacggttcggttacccgttaacggttaaaggggttaaccgtttaaaagggtaaaaagtttaacggtaacggtaaccggtaaaaactaaacggttaacttaaagtttaacgtttaaactacggtaaacccgttaaaacgtttcgttaacgggtaacggtaagggtacccgtaagtaccgtttaccgaaccctaacgttccgaaccgtaacgggactaaaccgttacccgaaataaccgccgtagtacttaacgtcctttaacgaacggtgggacaccggctaacgggtaacnggtactacggacggtaccgacggtatagttacgttaagtaccggttgggacggggtaagtaagggacgtaacggttaggtaaccggtaagggttcgggtacgggtcgggacccggtaaggg

SEQ ID NO: 268689 - DNA, 800 bp, Homo sapiens
  misc_feature: GYAE6OF02II89I.28.57.F02.1.454.CMB.1.raw
  modified_base (676)..(676): a, c, t, g, unknown or other
  misc_feature (676)..(676): n is a, c, g, or t
  modified_base (737)..(737): a, c, t, g, unknown or other
  misc_feature (737)..(737): n is a, c, g, or t
tcagagtacgctatcacgaccggtgctcgatttagctcgatatagttgggtctgggagaggagccccccgccctgggtttcccgaggtgttctcatttggtgatcagcactgcacacagaagagtcatgacggagtttgggctgagcgtgggttttccttgttgcttaatttttaaaggtgtccagtgtgaggtgcagctggtggagtcgtgggggagtcgttggccgagccgtcgggggggtcccttaggagactcctcctgtgcagcctcgtggtactttccaccttctaagttattttatcgctatcgactaccggtcggggtcccgacccgacgggtcccttaccggaaaggggggtaaacggtaccgttagggtaaattacgtacgttaccgtacggttaaggttaaacgtttaaacggtaaagtaacggttaacgaacggttaaaaacttaaaccgtaaagtttaaacctttaaagttttaacgtaccgtaaaccgttaaaaccctttagttaccgggtaaaggaaaccgggggttaccaaagggtttacctttaccgtaaccccgtaacgttccccggttaaccggaacgggttaaaacctaacgttaaccccgaaaaggtaaccaaccgttcgtttaacgtacctttacgttaacgaaaggtcggacnggtaccctggaacgtacggcgttaaggacggtacacggttactacgttaataccgtttagnggtaacgggagggacgaggtacgttaaggtacgagggttacggggtagtccggggaagccggg

SEQ ID NO: 268690 - DNA, 637 bp, Homo sapiens
  misc_feature: GYAE6OF02IROC0.28.57.F02.1.454.CMB.1.raw
  modified_base (182)..(182): a, c, t, g, unknown or other
  misc_feature (182)..(182): n is a, c, g, or t
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (319)..(319): a, c, t, g, unknown or other
  misc_feature (319)..(319): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
  modified_base (519)..(519): a, c, t, g, unknown or other
  misc_feature (519)..(519): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtggttcgtgtaggctagtttaagtgtacagtgtgnggtgcagtcgtaggtggngttcgnggggacgtcgtcggtccaggccgtgggggtcctagacgctcgtcctgtcgacngtcctgtcggtacttcaccggttntacgttattagcgtatgttcgactcggtcggtaacnccgacggtccgcggtaagggaacggtgtacgntacgtntcccagtacgtatagtaatagtcganaactagctaagtactgacgtaatactgtcgtaggactagtgtacttcacatccgtagacgtagtacacgtaacgacctacggtattacgtctacgtaacgtagtaaggcgtaacgccgtaggaacgtcgtaccggngtaaccgggtacaacgggtcttacgtgtttaccgaggttcggaaggtaccgggtagtagggtaaaccgttagggttaacccgtagggtaacccgggtgggtaccggaccgggttaacg

SEQ ID NO: 268691 - DNA, 690 bp, Homo sapiens
  misc_feature: GYAE6OF02HVN0D.28.57.F02.1.454.CMB.1.raw
  modified_base (312)..(312): a, c, t, g, unknown or other
  misc_feature (312)..(312): n is a, c, g, or t
  modified_base (331)..(331): a, c, t, g, unknown or other
  misc_feature (331)..(331): n is a, c, g, or t
  modified_base (596)..(596): a, c, t, g, unknown or other
  misc_feature (596)..(596): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatcgacggtagtttgggctgagcgttgggttttccttggttgcttaagtttttaaaggtcgttaccacgttggtgaggtgctagctgggtggagtcgtggggggatcgtggtccaggcggtcgggggtccctgagctcgtctgtgcagtcctgtggattccgtacttcgtaattactttagactatancgtacacggttccggaccnccgaggaccttacggaacggggtaacggcgtaaggtactaggttcgcgttacaaggtaacgttaagaagtagtacggaactaataaactagtaattatagtactactaaattcggtaggtaagacgggtatactacggtaccaacctcgttaaccgacggtaacgaaacgtaaccctaacgaaacggtacttaacgcgtttaagtacttcgtaatacggaacgtgaaccgtcaaggagtacgcgtaaggaccgtcgtacgtagtntaagttaccgtggtaggtaccgggaagaccgggttacggaacggtttagaacgggtacgggttaacgggttgggtaccgggacgttaaccgggg

SEQ ID NO: 268692 - DNA, 709 bp, Homo sapiens
  misc_feature: GYAE6OF02GYZP7.28.57.F02.1.454.CMB.1.raw
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcgttggtccagccgtggggggtccctgagactctcctgtgcagcctctggtacttcaccttcagttatttangtctatncgacgtggtccgccgaggcctaccgaggggaacgggtacgtaggtaatagtgtctcgtaaggttaataagtaagtaataggacgtaaataaactaataattaattaagtagaacctaaaacttcgtagttaggaacgggtacagtaactttacccaaccgtaagttcccgtaaccgagggtaaacctaacttaacccgaaacgaaccacggtacttagttacttacttaacgaaagtcggggtaccacggtaccgtagaacggacgtcgtaacggacggacgaacggtaccttagttaacgttacgtttaacggttcgggtaagggtacggtaagggtaacggtaacgggttaaccgttaggggtaaaccgggtttaagggggtttacgggttacggggggacccgtaaccgggggg

SEQ ID NO: 268693 - DNA, 589 bp, Homo sapiens
  misc_feature: GYAE6OF02H9QM7.28.57.F02.1.454.CMB.1.raw
  modified_base (298)..(298): a, c, t, g, unknown or other
  misc_feature (298)..(298): n is a, c, g, or t
  modified_base (396)..(397): a, c, t, g, unknown or other
  misc_feature (396)..(397): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
  modified_base (500)..(500): a, c, t, g, unknown or other
  misc_feature (500)..(500): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgctatttttaaaggtgtccagtgtgaggtgcagctgggtggagtcgtggggggaggcttggtccaggccgtgggggggtcccctgagactctcctcggtgcagtccctctggacttccaccttcaagttattttangacttatgcactgggtaccgccaggcctaccgaaggggaaggactaggaaactatgtacctgtaaggtatagaagtaatgacaaataacatatattannanaaactntgagagganagtatcacatacacgaggactaactacaagaactacgactntatcttanaagtggacagactgagacgactaggacgacgaacgtntagtataacgtttacgtggtacgggtaggaaggtaacggacgggtaagttacggtaaggtttaaggggtcggtacggggcgtaacgggg

SEQ ID NO: 268694 - DNA, 779 bp, Homo sapiens
  misc_feature: GYAE6OF02IE4IE.28.57.F02.1.454.CMB.1.raw
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (698)..(698): a, c, t, g, unknown or other
  misc_feature (698)..(698): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagcttgggttttccttgttgcttattttaaagtgtccagtgtgaggtgtcagctggtggagtcgtgggggagcgttggtccagccgtcggggggtccctggagtactccgtccgtgtgcgtagcctctaggtacttccactttcgagttattttangtctagtcggactacgtcggggtaccnccccgtagggtcccgttaccgaacgggggaaacgggtaccgttacgggaaattacggttcgttaccgtaccgtaaggttaacgttaaggaaaggttaaacgtacggaccggtaaaacttaaaccgtaagttaacttaaagtttacgtacggtaactaaaacctttcgttagggtacgggaacgggtactaaggtacttaccaacccgtattcccgaaaccggtaaggtaactaaaccgttacccgaaaggtaaccacccggactttaggtaacttccttaacgtaaacgtcgggaactaccggtacccgttgaacggtataccggttaggaacggtacctaccggtacgttagttacgttaacgtttaaggngggttaacggaaggtagggttaacggacggttaaggtaccggtaacgggttagggtttagggtcccggggagtaaccgggg

SEQ ID NO: 268695 - DNA, 586 bp, Homo sapiens
  misc_feature: GYAE6OF02JA9S9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcacgcctctggacttcaccttcagttatttatgctatgcacgtgggtccgccgacggctccgaaggggagggactaggaactagtcgtctacgtaggttattaagaagtatgacgaataacatatatatgactaatctgagaaggcagactcgactactctacgaggactaactaccgaagacacgtctagtacttaccgttacgaaactgggacacgctaggagtacggagtacgaacggacacgggtactgttacttagttcgttgggtacgggtagacgggaggaacggtaggttacggaacggttgggttgggacgggcggtaacgggg

SEQ ID NO: 268696 - DNA, 821 bp, Homo sapiens
  misc_feature: GYAE6OF02G02I0.28.57.F02.1.454.CMB.1.raw
  modified_base (287)..(287): a, c, t, g, unknown or other
  misc_feature (287)..(287): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaggtgtccagtgtgaggtgcagctggtggagtcgtgggggagcttggtccagccgtggggggtccctgagactctcctgtgcacgcctcgtggacttccaccttctagttattttangtacttagtcgacgtaccgtggggtcccgtaccgacgggtcctaccggaagggggaacgggtacgtacgggtaaattacgtacgtaccgtacgtaagggttaacgttaaaggtaacggttaaagtacggtaaaccgtaaaacgttaaaactaatttaaatttaagtttaaagtacgtaaacctaaaacgttacgttacgggtaacgggtaaacgggtacgtaaacgttaacttacccggtaacctaacggttccccgtaaacggtaacgggtaaaccttaaaccgttaaacccggaaaccgtaaaccgtacgtaccgtttaggttaaccttaccgttaataaaacggtggtacctacggtaccgtaggaacgtacgtacgaacggacgggtaaccgtacggtacgttaagttaacgttacggttaacgggtaggggtaaggtaacgggtagggtaacgggttaacggtaaagggtttacggggtaaaccgggttttaggggtacccgggggttacggggaccgtaaccgggggg

SEQ ID NO: 268697 - DNA, 1041 bp, Homo sapiens
  misc_feature: GYAE6OF02I26J0.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcagtgacggtagtttgggctgagtctgggttttccttgttgctaattttttaaaggtgtccagtgtgaggtgcagcttggtggagttcgtgggggagtcttggtcctaggtccggtggggggtccctgagtacctcgtccgttggtcggactacgtccttcgtagggtaactttccaacccttttacgtaacggttttaatttttacgtacggtaccgttaagttccggtaccggtaaccgggttcgggggttccccggacccggtaaccgggggtcccgtttaaccggggaaacgggggggtaaaaccggggtaccggtaaggggttaaaacgttttacggttaccggttacccgtaacggttaagggtttaaaagttttaaacggggtaaaagttaaaggtttcggaaaaccggtaaaaagtttaaaacctaagtttaaacgtttaaatttaaacgttacgtaaaacccttaaaacgtttacccggtttagggttaaacgggtaaaccggggtaacttaaaccgggtttaaacgttttaaacccgtaaaaccccgtttaacgttttaacccggtaaaccccggggtaaaacggggttaaacccgttaaaaaccggtttaaccccggaaaaaccgggtaaaaacccgttaacccggttaaaccgtttaccgtttaaacgtttaacccgttttaaaacgggtaaaccggtttccggggtaaaccgtccggttaaccggttacggaaaggtaccggacggttaacgggaacgggtaaacccggtacggtttaccgttaaggttacgttttaaccgttaacggttggggttaaacggggaggtaacgggaacgggttaacggttaaacggttagggttaaccgggttaaggggttacggtccggggaccccggtaagggg

SEQ ID NO: 268698 - DNA, 804 bp, Homo sapiens
  misc_feature: GYAE6OF02JFIB7.28.57.F02.1.454.CMB.1.raw
tcagagtacgctatcacgaccggtgctcgatttagctcgatatagttgcgtctgggagaggagccccgccctgggtttcccaggtgttctcatttggtgatcagcactgcacacagaagagtcagtggacggtagtttgggctgaggcttgggtttttccttgttgtcttaagtttttaaaggtgtcctagtgttggagggttgcgagtcgttggtggtaggtcgtggggggagtcgttgggtccgaaggtccggttcggggggttaccctggtacgccgttcgtccgtgtgacgcgtcctcgtggtacttcctacgttctagtttattagtgtactagtcgactacgtcgggtacccgccgtacggtcctaccggaaggggaacggtacgttacggtaattcgtggttactacggtaaggttaagttaaggtaaagttaacgtaggtaacgtaaagttaacaatttaataagtttagaacgtaactaaaccgttgtaggttaacggaaggtaccgtaagtacctttaaacccgaccgttaacgtaccgtaaccggtaagggtaaaccttaaaccgttaccggaaaaccgtaaccgtaccgggtttaactacggttttaaccctaacggttaaacctaaaacgggtttcgggaaacctaaccgttacccgggtaaggtaacgtaacggttacgtaacgggacggtaaccgtggttaccgttagtaacttacggttacggaggagggttaagacggtaagttacgggtagttaaccggtaggtaggggttccggaggtacccggg

SEQ ID NO: 268699 - DNA, 910 bp, Homo sapiens
  misc_feature: GYAE6OF02FL42M.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgtgtctattttaaggtgtccagtgtgaggtgctagctggtggagtcgtggggggagcgttggtccaggccgtggggggtccctgagtactcctccgtgtgcagccttcgtggtattaccaccctttcaagttattttagtcgtacttattcgacgtaccgttcggggttcccgacccgaacggtcccgttacccggaaggggggaaacggtaccgtaggggtaaaacttggtcgttccgtacgtaagggttaatttaagggaaagttaaagttcggaaccgaaaattaaaacattaaactttaaattaagtacggtaaacctaaaactttcgtaaggtttacggggaaaacgggtccgtaaggttaacgtttacccgaaacccgttaaccgttacccttaacccgggtaaaccgggggttaaaaccttaaaacccgtttaaaaacccccgaaaaaacccgtacccggttaaaccgtttaccggttaaacctttaaccgtttaaaccggtaaaacgttacggggaacccttaccggtacccgttaagggaaccggttaacgggtacccgttagggaaccgggtaacccgtacccgggtacgttaacggtttaaggttaacgttacggtttagggccggggggttaaagtaaacggggtaaccgggttaagggtttaacggtttaaggggttaacccggggttttagggggttacgggtaccggggggttaccgggtaaacgggggtaaccccggg

SEQ ID NO: 268700 - DNA, 655 bp, Homo sapiens
  misc_feature: GYAE6OF02FQ4I4.28.57.F02.1.454.CMB.1.raw
  modified_base (533)..(533): a, c, t, g, unknown or other
  misc_feature (533)..(533): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcacgcctctggtacttccaccttcagttatttatgctatgctacgtgggtcccgccgaggcctaccggaaggggaacgggacgtgggaattagtgtctcgtaggttaattagaagtaatgaacgtaaataacattaattaattagtacgaactaaacttcgtaggtaggaacgggacagtacttaccacctattccgtacccgaagggtaacctaacgttaccgaaacgaccacgtactagttacttactacgtaaagtcgggactacgcctagaacgtntcgtaggaacggaccgacggtctagttactagttacggtgggtaacggggaggaagggtaacggtacgggttaagttacgggtaaacggttggggttagggtaccgggggacgtaacggggg

SEQ ID NO: 268701 - DNA, 778 bp, Homo sapiens
  misc_feature: GYAE6OF02H6205.28.57.F02.1.454.CMB.1.raw
  modified_base (629)..(629): a, c, t, g, unknown or other
  misc_feature (629)..(629): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatcgacggaggtttgggctgagcgttgggttttccttgttgcttagttttaaaggtgtccagtgtgaggtgcagcgtggtggacgtcggtgggggaggtcgttggtccaggccggttggggggtcccctggacgtacgtccgtcctggtgccgaaggtcccttgtggtacttccaccgtttaccgagtttaattttacgcgtcgttacgtcggtacctaccggttcgggtacccgtaccgtcggtaccggtccggaaagggtaacgggtacttaggaaaactttcgtcggttaccgtaaccgttaagggtaacgtttaaaggtaaagttaacgtacggaacgttaaaaactaacgtaattaagttaacttaacgtcgtaaactaaacgttacgtaggtggtaacgtcgtagtaaccgtctaacgtctaccgtacggaacgaccttaaacgtcgaaaacgtacctacggttacgtgttaactaccgttacaaacggtcgggtaacnggtacccttaggacgtacgacgttaacggaacgttcggaaccttgacgttataaggtttacggtcgggtagggaacgtaacgggtacgtaagggttaaccgttacgggtagggtttaagggggtcggttacgacccgggttaaaccggg

SEQ ID NO: 268702 - DNA, 754 bp, Homo sapiens
  misc_feature: GYAE6OF02FIDK9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccaggccggttgggggtccctgagacctctcctgtgcgacgtcctcgtggtacttccaccttgagtttattatgctatcgctacgtggcccgcgacgtctaccggaagggaggtacgtaggaactgtgtactcgtaggtaattagaagttagtcggaagtaaactaacgtaatttaataattacgtataacctaaacttcggtagtaggtaacgggtactaacggtacttacaaccctacgtaccgtaacccgaacggtaacctaaaccgttaccgaaacggtaacccaccggtactttacgttaaccttaaccgttacgtaaacgggtcgggtaactacgggtaccgtacgggtaacgacggttaacgtagggaaccggttaccgtacggggtacttacgttaagttaaccgtttacgggtaagggtacggggtaaggggtaacgggtacggggtaaccgggttaacggtttaacgggggttaaaccggtttacgggggttacggggtacgggggaacccggtaacgggggg

SEQ ID NO: 268703 - DNA, 756 bp, Homo sapiens
  misc_feature: GYAE6OF02HD6JS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgacgactctcctgtgcagcctctggtacttccaccttcagttattatgactatcgacacgtcgggtcccgccgaggcctccggaaggggtaacgggtacgtagggaattacgttacgtctacgtaaggttaattaaggtaaagttaacgtacgaaccgtaaaataacctaagttaattaagtttaatacggtaactaaacgttcgtaggtaggaagggactaagtacttaccaactacgttacctacccggtaaggtaacctaaacttacccgaaaacggtaaccacggtacgttacggttaacttccgttaaacgtaaagggtccgggaactacggtaccgtaggtaacgacggtaccgtagggaaacggtacccgaaccggttacgttacggttaactttaagttaccggggtgggtaacggggttaacgggaacgggtaaccggtttacgggttaaagttaccggggtaaggttacggggggtttacgggtccgggggtaacccgtaccgggggg

SEQ ID NO: 268704 - DNA, 703 bp, Homo sapiens
  misc_feature: GYAE6OF02GJ0K0.28.57.F02.1.454.CMB.1.raw
  modified_base (283)..(283): a, c, t, g, unknown or other
  misc_feature (283)..(283): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagtcgtgggggaggtcgttggtccagccggtcggggggtccctgagactctcctgtgcagcctctggtattccgaccttntacgttatttagtgtacttagtgtactacggttcgggttaccccgacgacggtcctaccggaaggggaacgggacgtaggtaatcgtcgttcgtcgtagtaagttagaacgttatcgacgtaaataactattaagttaattagtacgaactaaactcgttaggtacgaaggacgagtaactttacgaccttagtcccgtaaccggaaggtaacctaacgttcccgaaaagtaccgaccgtattacggttaacctattaacgaaggtcggaacctacgggtctagggaccaggtccgtaacgggacgtaccgtaccggttatagttaacgttgttaccggtgggaacggtagggtagggtacgtaacggttaggttacgggtaaacggtttgggggtaaccggtcggggaccgtaacgggg

SEQ ID NO: 268705 - DNA, 703 bp, Homo sapiens
  misc_feature: GYAE6OF02JLKUP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggtcgttggtccgagtccgtggggggtcccctggacgactcgtccgttggtgtcgagcctcgtaggtacttccgtaccttcagttatttatcgcttagtcgcgtacgtcgggtcccgccgaggacctacccggaaggggtaacggtacgtaggaattacgttcgggtaccttacgtaaggggtttaaattaaggtaaacggttaagtagtaaccgtaaaattaactaagttaaattatttaagtacggtaactaaacgtttccgtaggaaggtaaagggacaacgttattacctaacctgttaccgaacggtaaggaaccttaactaaccgaaacgtaacaccgtacgttaagtacttccttaagacgtacgagtacgacgttaagcgtaacgtcgtaaggaacgacggtacgtaagtgtacttagtacgttcgggaggtacggagacggagtaacgtggtaacgttgggtaggtcgggacgtaacgggg

SEQ ID NO: 268706 - DNA, 706 bp, Homo sapiens
  misc_feature: GYAE6OF02GJUFA.28.57.F02.1.454.CMB.1.raw
  modified_base (261)..(261): a, c, t, g, unknown or other
  misc_feature (261)..(261): n is a, c, g, or t
  modified_base (340)..(340): a, c, t, g, unknown or other
  misc_feature (340)..(340): n is a, c, g, or t
tcagagtacgctatcacgaccggtgctcgatttagctcgatatagttggggtctgggagaggagcccccgccctgggtttcccaggtgttctcatttggtgatcagcactgcacacagaagagtcatgacggagtttgggctgagctggggttttccttgttgctatttttaaaggtgtccagtgtgaggtgcagctggtggagtctgggggagcttggtccagcctggggggtccctgagactctcctgtgcagcctcgnggtacttccacctttcagttatttatcgcttatgcacgtgggtcccgcaggccttaccgaggggaaggcgtaggaatangtctacgaggtattagaagtagtagacgaatacatatattagtacgcaaacttcgtgtaggagggtactaggtactaccgaactactcgttccgaaggggtaacaaacgttaacccgaacgaaaccgtacgttaacgtacgtttaacgttcttaacgtaaacgtcgggaaccctaacggtccggttaacggtaaccggtaagtacggttaacggacgggtaaaccgtacggtacgtttacgttaatttaccgtttaggttagggtaaccgggtagggtaaacgggtaacggtaaccgggttaaaggtttaccgggttaaacggggttagggtttacggggttaccggggaccggttaaaccggggg

SEQ ID NO: 268707 - DNA, 866 bp, Homo sapiens
  misc_feature: GYAE6OF02FVAG1.28.57.F02.1.454.CMB.1.raw
  modified_base (275)..(275): a, c, t, g, unknown or other
  misc_feature (275)..(275): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagtactctccgtgtgcagcctctggattcaccttnagttatttatgctatgctacgtcgggtccgaccgagggcctccggaagggggaacggggtacctaggggtaaacttagttggttccttacggaagggtttaactttaacggtaaaaggttaaagtcggaaccgtaaattaaaacctaatttaactttaatttaagtacggaacctaaaaccgtttcgttaagggtaggtaaacggggtaccgtaagttaactttaccgaacccttaagttccccgttaacccggaacggggtaacctaaaacgtttaccccaaaacggaaacccgtaccggaaccgtttacggttaactttaccgtttaaccgtaaacggttacggggtacctaacggtacccgttagggtaaaccggtaggttaccggttagggaaaccgggtaaccgtaccggggtaccgtttaaggggttaactttaacggtttaaccgggtttacggggtaacgggggtaacgggaacggggtaaccggggttaacgggggtttaaacggttttacggggtaaaaccgggtttttaagggggggtttaggggtttacccggggggggacccggttaaccgggggggg

SEQ ID NO: 268708 - DNA, 712 bp, Homo sapiens
  misc_feature: GYAE6OF02F5L77.28.57.F02.1.454.CMB.1.raw
  modified_base (550)..(550): a, c, t, g, unknown or other
  misc_feature (550)..(550): n is a, c, g, or t
  modified_base (608)..(608): a, c, t, g, unknown or other
  misc_feature (608)..(608): n is a, c, g, or t
tcagagtacgctatcacgaccggtgctcgatttagctcgatatagttgggtcgtgggagaggagccccccgccctgggtttcccaggtgttctcatttggtgatcagcactgcacacagaagagtcatgacggtagtttgggctgagcttgggttttccttgttgcttatttttaaaggtgtccagtgtgaggtgcagctggtggagtcgtgggggagtcgttggtccaggccgtggggggtccctgagtactctccgtgtgcacgcctcgtggtaacttccacctttacgagtttaatttactgtacctagttgccgacgttcggggtccgccggaggcccgtaccggaagggggaacgggactaggaattacgtgttctacgtaggttaattaaggtaaacgttagtacgtaacgaaaatttaaacgtaattaaataatttaacgtacgtaaactaaaacttcgttagggtaaggtaacgggactaacggtaacttacccaaactcgtacccgtaaccgaagggtaaacctaaacgttaaccggaaanaaacccgtaggtacttagtttaactacgttaaacgtaagtgggactacgaccgtaganacgtcgaggacgaccgacgtcgttaatacttacgttacgtgggtaggacggtaagggcgtaaggtaattgggaaaccggttggggtcgtacggggtgaacgggg

SEQ ID NO: 268709 - DNA, 704 bp, Homo sapiens
  misc_feature: GYAE6OF02F4GCR.28.57.F02.1.454.CMB.1.raw
  modified_base (329)..(329): a, c, t, g, unknown or other
  misc_feature (329)..(329): n is a, c, g, or t
  modified_base (356)..(356): a, c, t, g, unknown or other
  misc_feature (356)..(356): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgacgactctcctgtgcagcctctggattccaccttcagttatttatgctatgcacgtggtcccgccgagctccgagggaaggctaggaatntgtctgaaggttattaaggaagttaancgtacgtaaataactattaatattaagtgactaaaacttcgttagtacggtaagggcaagtacttaccaacctattaccgtaccgtaaagggtaacctaaacgtttaacccgaaacgtaaacccgtaaccgttcgtaacggtttacctttaacccgttaacgaaaacggttcggggacctaaaccggccgttaagggacgtaacggtcgttaacgggaacggtaccgtacgggtacttaacggttattaacgttacggttagggtaggggaacggtaagggtaggaacgggtaagttacggggtaaacggttaggggttacggggtacgggggtacggtaaccggggg

SEQ ID NO: 268710 - DNA, 770 bp, Homo sapiens
  misc_feature: GYAE6OF02FZJAA.28.57.F02.1.454.CMB.1.raw
  modified_base (333)..(333): a, c, t, g, unknown or other
  misc_feature (333)..(333): n is a, c, g, or t
  modified_base (563)..(563): a, c, t, g, unknown or other
  misc_feature (563)..(563): n is a, c, g, or t
  modified_base (613)..(613): a, c, t, g, unknown or other
  misc_feature (613)..(613): n is a, c, g, or t
  modified_base (635)..(635): a, c, t, g, unknown or other
  misc_feature (635)..(635): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttttccttgttgcttatttttaaggtgtccagtgtgaggtgcagcgtggtggagtcgtggggggaggtcttggtccagccggttggggggtccctggacgacctcctccgtgtgcgacggtcctcgtggtacttccacctttcgagtttatttatcgacttagtcgactacgtcggggtcccnccgacgggccttcggaaagggggaacggtacgtagggtaattagtcgtcgttacgtaagggttaatttaacggaagttaagtcggaacgtaaaattaaacgtatttaaacgttaagttaaagtttcggaaacttaaaacctcgtttaagggtacggaacgggtacacgtttaccttacaaccgttgttacccgaacccggtacgggaaactacgttaaccgaagtaaccnccgttaactgttaactcggtaactaaggtcggaacgtacgtcgagtacgngtaccgttaggaacgtaccggntaccgtttaagttagttaaccggttcgtaacgggggttaaggaggggtaaccggggtcggttaaacgggttaacggtttaacggggttaaagggttcgggggttagggtaccgggggttacccgggtaacggggg

SEQ ID NO: 268711 - DNA, 745 bp, Homo sapiens
  misc_feature: GYAE6OF02H2BVA.28.57.F02.1.454.CMB.1.raw
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (305)..(305): a, c, t, g, unknown or other
  misc_feature (305)..(305): n is a, c, g, or t
  modified_base (395)..(395): a, c, t, g, unknown or other
  misc_feature (395)..(395): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagttttgggctgagcttgggttttccttgttagcttaagttttttaaaggngtccagtgtgaggtncagctggtggagtcgtggggagtctggtccagccgtgggggtcctgagctctctgngacagtccctntggattccacttcattattangctagngacacgtcggtccncagcgtaccgaggggacgtacgtaggaatacgtggtactacgtagggtaattagaaacgtaacgttagacgtaaataacataatagttanacgtaacctaagttctggacggtaacggactagtactttaccgaaactactaccggtaccgtaaacgggtaaccttaaacgttaacccgaaagaaaaccgtaaccgtacgttaaagtaccttaacccgtttaaacaaaacggtccgggaacgtaaccgggttaccgacgggtaacgaacggtacggttaacgggtacccgtaaacggttaacgggtaccttaaaggttaccgtttaacgttttaacgggtcgggtttaaagggacgggtaaagggacccggtaagggtaacgtttaacggggaaacggttttacgggggttaacgggtaccgggggttacggaaccgggg

SEQ ID NO: 268712 - DNA, 617 bp, Homo sapiens
  misc_feature: GYAE6OF02FTZD1.28.57.F02.1.454.CMB.1.raw
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggacttccaccttcagttatttatgctatgcacgtgggtccnccgaggcctccgaggggaaggacgtggaatagtgtctcgaggttattagaagtatgacgtaaataacattatattatgactaaacttctaggtaggaagggcagtacttaccacctatcctacgaagggtaactaacgttaacccaaagaacccgtacgtacgtagttaacttaccgttacgaaacggtgggacacggtccgtaggacgtagtcgtaggacgacgtacggtcttagtacttattacggtggtagggagtagggagtacggtaagttcgggtaaggttaggggttggtacggggacgtacgggg

SEQ ID NO: 268713 - DNA, 638 bp, Homo sapiens
  misc_feature: GYAE6OF02JQEKT.28.57.F02.1.454.CMB.1.raw
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
  modified_base (466)..(466): a, c, t, g, unknown or other
  misc_feature (466)..(466): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgttgttgctattttaaaggtgtccagtgtgaggtgcagctggtggagtctgggggagcttggtccagccgtggggggtccctgagactctccgtgtgcagcctcgtggattcaccttcagtattttangctatgcactgggtccnccaggctccgagggaaggctggaatntgtctacgaggtattaagaacgtatgacgaataacgattatattactgacgaaacttctaggtagaacgggctagtattcgactatcgtaccgagggtaaacacgttacgaaacgaactacgcgttacgtacttccgttaanaacttacgggctacggtaccgttaggaacgtaacggtacttacgggaacgtaccggaaccggttacgttggttaaccgtagtttaacgtgggtaacgggtagggtaacgggtacggaagggttaacgtagggtaacggttaacgggttgggttacgggggaccctaaggggg

SEQ ID NO: 268714 - DNA, 1002 bp, Homo sapiens
  misc_feature: GYAE6OF02F6ST7.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgtgctattttaaggtcgtcagtgtgaggtgcagctggtgagtcgtggggagtcttggtccagccgtgggggtccctggagtactcctccgttagtcgctagtccttcgtaggtacttacgtacccgtttcgaaggttacttttaagtcggtacttaacgtgtaccgtaccggttcgggtcccggtaccgaacgggtcccgttaccgaagggggtaaacgggtacgtagggtaaacttagtacgttcctacgtaacggtaattttaacggaacgtttaacgtacggtaacccggttaaaattaacccgtaagtttaaacgtttaacggttttaaacgtcgggtaaaacctaaaaaccgtttccgggttaaacggtttaacgggggaaaaccggggggtacctaaacggttaacgttttaaccccgtaacccggttaaacgttaccccgttaacccgggtaaaccggggtaaaacccgtttaaacccgtttaaacccccggtaaaacggaaaacccgtaacccgggtttaaccgttagggtttaaacccctttaccggtttaaacccgttaaaacgggtttacccggggtaacccggtaaaccgggttacccggttacgggtaaacggttaaccgggtacccggttttaaagggaaccgggttaaaccggtaacccggggttacccgttaagggttaacggtttaaaccgtttacccgggttaagggttaccggggggtaaggtaaccggggtaacgggttaaccccggggttaaaggttaaccgggggtttaaacggttaccgggggtttaaccggggttacgggggtacccggtaaccggggggg

SEQ ID NO: 268715 - DNA, 584 bp, Homo sapiens
  misc_feature: GYAE6OF02IY1NE.28.57.F02.1.454.CMB.1.raw
  modified_base (339)..(339): a, c, t, g, unknown or other
  misc_feature (339)..(339): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctaattttttaaaggtgtccagtgtgaggtgcagcgtggtggagtcgtggggggaggcttgggtccagccgtggggggtccctggagactctcctgtgcagcctctggacttccaccttcagttattttatgtctatgcacgtgggtccgcgaggcctcgaggggaaggctggaatntgtctacgtaggtatagaagtaatgacgaataanatatattangacaactntgtaggagnagactcacatccgtacaggactaactacaagaaccagtctatacttctaacgtagtcggctacggaccgtgagacgcgtaggaacgaccgacggtcttacgtattacgtacgttggggagggtaaggaaggtacggagggttaagtaggggttaacgttaggggtcggtacggggaccgacgggg

SEQ ID NO: 268716 - DNA, 582 bp, Homo sapiens
  misc_feature: GYAE6OF02FL891.28.57.F02.1.454.CMB.1.raw
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (329)..(329): a, c, t, g, unknown or other
  misc_feature (329)..(329): n is a, c, g, or t
  modified_base (517)..(517): a, c, t, g, unknown or other
  misc_feature (517)..(517): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctggngactcncctgtcgcacgcctctggatcacttcagttatttatgctatgactacgtgggtccgccaggctaccgagggaggactggaatntgtctcaggtattagaagtaatgacgtaaataactagtaatattaatcaactaaactcgtgtagaaagggtcagtataccacctatctacgaaggactaacgttaccaaagaaccacgtcctagttactacttaacaaggtggcacgtcgtagacgagctaggaacgacacgcgttagtatattacgnggtagggaaggaggtacggaaggtaacgttaggaacggttaggggtacggtcggggacgacgggg

SEQ ID NO: 268717 - DNA, 748 bp, Homo sapiens
  misc_feature: GYAE6OF02IN96P.28.57.F02.1.454.CMB.1.raw
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (668)..(668): a, c, t, g, unknown or other
  misc_feature (668)..(668): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggtcgttggtccaggccgttcgggggggtccctggagactctccgtgtcgtcagcctcgnggtnttccaccttcagttatttatgactgtgctacgtcgggtcccgccgaggtcctaccgaggggaacggggtactacgggtaattacgtggtccctacggtaggtttaacgtttaacggtaagttaaagtgacgtaaaattaaaccgtataaatttacgttaatcggtaaccttaaaactccgttaggtaacgggtaaacgggtcgaacgttacgtttaccaaacccttacgttccgtaacccggaacgggtaaccttaaccgttaaccgaaacggtaacccgaccgttacgttacgttaacgttacccttaacgttaaacggtaccggggactacggtaccctaggagtaacgcgtagaccggacgtacggacgttgtacgttatttaccggnggttaggggacgaacgggacggtaacggttaacgttacgggtaacggttacgggtagggttaccggggacgtaacggggg

SEQ ID NO: 268718 - DNA, 740 bp, Homo sapiens
  misc_feature: GYAE6OF02FKRMH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggaggtcttgggtccaggcccgtgggggggtcccctaggacggaccttccgtcctgtgcacgtccctcgtggacttccaccgtttcagttatttagtgcttatcgctacgtcgggtcccgccacggcgtccgaaggggaaggctaggaatacgtcgtctcgtaaggttattagaaagttagtagacgtaaactaactattaacgtttaattagttcgaacctaaaaccgtttcgtacggttaacggaaacggggtcaacgtactttaccaccctacgttcccaaccggtaacggggaaacccgttaaaccttaacccggaaaagtaacccggtaaccgtcgttaacggttaactttacccgttaataaacggtcgggactccggtacctagggaacgacggtacgacggtaacggaccgtacgcgttaagtacgttaacgttacggtgggtacgggaaggtaacgggtacggtaacgggtaagtttacggggaaagtttaggggggtcggttacgggggccgtaacccggggg

SEQ ID NO: 268719 - DNA, 665 bp, Homo sapiens
  misc_feature: GYAE6OF02IIWI3.28.57.F02.1.454.CMB.1.raw
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (412)..(412): a, c, t, g, unknown or other
  misc_feature (412)..(412): n is a, c, g, or t
  modified_base (572)..(572): a, c, t, g, unknown or other
  misc_feature (572)..(572): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagcctggggggtccctgagactctcctgtgcagcctntggattcaccttcagttatttancgctatgcacgtcgggtccgccacgggcctaccggaaggggaacggcgtaggaacttagtcgttcctcgtaaggttaagttaaggaaacgttaagtcgaacgtaaaataaactaattaacttaatttaanaggtaacctaaaactcgttaggtaggaagggtctaaggtcttaccgacatcctaccgaggaactaataccaaagaacacgcttagttactcttaacaaaggtcggtacacgtaccttggacgaggcgttaaggacggtaccgacggtacttaggtaattntttaaccggtgggtacggggaataaggggtaccgaagggttaacttacgggaaaccggttggggggtttacgccgggggtaactaaccggggg

SEQ ID NO: 268720 - DNA, 878 bp, Homo sapiens
  misc_feature: GYAE6OF02GSXG4.28.57.F02.1.454.CMB.1.raw
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagtctgggtggagtcgtgggggagtcgttggtccacggtccggtcggggggtccctggacgtacctccgttcctggtcgcacgcctcgtggattcctaccttctaatttagtttagtcgtctagttcgactaaccggttcgggtacccgcccgtaagggtcctacccggtaaggggaaacgggtccgtaaggggtaaatttacgttacggttacccgtagttaacgggttagttaaacgtaagtaacgttacggacgtaaaacgttaaaccttaattaactttaaacgtttaagttacgaaccgttaaaaaccgttccgttaacgggttaggaaaaccggggtactaaacggtttaacttttacccgaaccgttaaaccgttacccgtacccgggtaaaccgtaccgtaaaactttaacccgaaaagaacccgtaacgttactttacgttaactttaccgtaataaaccggtacggacgttaacgtaccgtacgggtagaaaccgtcgggtaacggtaaaccggtaccgtaaccggtcgttaacggtttaagtttaaccggttaggtttaaacgggggtaggtaacgggtaaagggttaccggaagggggtttaaaccgttaggggttaaacccgggtttaggggggtacccggttttaacggggggacccgttaacccgggggg

SEQ ID NO: 268721 - DNA, 763 bp, Homo sapiens
  misc_feature: GYAE6OF02G2AHP.28.57.F02.1.454.CMB.1.raw
  modified_base (345)..(345): a, c, t, g, unknown or other
  misc_feature (345)..(345): n is a, c, g, or t
  modified_base (472)..(472): a, c, t, g, unknown or other
  misc_feature (472)..(472): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtgggtggagtcggtgggggagtcttggtccagtccggtggggggtcccctggaacgtcctcctccgtggtcgcgacgtccctcgtggaactttcctacccttctaagttaacttttaatcggtctatcgcctacggtcggggttcccnccgtacggcctacccggaagggggaacgggtaccgtggtaaatacgttcgttccgtagtaagggtttaattaaggtaaaagttaacgtagtaacgtaaacttaaataattaaatttaatttaagtanaacctaaaacttcgttaaggtagggaacgacgtaaggtacttacccaactaccgttccgaccggtacggtaaactaaccgttaaccaaacgaaccgacgtacgttattacttaccttaacgaacggtcggacgtaaccgtcgttaaggacgtacgacgtcggtaaacgacgaccggtacttagttacgtaacgtttcggtaggtaccgggagggtacgggtaacgggttacggtaaggttacgggtaaccggttagggggtttacgggtacggggtaccggtaaccggggg

SEQ ID NO: 268722 - DNA, 736 bp, Homo sapiens
  misc_feature: GYAE6OF02J12OQ.28.57.F02.1.454.CMB.1.raw
  modified_base (263)..(263): a, c, t, g, unknown or other
  misc_feature (263)..(263): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcactgacggagtttgggctgagctgggttttccttgttgctatttttaaaggtcgtccagtgtgaggtgcagctggtggagtcgtgggggagcgttgggtccaggccgtggggggtcccctggagcctctcctgtagccncgtcctcgtggtacttcctaccttctacgttacttttaagtgtcctagtcgcgtaccgttcgggtcccggcccacgggtcctaccggaaggggaacgggaaccgttagggaattaacgtcgttaccgttccggtaaggttacttaaggaaagttaagtcggaacgtaaataaccgtattaacgttattacgtacgtaactaaacttcgttaggtaaggacgggtacagtaacgttccaacctcgtacctccgaacggaactaacgttaccaaagaccacgtccttaagtcttactacgtaaacgcggactaacgcctaggacgtacggacgttacggacggtaccgaccgggtacttacgggttaacttggtttaccgtacggggtacgggaagtaacggggtgaaccggtaaggttacggggtaaacccggttaggggtttaccggggttacgggtacccggtaaccggggg

SEQ ID NO: 268723 - DNA, 846 bp, Homo sapiens
  misc_feature: GYAE6OF02FORGW.28.57.F02.1.454.CMB.1.raw
tcagagtacgctatcacgaccggtgctcgatttagctcgatatagttgggtctgggagaggagcccccgccctgggtttccccaggtgttctcatttggtgatcagcactgcacacagaagagtcatgacgggagtttgggctgagctgggttttcctgttgctatttttaaaggtgtccagtgtgaggtgcagctggtggagtcgtgggggaggctttgggtccgagtccgtggggggtccctggagactcgtcctgtgcagcctcgtggattccacttcacgttatttagtcgcttagtcgtactaccgttcggggtcccgccgacgggcccgttacggaagggggtaaacgggtacgtacggtaaagttagttacgtccgttacgtaaggttaacgtttaagaaaggttaagtcggaaaccgttaaataaacgtataacgtttaagttacgtacgtaacctaaaacgttccgtagggtaacggtaagggcgtaacgttaccttacggaaaccctcgttacccgtaaccggtaagggtaaccctaaacgttaacccgaaaagaaccctaacggttacgtagtttaaccgttacgtttaaccgaaacggtttgggaccgttaacggtaccggttaacgggtaagtaccgggttaccgtagggtaaaccggaaacccggtaccggttacgttaacgttaacgtttaggtttaacccggtggggttaacgggggaacgggttaaaccggggttacgggtaaacggggttaacgggtttacgggggttaaaaccgggttttacgggggtttacgggggtccccgggggtaacgggtaaccccgggggg

SEQ ID NO: 268724 - DNA, 821 bp, Homo sapiens
  misc_feature: GYAE6OF02IY5OM.28.57.F02.1.454.CMB.1.raw
  modified_base (728)..(728): a, c, t, g, unknown or other
  misc_feature (728)..(728): n is a, c, g, or t
tcagagtacgctatcacgaccggtgctcgatttagctcgatatagttgggtctgggagaggagcccccgccctgggtttcccaggtgttctctatttggtgatcagcactgcacacagaagagtcatgacggagtttgggctgagtctgggttttccttgttgtacttaatttttaaaggtgtcctagtgtggaggtgcagcgtggtggagtcgtgggggaggtcgttggtccacggtccggtcgggggggtccctaggacggtaccttccgtccgtggtcgtccacgtcccgtcgtaggtacttccaccctttacgacgtttaattttagtacgtacgttacgtcggtacctaaccggttccggggtacccggtccccggtaacggggtcccgttaaccgggaaagggggtaaaccggggtaacgtaacgggtaaacttacgttacgttaccgttacgtaaggttaacggtttaaaggtaaaaggttaagttacggaacgttaaaaacttaaacgtaatttaaaagtttaattacgttaacggaaccttaaaaccgttacgttagggtaaggaacgggtaacaacggttaaccttaccaaccgtaactccgtaaccgtaaacggtaactaaacctacccgaaaagaccgtaacgtacttataaccgttacttaacgaacgtcgggacacgtaccgagacgtcgacgtacggtaaggacgtaacggtntagtaacgttagtaggtcgggttaaggaaggaacggtagtaacggttaggtacggttaacgggtagggtcgggtacgggtaccgggtaacggg

SEQ ID NO: 268725 - DNA, 623 bp, Homo sapiens
  misc_feature: GYAE6OF02FO2P4.28.57.F02.1.454.CMB.1.raw
  modified_base (373)..(373): a, c, t, g, unknown or other
  misc_feature (373)..(373): n is a, c, g, or t
  modified_base (520)..(520): a, c, t, g, unknown or other
  misc_feature (520)..(520): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtggggggtccctgagactctcctgtgcacgcctcgtggtattcaccttcagttatttatgctatgcacgtggtcccgcaggctccgagggacggactggaatagtgtctcgaggtattagaacgtatgacgaatacgatatattancgacaaactctgtagaagggcagtacttacaccagtccaccgaagggtactaacttaccgaaagtaccaacggtcttcgtaacttccttaagaaacgttgggacctacgtccttggaagtcgaccgttagggacgtaccgtacggtnttacgggtatacgttacgtgggtacgggaaggagggaacggtcgggttaaaggttacgggaaccgggtttaggggtcgggtacgggggtaccggtaacggggg

SEQ ID NO: 268726 - DNA, 789 bp, Homo sapiens
  misc_feature: GYAE6OF02GPIS4.28.57.F02.1.454.CMB.1.raw
  modified_base (209)..(209): a, c, t, g, unknown or other
  misc_feature (209)..(209): n is a, c, g, or t
  modified_base (273)..(273): a, c, t, g, unknown or other
  misc_feature (273)..(273): n is a, c, g, or t
  modified_base (333)..(333): a, c, t, g, unknown or other
  misc_feature (333)..(333): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggtagtttgggctgagtcttgggttttccttgttgcttatttttaaggtgtccagtgtgagtgcagctggtgagtcggngggggaggtcgttggtccaggcccggttcggggggtccctggacgtacccttcgtccgtggtanaccgtcgtcccttcggttaggtaacctttccgtaaccctttcgtaaagttaagtttttcncggttactttacgcgtacccgtacggttccgggaccccgacgtacggcccgttacggaaacggggtaggacgtaggtaactagtgttcagtaggtaatacggtaatgtagaaccgtaaattaacattactttaagtaactcgtaaactaagttcaggtaaacggaaggtaccgtaagtaaccttaaccgtaacctacgtacccgtaaccggaacggttaaccgtaaacttaacccaaacgtacccgaacggttactacgttaactttacgtaacgtaacggtggtaaccgtacggtccgtagggacgaacggtacgtacgtaacggtaccgacgtacgttactttacgttaacggtttacggtaagggtaacgggtaagggaaggggtacggtaacggttaacggttacgggttaaggggttaccggggtagggtaccggggtacgtaacccgggg

SEQ ID NO: 268727 - DNA, 833 bp, Homo sapiens
  misc_feature: GYAE6OF02JPVLI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctattttaaggtgtccagtgtgaggtgcagctggtggagtcgtgggggagcgttgggtaccaggccggtcggggggttccctaggacgtaccttccgttcccgttggtcgccgacgtccccttcgttggtaactttcccgtaaccctttccgtaaaggtttacttttatcggtacctttaagtcgtccgtaaccggtccggggttaccccaccggacgggtccgttaccccggaaggggtaacgggcgtaaggtaaacttgtcggtactacggtaagggttaattaaacggaagttaaacgtcggaaaccttaaaacgtaaacgtattaagtttaagttaacgtacggtaaactaaaaccgttccgttggtaaagggacggtactaagtaccttacgacctacgttaccgaccgtaacggtaacctaacttaccgaaaacgtaccgacgtacgtagttaacctttacgaacgtaaacgtcgggaactaccgtacgtacggtaacgaacggttccgtaacgacggtaaccggaccgttacgttacgtttaagtaaccgtttagggtaacgggtaaccggtaacgggaacgggttaacggtaggtttaaacgggttacgggttaaaccggggttaggggtttacgggggaaccggggtaccgggtaaccgggg

SEQ ID NO: 268728 - DNA, 692 bp, Homo sapiens
  misc_feature: GYAE6OF02FP7Z3.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcgttggtccagccgtggggggtccctggagacctctcctgtgcagcctctggacttcaccttacagttattatcgtctatcgactacgtcgggtcccgccgacggtccgtaccggaagggggaacgggtaccgtaggaaacttagtcgttaccttaccgtaaggttacgtttaagaaaggtttaatacggtaacgtaaagtaaactagttaattaagttactacgacctaaaacgttcgtaggtaaggtaacgggtcgaagttactaccgaaccctagtcccttacggaaggtacctaaagttacccgaaacgaacctacgtactagttactacttacgaagtcgggacacgtactgaacgcgacgtagaacgtcgacggtcttagtagtaacttaggttggtaggaagggtaggtaaccggaggttaacggttacgggttaaacggtcggggtttagggtccgggacggttaaccgggg

SEQ ID NO: 268729 - DNA, 746 bp, Homo sapiens
  misc_feature: GYAE6OF02F5IVS.28.57.F02.1.454.CMB.1.raw
  modified_base (442)..(442): a, c, t, g, unknown or other
  misc_feature (442)..(442): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggtttttccttgttgcttaagttttttaaaggtgtcctagtgtggaggtgcagctgggtggagtcgtgggggagtcgttggtccaggccggttcggggggtccctgacgactcctccgtgtgcgacgcctcgtggtacttccaccttcgtagttatttatcgtctagtgacctacggtcggggtaccccgaccgacggtcctcccggaaggggtaacggtacgtaggtaaactagtcgttactgtaagttagttaagtaagttaacgtgaacgaaataacgtattaatattntagaactaattcgtaggtaggaacgggtatagtacttaccaaccgtactccgtaccgaacggtaaacgttaaccttaaccgaaacgtaaccgtacgtcgttacttacttaaccgttaaactaacggtcggacgtaccgtacgaggtacgtgtaacgtacggaacgtacgtaaccgggttcttaagtttaccgtaagttttacgggtaacgggttagggaaacgggtaggtaacgggtacggttaagggtttaacggggtaacgggtttacggggttacgggtaacggggtacggtaaccggggg

SEQ ID NO: 268730 - DNA, 813 bp, Homo sapiens
  misc_feature: GYAE6OF02I96F5.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagtcgtgggggaggcttcggtccgagccggtcggggggtccctgagactctcctgtgcagcctctggacttccacctttcagttatttatgctagtcgctacgtcgggtcccgtccgacggccgtaccggaaggggaacgggtacgtaggaattgttcgtaccgtgtaacggttattaaaggaaagttaaacgtgtaaccgtaaaactaaacgtaattaaattaaagttacgtaacgaaaccttaaaacctacgttaggttaaggtaaaggggactaaggtacttaaccaaccctaacgttacccgtaaccggtaaacgggtaacctaaaaccgttacccgaaaacggtaaccaaccgggttactttaaccgttacttaccttaaccgtaaaggtccgggttaccgaaccggtaccttagggaacgtacggtaaccgtagggaaacgggtaaccgtaacgggtaaccgtttagtaacttaacggtttaaccggttgggttaaacgggggaggttaaacggggacgggttaacgggttaaacgggtttaaggggttaaacccgggtttaagggggttaccggggttaccgggggaccgggttaaccggggg

SEQ ID NO: 268731 - DNA, 865 bp, Homo sapiens
  misc_feature: GYAE6OF02IMJPW.28.57.F02.1.454.CMB.1.raw
tcagagtacgctatcacgaccggtgctcgatttagctcgatatagttgggtctgggagaggagcccccgccctgggtttcccaggtgttctcagtttggtgatcagcactgcacacagaagagtcatgacggtagtttgggctgagcttgggttttccttgttgtcttagttttaaaggtgtcctagtgtgaggtgcagcgtggtggagtcggtgggggagtcgttggtccgaggccggtggggggtcccctggagacttctccgtgtcgcgagtccctcgtggtacttcctaccttcgtaagttaactttagtcgtacttgtcgtctaccggttcgggtcccgtcgaacggtccgtaccggaaggggaacggtaccgtaggaattacgtcgtaccgtacggtacggttaagttaaggtaagtaaggtcgtaacggtaaacttaacctagttaattattaagtacgtaactaaacgttaccgttaggtacggtaaacggtacgtacgttaaacgttacccgtaaccgtaccgtttcccggtaacccgggtaaaagggttaaccgttaaaacccgtttaacccgaaacggtaaaacccgttacccggttaacgtttaaccgtttaaccgttaacccgttaaacgtaaacgggttaccgggtccgtaaaccggtccgtacgggtaaaacgtcgtacggttacggaacccggtaaacgggacccgttaggttaaccgtaacgtttacggtaccggtttaggggaacgggttaacgggacgggttaacgggtaaccgggttaacggtttaacccgggtaagggtttaaacgggggttcgggttaaccggggaccggtttaacccggggg

SEQ ID NO: 268732 - DNA, 616 bp, Homo sapiens
  misc_feature: GYAE6OF02GFHNF.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctggagactctcctgtgcagcctcgtggattcacctttcagttatttatgcttatcgcacgtgggtcccgaccaggcctaccgaggggaagggtactggaatagtgtcgtcaggttattagaagtatgacgaataacatagtattaatcgaactaaactcgtagtaggaagggctaaggtacttcaacctagttccacgaagggtaactacttaccaaagtaccacgtctagtacttcgttacaaaggtcggactacgctaggacgagtaccgtaggagacgacgtcgttagtacttagttaccggtggtagggaaggaggtaagtcggtaagttcgggtaaacgttcggggttacggtacgggggacgttaacgggg

SEQ ID NO: 268733 - DNA, 706 bp, Homo sapiens
  misc_feature: GYAE6OF02IL4WU.28.57.F02.1.454.CMB.1.raw
  modified_base (242)..(242): a, c, t, g, unknown or other
  misc_feature (242)..(242): n is a, c, g, or t
  modified_base (294)..(294): a, c, t, g, unknown or other
  misc_feature (294)..(294): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgngactctcctgtgcagcctctggattccacctttcagttattttatgcttatncacgtcggggttcccgccgacggtcctacccggaagggggaagggaccgtagggaatagttcgtcctcgtaaggttaagttaaggaaggttaaacgtggacgtaaagtaaacattaattattagtacactaaaactctaggtagaagggacaagtacttcgaaccatcctacgaagggaactaaagttacccgaaagtaaccgaacgccttagtacttacttacgaaacgtcgggacgacgccgtacggaagcggacgttagacgggtacgaacccggtagttaacggttagttttaacgtacggttgggtaacggggtaagggtaacggggtacggtaacggggtttaacggtttaggggtaaacccggtttaaggggggtttacggtcggggggtaccggtaaccggggg

SEQ ID NO: 268734 - DNA, 682 bp, Homo sapiens
  misc_feature: GYAE6OF02IMS31.28.57.F02.1.454.CMB.1.raw
  modified_base (291)..(291): a, c, t, g, unknown or other
  misc_feature (291)..(291): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagcttgggttttccttgttgcttagttttaaaggtgtccagtgtgagtgcagctggtgagtcgtgggggagtcgttggtccagccgtgggggtcctgagacctctcctgtcgcagcctcgtcggtattcgaccttcagttacttttangcttagtgctacgtcggtccgcgacgccgtccgaagggacggactaggaatagtgtctcgtaaggttataagtaaagttagacgtaacgaaagtaactaagttaatttaactagtacgttaacctaaaacgtttccgtagggttaacggtaacgacgtaagttacgttaaccgaacctacgttacccgtacggaacggtaaaccttaacctaaccgtaaacgtaacgaccgtacttacgtacgttacgtaacgtaacggtacgtacgaccgtacgtagtacgaagtcgacgtagacgacgtacgtatacgttagtccggtggtacgaacgggaggtacggaacgtaggttaggtaccggttagggtttccgggacgggtaacgtaccgggg

SEQ ID NO: 268735 - DNA, 684 bp, Homo sapiens
  misc_feature: GYAE6OF02F0CW5.28.57.F02.1.454.CMB.1.raw
  modified_base (389)..(389): a, c, t, g, unknown or other
  misc_feature (389)..(389): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcacgtgggtccgccaggcctccgaaggggaacggactggaaatgtgtctcgaggttattagaagtaatgacgtaataacattaatattatgactaaactntaggtagaagggacagtattaccgaacctagtcctaccggaaagggtaacctaaacgttaccgaaaacgaaaccgtacgtacttacggtttaacttaccctttaaagaaacggttcggggactaacggtcccgtagggtacgaaggtccgttaacgggacgaacccgttacgggactttaagggttattaacggtttacggttcgggtaggggaaaggacgggttaaggaccgggttaaagtttggggtaaaccggttagggggtttccggggttacgggaccggtaaccggggg

SEQ ID NO: 268736 - DNA, 867 bp, Homo sapiens
  misc_feature: GYAE6OF02FFXD8.28.57.F02.1.454.CMB.1.raw
  modified_base (197)..(197): a, c, t, g, unknown or other
  misc_feature (197)..(197): n is a, c, g, or t
tcagagtacgctatcacgaccggtgctcgatttagctcgatatagttgggtctgggagaggagcccccgccctgggtttcccaggtgttcctcatttggtgatcagcactgcacacagaagagtcatgacggtagtttgggctgagtctgggtttttccttgttgtcttaagttttaaaggtgtccagtgtgaggtncgagcgtggtggagtcggtgggggtacgtcgttcggtccgacggtcccggtcggggggttccctggacgtaccgttcctccgtggtcgaccgtccgtccttcgtacggtacttcctaccgttcgtaaggtttacttagtcgtacttacgtcggactaccggtccggtcccggaccgtacgggtccctaccgggaaaggggtaacggtacgtaacggtaacgtttacgtcgttaccgtacggtaaaggtttaaagtaaacggttaaaggttaaacgtacggtaacgtaaaacttaacgtaaatttaactttaaacgtttaacgtaccgtaaaacccgttaaacccgttacgggttaagggttaaacgggaacggtaccgtaaacggtttacccttaccgaaccgttacgtacccggtaaaccgggtaacggtaaaccttaaccctaaaaccggaaccgtaaacctaccggttacgtacgtttaacctaccgttaaacgtacggttcggaactacggaccgtaagtaacgacggtacgacgggaaaccacggtaccgttagttaacgttaccgttaagggtaccggttaagggacggggaagtacggggaacgttacgggttaacggttacggggtaacggtttgggacgggtacccgggaggtaacccggg

SEQ ID NO: 268737 - DNA, 737 bp, Homo sapiens
  misc_feature: GYAE6OF02IB10J.28.57.F02.1.454.CMB.1.raw
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (430)..(430): a, c, t, g, unknown or other
  misc_feature (430)..(430): n is a, c, g, or t
tcagagtacgctatcacgaccggtgctcgatttagctcgatatagttgggtctgggagaggagcccccgccctgggtttcccaggtgttctctatttggtgatcagcactgcacacagaagagtcatgacggagtttgggctgagtcttgggttttccttgttgtcttaattttttaaaggtgtccagtgtgaggtgcagctggtggagtcgtgggggaggtcgttggtccaggtccggtcggggggtcccctggacgacttcctccgtgtcgcacgtcctcgtggtacttccaccttcagttatttatgtctatgctacgtcgggtcncccgngtcctaccggaaggggaacggtacgtaggaatagtcgtcgtacgtaaggttataaggaaagttagaggaacgaaataaactagttaattaattaanacgtaacctaaactcgtaggtaggaacgggactaagtactttacccaaccttacgttaccctacggtaaaacgggtactaaaccgttaaccgaaacgtaaccgtaacgtcttacgtaactttacgtaaacgtaaaggtcggacgtacgtcgtagaacggtagtccgtaagggaaccggtaccacggggtacttaagttacgttaacgttaggtaggggtaacgggaaaggacgggtaggtaacgggttacggttaaacgggtaccggggtttaaggggtttcggggaaccggggacccggtaagggg

SEQ ID NO: 268738 - DNA, 632 bp, Homo sapiens
  misc_feature: GYAE6OF02ID0PN.28.57.F02.1.454.CMB.1.raw
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttcctgttgctatttttaaaggtgtccagtgtgaggtgcagctggtggagtgtgggggagcttggtccagccgtggggggtccctgagactctcctgtgcagccgtctggattcaccttcagttatttatgctatgcgtatgggtccgcctaggcctaccgaggggacggactaggaatagtcgtactcgtaaggtaagttagaaaccgttaanagaccgaaataagtaatataaatttnaacgtacaaaacgttccgtagttacgggaagggctaaggtacttacaccttaagcccttaccgaagggaactaacggttaccacggtaaacacgccgttagtacttacgttacgaaagttcggataaccgcgttaggagagtaccgtggaacggtacaacggtgtacctattaagttaccgtgggaaggtaggacggaagcggttaaatcgggaaagttgggtaggtcggggactacggggg

SEQ ID NO: 268739 - DNA, 627 bp, Homo sapiens
  misc_feature: GYAE6OF02GCO29.28.57.F02.1.454.CMB.1.raw
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (303)..(303): a, c, t, g, unknown or other
  misc_feature (303)..(303): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtncagcctctggattcaccttnagttatttatgctatgcacgtcgggtcccnccgaggcctccggaaggggaacgggtactagggaatagtgtctcgtaggttattaagaagtaatgaacgaaataactataacttattatacgactaaacttcgtaggtaggaacgggcaagtacttaccacctatccgtaccgaagggtaactaacgttaaccgaaagaaccgacgtcttacgtattaccttaagtaaaggtcggactacggccgtagacgagtcgtaggacggactcggtatagtattacgttagtggtaggaaggtaaggacgtaaggtaaggttacggaacggttagggtcgggtacgggcggtaacgggg

SEQ ID NO: 268740 - DNA, 737 bp, Homo sapiens
  misc_feature: GYAE6OF02GSP6D.28.57.F02.1.454.CMB.1.raw
  modified_base (272)..(272): a, c, t, g, unknown or other
  misc_feature (272)..(272): n is a, c, g, or t
  modified_base (290)..(290): a, c, t, g, unknown or other
  misc_feature (290)..(290): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctgagactctcctgtgcagcctctggattcgaccttnacgttatttatgtctatncacgtgggtccgccgaggcctaccggaaggggaagggacgtagggtaatagtcggtcttacgtaacgggtaattaaggtaaagtaagttagaacgtaaataaacattaattaattatacgactaaaactcgtaggtaggaacgggacgtaagtaacttaccgacctaactacctaccgaagggtaacctaaacttaacccgaaagtaaaccgtaaccgacgttaacgttaacttaaccgttaacgtaaaacggtcgggtaacgtaacgacccgttaggaacgtaacggtaccggtacgggtaacgggaaccgtaaccgggttaccgttaagttacgttacgtttaacggttagggtaacggggagggtaagggaacggttaacggttaaggttacggttaacgggttaacggggtttagggtacccggggggaacggtaaccggggg

SEQ ID NO: 268741 - DNA, 729 bp, Homo sapiens
  misc_feature: GYAE6OF02FLIW8.28.57.F02.1.454.CMB.1.raw
  modified_base (310)..(310): a, c, t, g, unknown or other
  misc_feature (310)..(310): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttggggctgagcgttgggttttccttgttgcttaagtttttaaaggtgtccagtgtgaggtgcagctgggtggaggtcggtgggggagcgttggtccaggccggttcggggggtccctgacgacctctcctgtcgcagtcctgtgacttccaccttcagtttattagtgcttagngctacggtcgggtcccgcgacgggtccaccggaagggggacgtacgtaggtaagttacgttcgttacgtacggtaagggttaataaggaaaagttaacgtacggaacgtaaaataaacgtattttaaagtaacgtttagtacgtaaaccttaaactttcgtaggtaggaacggtactacgttagtaccaacgtactcgtaccgaggaactagtaaccgaacaacgcgttacagtttactacgtttaacaacggtcggaccagtccggagaagtcgtcgaacgggagtaccggacgtttacgtagttacgttaacgtggtttaacggggacgggaaggttaccggggaaggttaccggtttaaaggttaccggggaacggggttttaaggggtcccggggtagggtaacccgggtcgggg

SEQ ID NO: 268742 - DNA, 792 bp, Homo sapiens
  misc_feature: GYAE6OF02IR34U.28.57.F02.1.454.CMB.1.raw
  modified_base (296)..(296): a, c, t, g, unknown or other
  misc_feature (296)..(296): n is a, c, g, or t
tcagagtacgctatcacgaccggtgctcgatttagctcgatatagttgggtctgggagaggagccccccgcccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtcggggggtccctgacgactcctcctgtgcagcctcgtggacttccacctttcgaagttattttancgtctagtgtcacgttcggggtcccgccgaggtccctacggaaggggaacgggacgtagggaaacttagtgtccgtagaggttaacttaagaaagtaagtacgaacgtaaattaaacattaaattagttaatagaactaaaacttcgttagtaggaacgggtcaagtacgttacccaacctacgttcctaccggaaggtaaacctaaacttacccgaaaacggtacccgtaacgtcttaggttaacttcgttaactaaaggtacggactaaccggtccgtaggtaaacggacggtacgtacgggtaaaccggacccggttaaaccgggcttttaacgggttaacttaacggtttttaacccgggtaagggggtttaacgggaaacgggggttaaaggggtacgggtaaacggggttaaggttttaaccgggggttaaggggtttaaccggggggttttcgggggttacggggggtaaccccggggtaaccgggggg

SEQ ID NO: 268743 - DNA, 784 bp, Homo sapiens
  misc_feature: GYAE6OF02FTUOJ.28.57.F02.1.454.CMB.1.raw
  modified_base (639)..(639): a, c, t, g, unknown or other
  misc_feature (639)..(639): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcgtgggtttttccttgttgcttattttttaaaggtgtccagtgtgaggtgcagctggtggagtcgtgggggagcgttggccagccgttggggggtccctgacgactctcctgtgcagcctcgtggattccaccttcaagttactttagtcgtctatcgtctacggtcggggtcccgtaccgacgggtccctaccgggaagggggaacggggtaaccgtagggtaaagttacgtacggttaccgtaccgtaagggtttaactttaaaggtaaaaggttaactaggaaccggttaaattaaaaccgtaatttaaacgtttatttaagtacgtaaccgttaaaacttcggttaaggtaaggtaacgggacgtaagtacgtaaccaacccgttagttacccgtaccgggtaacggtaaacctaacgttaacccgaaacgaaaccgtacgtacgttacgtaactttaccgtaacgtaaggtcggacgtacgtccgtagnggtaacgtcgtaagggaacgtacggaacgtaccgttagttacgttaacgtttacgggtaccggttagggaacgggtagggaacgtagggttaaggtacgggttaaccgggtaggggttttacgggtcggggaccggtaacggggg

SEQ ID NO: 268744 - DNA, 690 bp, Homo sapiens
  misc_feature: GYAE6OF02IFHIE.28.57.F02.1.454.CMB.1.raw
  modified_base (626)..(626): a, c, t, g, unknown or other
  misc_feature (626)..(626): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttattttttaaaggtgtcagtgtgaggtgcagctggtggagtcggtgggggaggtcgttggtccaggccgttcggggggtccctggacgtacctccgtccgtgtgcacgtccttcgtggtacttaccaccgtttcaagttattttagtgcttagtcgctacgtcgggtcccgccgaggcctaccggaggggaaggactaggaatagtgttctacgtaaggttacttaagaaagtaagttcgaacgtaaattaactaattaatttaattaagtacggtaacctaaacttcggttaggtaggaaacggggtctaaggttactttacccaaccgtacgtacgtaaccgagggtaaactacgttaacccaaagaacgaccggttactgttaacttctaagaacgttcgggactacgccgtagagtacgcggtaagaccggacgtacgtgtagtacgttacttaggngtacggggagaggtacgacggttagtacggtaacgggttagggtttcgggaccggacgtacggg

SEQ ID NO: 268745 - DNA, 804 bp, Homo sapiens
  misc_feature: GYAE6OF02HDOXS.28.57.F02.1.454.CMB.1.raw
tcagagtacgctatcacgaccggtgctcgatttagctcgatatagttgggtctcgggagaggagcccccgccctgggtttcccaggtgttctcatttggtgatcagcactgcacacagaagagtcatgacggagtttgggctgagctgggttttcctgttgcttattttaaggtgtccagtgtgaggtgcagctggtggagtcgtgggggagtcgttggtccaggccgttggggggtaccctggacgacgtctccgtgtcgcagcctgtggattccgaccttgagttactttagtgtctatcgacctacgttcgggtccctccgagggtccctaccggaagggggtaacgggtaccgtagggtaaacttcggttacgttaccgtacgtaagggtttaacgtttaaggtaaacggttaagtcggtaaacgtaaaacttaaacgtaacttaattaagtttaactacggtaacctaaaacgttcgttaaggtaacgggtaaacgggtataacgtaacgtttaccaaaccggtacttacccggtaacggaaacggtaaacctaaacttacccgaaacggtaacccgtaagtaccgtttaacgttaccttaccgttaacgaaagggtccgggacctaccggtaccgtaggaacgtaccggtacgtaggggtaaccgacctaccgggttagtacgtttaataccgggttttaaggtcggggtaacggaagggtaacgggtacggttaagggttaacgtacggggttaaacgggtttgggggtacgggtaccggggtacccggtaacgggg

SEQ ID NO: 268746 - DNA, 694 bp, Homo sapiens
  misc_feature: GYAE6OF02IMEAY.28.57.F02.1.454.CMB.1.raw
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccaggccgtggggggtccctggagactctcctgtgcagcctctggattcaccttcagttatttangctntcgctacgtcgggtcccncgacggccgtaccgaaggggaacggactagggtaactagtcgtctacgtaaggttactaaggtaaacgtaagtgacgtaaataaacgtattaatattacgtagactaaactcgtagtaggaaggctagtacttcaactagtccgtacgaagggtaaccaacgttaccaaagtaccgtaacgtcgttagtaacctttcttaacgaaacggtcggtacaaccggtccgttaagaacggtacgtcgtaacgggaacggtaaccaccgggttaacttgggttaaacttagtttaaccgggtgggtaagggaggtaacgggtaacggtaacgggttaagttaccggggtaaaccggttagggggtttcgggtaccggggaccggtaacggggg

SEQ ID NO: 268747 - DNA, 697 bp, Homo sapiens
  misc_feature: GYAE6OF02JWX1W.28.57.F02.1.454.CMB.1.raw
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
  modified_base (359)..(359): a, c, t, g, unknown or other
  misc_feature (359)..(359): n is a, c, g, or t
tcagagtacgctatcacgaccggtgctcgatttagctcgatatagttgggtctgggagaggagccccgccctgggtttccaggtgttctcatttggtgatcagcactgcacacagaagagtcatgacggtagtttggctgagctggtttcctgtgctatttaagtgtccagtgtgaggtgcagtctgggtgagtcgtagggggagtcctttggtaccgagccggtggggggttccctggagtaaccttcctccgtgtacgcgtacgccttcgtggtacttctacccttgtacgttattttagcgtctatgacctacgnggtaccncagggtctaccgaggaagggtcaggtactagtcncgtacgtacgtagtaagtagtaagtcgtacgaaataactattaatagtttatacgactaaaccgttgtaggtaaggacgggttaccaggttacgtacctaccgtacttacgtaccggtacgtaactacgtaacctaacgaacgtcgaaccttacgtaactacgttaacgtagtacggtcaacgttccgagtcgacgtaacgggttacgacgggtaaaccttaccgggacgttagttaccttaaacgggttcgaacggggtttaggagggtacgtaagggccgttaagggttacgtaaccggtttaggggtttacggacggggtaaccggttaaccggg

SEQ ID NO: 268748 - DNA, 712 bp, Homo sapiens
  misc_feature: GYAE6OF02IWCOH.28.57.F02.1.454.CMB.1.raw
  modified_base (160)..(160): a, c, t, g, unknown or other
  misc_feature (160)..(160): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (451)..(451): a, c, t, g, unknown or other
  misc_feature (451)..(451): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (591)..(591): a, c, t, g, unknown or other
  misc_feature (591)..(591): n is a, c, g, or t
tcagagtacgctatcacgaccggtgctcgatttagctcgatatagttgggtctgggagaggagccccccgcccctgggtttcccaggtcgttcgtcaagtttggtgtactctaggcacctgcgacacgagaaggagtacgatgacggtagtttgggctgngctgggttttccttgttgctatttttaaggtgtccagtgtgaggtnctagntggtggngtcgtgggggagtcttgggtccaggtctcgggggggtccctgacgaccttcctccgtgtcgcacgtcctcgtggtacttcctaccttacgtagttttaatttagtggtaccttaatcggtctaaccggttcggggttccccaccggtcggtaccgtacccggaaggggaaacggggactttagggaaacttggttacgttactacggtaaggttaaagttaaggaagtttaancggaacgtaaataaactattattaattcgtagactaacttcggagtagacggtanaagttntaccacgtaatccagacgtaatacctcaaacgactcgttatacgttactcttaataagtcggcatccgagtggtaccgntacggaacggccgaggtattcgtagttaactttccggggtaggtacgggagtaaacgggtcggtaacgggtttaacggtacggtaacggggttggttaccggggtggggaacccgtcgggg

SEQ ID NO: 268749 - DNA, 742 bp, Homo sapiens
  misc_feature: GYAE6OF02I4URQ.28.57.F02.1.454.CMB.1.raw
  modified_base (176)..(176): a, c, t, g, unknown or other
  misc_feature (176)..(176): n is a, c, g, or t
  modified_base (262)..(262): a, c, t, g, unknown or other
  misc_feature (262)..(262): n is a, c, g, or t
  modified_base (313)..(313): a, c, t, g, unknown or other
  misc_feature (313)..(313): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggngtccagtgtgaggtgcagctggtggagtcgtgggggaggcttggtccagccgtggggggtccctgacgactctcctgtgcagcctntggattcacccttgagttatttactgtacctatgacacgttcgggttcccnccgtacgggccgttaccggaggggaacggggtacctagggaacttagtcgtacctcgtaggttaattaggtaagttaacgtgtaacgtaaagtaaacattaatagtttatagtaacctaaacgttcgtaggtaacggaagggtactaggtaacttaccgaacctacttaccgtacccggaagggtaaccttaaacgttacccgaaacgtaacccgtaaccgtacttaggttaactttccgttaaacgaaacggttcgggaccgtacgtaccgttgggaaaccgagtaccggtaggaacgggacccgtacgggtcttaacggttattaacgtttacggtgggttaagggaacggtaaggggtacggtaaggggttaagttacggggtaacggtttagggggtttcggtacgggggtaccggtaacggggg

SEQ ID NO: 268750 - DNA, 827 bp, Homo sapiens
  misc_feature: GYAE6OF02F05QZ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagtcttggtccgagccgtcggggggtccctggacgtactctccgtgtcgcacgtcctcgtggtacttccctacctttctaagtttattttagttacgtccttaagtcgtacctacgggttccggggttcccgacccggacgggtcccgttaccggaaggggggaacggtaccggtagggtaaattacgttcgttacgttaccgtagggtttaattaaaggtaaaaggttaacgttacggtaacgttaaaactaaacttaaattaattttaagtttaaacgtacgtaacccttaaaacgtttcgttaacgggtaacggggtaacggtaaccgtaaggttacttaaccgaaccctaagttccccgttaacggaacggtaaactaaaccttaccgaaacgaaaccggtactcgtttactaactttaccgttaacgtaaacggttcgggaacgtaccggtcgttacggaacggcggttacgtacgaacggacggtagtaccgttaggttaactagttaccgggtagggttagggaacgggtagggtaaccggtagggttaacggttaacggggtaaagggtttacggggttacggggtcggggtaccgggtaacgggg

SEQ ID NO: 268751 - DNA, 788 bp, Homo sapiens
  misc_feature: GYAE6OF02I5VAH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttccttgttgcttatttttaaaggtgtccagtgtgaggtgcagcgtggtggagtcgtgggggaggtcttgggtccaggtccggtcgggggggttccctaggacgtacctccgttcccgtggtcgccgacgtcctcgtggtacttcctaccttacgagttattttagtgtccttagtcgacgtaccggttcgggtacccgccgacgggtccgttaccggaacggggaacgggtaaccgtagggtaaaacgtttcgttaccggttacccttaaggtaaggtttaacgtttaaggaaaaagtttaacgtacggtaaaccggaaaatttaaaccgtaagtttaaatttaacgtttaagtacgtaaccttaaacgttaccgttagggtaaggaaacgggtctaaggttacttacccgaaccgttagacccgtaaccggaacggtaactaaacttaccgaaacgtacgaccgttacgtagttacgttactaacgtaggtacggtacaccgttacgaggacctacggactacgggaacgtacgaacgttcttaaggttacttagttaggtagggtaggaggacggtaggtaaccggttaaggttccgggtaacggttgggggtacggtccgggaggtaccgggg

SEQ ID NO: 268752 - DNA, 628 bp, Homo sapiens
  misc_feature: GYAE6OF02IG2TM.28.57.F02.1.454.CMB.1.raw
  modified_base (387)..(387): a, c, t, g, unknown or other
  misc_feature (387)..(387): n is a, c, g, or t
  modified_base (518)..(518): a, c, t, g, unknown or other
  misc_feature (518)..(518): n is a, c, g, or t
  modified_base (541)..(541): a, c, t, g, unknown or other
  misc_feature (541)..(541): n is a, c, g, or t
  modified_base (558)..(558): a, c, t, g, unknown or other
  misc_feature (558)..(558): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggagcttggtccagccgtcggggggtcctgagacctctcctgtgcagcctcgtggattcaccttcgtaagttattttatgtctatgactacgtcgggtccgcccacgggtcctaccggaggggtaacgggctaggaatagtcgtctctaggtataagaagtaagtgacgtaataanattaatattatgaactaaactcgtagtagacgggctagtagttacccaactacgtcctaccgaaggtaactaacttacgaaacgaccacgctaaggttacttcgttaacgaatcgggcaacgtcctagacngacgtagaacggcctaacgggtntagttaatcgttaacgngggttaagggaggtaagacgggttagaacgttgggaacggttaggggtcggttacggggacggtacgggg

SEQ ID NO: 268753 - DNA, 827 bp, Homo sapiens
  misc_feature: GYAE6OF02JY3OD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttccttgttgctatttttaaaggtgtccagtgtgaggtgcagctggtggagtcgtgggggagcttaggtccagccgtgggggtccctgagactctcctgtgcagcctcgtggtattccaccttcagttattttagtgtacttatggactacgtcgggtccgaccgaggcctaccggaaggggaacgggacgttagggaattacgtcgttaccgtacgtaagggttaacgttaaggaaaaggtttaatcgggtaactaacttaaaccgtattaaagtttaattaacgtagtaacctaaaacgtttcgtaggttaacggaacgggtactaaggttaccttaaccctaccgtaaatttccccggaacccgggtaacgggtaaaccttaaccggttaaccgaaacggtaaacccgtacgtaccgtttacgttaagtaaccctttaacgtaaagttccggggactaaccggtacgttaacgtaagggtaccgtaaggttaccgggaaacgggtaccgtaaaccgggttacgttaacgtttacgtttaaccggttaaccgggttgggggtaaagggttaaccgggaagggggttaacggttaacgggttaaaggtttaccgggggttaaacgggttttacgggggtaacgggtttcgggggaacccccgggtttaagggggg

SEQ ID NO: 268754 - DNA, 725 bp, Homo sapiens
  misc_feature: GYAE6OF02I4Z86.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagcgtggtggagtcgtgggggaggcgttggtccagccgtggggggtccctgagactctcctgtgcagcctgtggtattccaccttcagttatttatggactatgcacgtcgggtccgccgaggcctaccgaggggaacgggacgtaggtaatagttggtacctcgtaaggttaacttaaggaaagtaatcggaacgtaaataaacattaaattattaatacgtactaaaaccttcgtaggttaggaacgggtctagtaacgtttaccgaaccttagttaccccgtaccgtaaacggggtaacctaaacgtttaacccgaaaacggtaaccaaccggtacttagttaaccttcgttaaacgaaacgttcggggaacctacggaccctaggacgtagtccgtaggacggtaacgccgggtactagttacgtaacgttaccggttaggggtaggtaacgggtaagggaggtaaccgggtagggtttaacgggtaacgggtttaggggtacgggtaccgggggtaccgggtaacgggg

SEQ ID NO: 268755 - DNA, 819 bp, Homo sapiens
  misc_feature: GYAE6OF02HDF4N.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctgagcgttgggtttttccttgttgcttaattttttaaaggtgtccagtgtggaggtgcagctggtggagtcggtagggggagtcgttggtccaggccggttgggggggtcccctggacgtacccgttccttcccgtggtcgaccgacgtcccgttcgttacggtactttccgtaccctttgtaacgtttattttactggtacttagtcgcgtacggttcgggtcccgaccgacggtcccgtaccggaagggggaacgggtacgtagggtaacttagttggttaccgtacggtaaggttaacttaaggaaacgttagtacgtaacgtaaaataactaagtttaatttaagttacgtacgtaaacctaaacttcggttagggttaaacggaacgggtctaaagttacttaacccgaactaacgttcccgtaaacgggaacggttaactaaacgtaaccgaaactaaccgtacgttaccgttagttaccttaccgtaagaacggtacggacgtaacgtccgtagaacgtcgtacgtaagggaccgacggtacgacttaaggttacttaaggttacgggtacggggtacggaaagggtacgggtaaggttaaccggttaacgggttacgggttaacggggtttaaggggttcgggggtaaccgggtaccgggtaaccgggg

SEQ ID NO: 268756 - DNA, 899 bp, Homo sapiens
  misc_feature: GYAE6OF02GVD5M.28.57.F02.1.454.CMB.1.raw
tcagagtacgctatcacgaccggtgctcgatttagctcgatatagttggggtctgggaggaggagcccccgccctgggtttcccaggtgttctcatttggtgatcagcactgcacacagaagagtcatgacggtagtttgggctgacgcgtgggttttaccttgttgacttaattttttaaaggtgtccagtgtagaggtgcagctgggtggagtcggtgggggacggcgtttggtccctaggccggttcgggggggttcccctaggacggtaccttaccgttcccgttggtcggacctacggtccttccggttaggtaactttccctaacccttttcaaggttattttagtcgcttaagtcgtccgtaccgttcgggtacccgcccgtaacgggtcctaccggaacgggggtaacggggacgttaacggggtaaacttacggttaccggtaccttaccggtaacgggtttaaattaaccggtaaaacggtttaacctagggtaaccgtaaaactaaaccgttaacgttaaacggtttaacttaacgtacggaaaccccgtttaacgttaccgttagggtaacgggtaaacggggtaaccgtaaggttaactttaaccccgtaaacccgttaagtttaccccgaaccgggtaaaccgggtaaccgttaaaaccttacccggaaaacggtaaccggtaaccgttacgtacgggttactttaaccgttaaaccgtaaggtaccggggtacctacggcccgttaacggaggtaaccggtcgttaggtaaccgtcggtaaaccgggtccgttattaagtacgtttaaccgggtggtagggtaacggtaagggaccgttaaggtagggtacgtaacggtggggttacggtacggggtcacgggg

SEQ ID NO: 268757 - DNA, 780 bp, Homo sapiens
  misc_feature: GYAE6OF02HQ5TH.28.57.F02.1.454.CMB.1.raw
  modified_base (219)..(219): a, c, t, g, unknown or other
  misc_feature (219)..(219): n is a, c, g, or t
  modified_base (671)..(671): a, c, t, g, unknown or other
  misc_feature (671)..(671): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggttttccttgttgctatttttaaagtgtcagtgtgaggtgcagctggtggagtcgtgggggagcttggtccngccgtgggggtccctgaaagctctcctgtgcacgcctcgtggacttccacctttcagttatttatcgctatgcacggtcggtacccgcgacggcctaccggaagggaacggtacgtaggaattatcggttactacgtaaggttacgttaaaggaagttaacgtacggtaacgtaaaacttaaacgaaatttaatttaagtttaacgaaccgtaaacgttaaccgtttacgtagggttagggaaaacgggtcgtaacggtacttaacccgtaaccttaacgttacccggaaccgtaaacgggtaaacctttaaaaccgtaacccgtaaaacggtaaacctaccggttaaccgttagttaacctttacctaacgttaacggtaccgggtaataccggtaccggtaagtacgtaacggttaacgaagggttaaccgggaaacgtaacccgggttntaacgggtttacttaacgtttaacggtggggtaagggacggacgggttaaggtacggtaaggtttacgggacggtttaggggtaacgggtcggggtcggtaaaccgggg

SEQ ID NO: 268758 - DNA, 810 bp, Homo sapiens
  misc_feature: GYAE6OF02F20PU.28.57.F02.1.454.CMB.1.raw
  modified_base (280)..(280): a, c, t, g, unknown or other
  misc_feature (280)..(280): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcgttggtccagccgtggggggtccctgacgactctcctgtgcacgcctcgtggactttccaccttnaagttatttatgactatgcacgtgggtccgaccgaggcctaccggaaggggaacgggtacgtaggaaattagtagttctacgtaagggttaattaaggtaaaagttaagtaggaaaccgtaaaaagttaaacctaaattaaagtttaattaagttacgaaacccttaaaacgtttccggttagggtaacggtaaacgggggtactaaggtaacctttaccgaaaccccttaagttacccgtaacccgggaaacgggtaaccttaaaaccgtttaaccccgaaaacgtaaacccgtaacggttaaccgttagttaacctttaccgtttaaacgaaacgttacgggaaccttacggtacccggttagaaggtacgtacgtaacggaacggaaccgaacgggtacgttacgttacgttaacgttacgggtaagggttaggggaaaggtaacggggtacggtaagggttaaaggtttaacggggtaaaccgggtttagggggttcggggtaccgggggtaccgggtaaccgggg

SEQ ID NO: 268759 - DNA, 1013 bp, Homo sapiens
  misc_feature: GYAE6OF02G8EW0.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacaagaagtagtcagtggaacggtaggtttgggctagagtcgtttcggtttttccgttgttgtacttttaaagttttttaaaggtcgttaccgtaggttggtagggtaggtgacgagtcggttgggtggtagttcgggtgggggacgttcggttcggtccgacggtccgggttcgggggttccctaggactaccgttccttccgtggtacgaccgtacggtcccttaggtacggttacctttaccccgttacctttagtaagttttaattttacgtcgtacttagtcgtaccgtacggttccggggtacccacggtaccgtaccctacggggaaaggggaaccggtacttaacgggaattttaggtcgttaccgtaaggttaagggtttaattaaaagggtaaacgttagtaacgtaaacgaaaaacttaaataacgtttaaatttaagtttaacgaacgtaaaccttaaacgttcggttaacggacggggtaagaccgtaagttacccgtaacctaaccgtacgttacccgtaaaccgggtaacggtaaacctttaaaccgttaacccggaaaacggtaaccgtaaccgttaccgtttaaacgttaacctttaaccggttaaaacgtaacgggttaccgggaaccgttaaccgggtaaccgttacgggaacgtaaccgggtaaccgggttaacgggaaaccggggttacccgtaaccggggttaacctttaaggttttaaccgttaacgggtttttaccggggaaggggtttaaccggggaaaggggtttaacccgggaaaccgggttaagggtttaaacgggtttaacggggttaaacccggggtttttaggggggttaccgggggttacccggggaaacccggggttttaccggggg

SEQ ID NO: 268760 - DNA, 956 bp, Homo sapiens
  misc_feature: GYAE6OF02FE6TU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaggtgtccagtgtgaggtgcagcgtggtggagtcgtgggggaggtcttggtccagcccgtggggggtccctggagactctcctgtgcagcctctggacttcaccttcgagttattattgcttatgctacgtgggtcccgtcgacggctaccgaacggggtaaggaccgtagggtaaatacgtcggttacttacgaagggttaatttaaaggtaacggttaaaatcgggtaacgtaaaacttaaaccggtaatttaaataagttttaacgttacggaaaccctaaaaacgttttcccgttagggttaagggtaaacgggggtacctaaacgggttaacttttacccggaaacccttaaccgttacccgttaacccggtaaacggggggtaaaccttaaaaccgtttaacccggaaaaaccggtaaaaccccgttaaccgggtaaccgtttaacgggttttaaaccgttaccccgtttttaaacgggtaaaaaaccggttttccggggggtaaacccggttaaaccgcccgggttaacgggaaacggttaaccggggtaccggtttaaccggggaaacccggggtaaccggtaaacccggggtcccgtttaagggttaaccgttttaacggtttaacccgggtttaacgggggttaaccgggggaaagggggttaaacggggtacgggttaaaaccggggttaaacggttttaacgggggttaaaaccgggtttaagggggtttttaccggggtaccgggggggttaacccggggttaaaccgggggg

SEQ ID NO: 268761 - DNA, 764 bp, Homo sapiens
  misc_feature: GYAE6OF02JDAP0.28.57.F02.1.454.CMB.1.raw
  modified_base (254)..(254): a, c, t, g, unknown or other
  misc_feature (254)..(254): n is a, c, g, or t
  modified_base (395)..(395): a, c, t, g, unknown or other
  misc_feature (395)..(395): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctgagactctcctgtagcngcctcgtggtattccgacctttcgagttatttagtcgtcttaagtcggacctacggtcggggtcccgccgacgggtcctaccggaaggggtacgggtacgtaggtaattcgtagtccgtcgtagggtaattaggagttaangtacgtaaacgtaatagttaactagttactagtaaccgtaaaccttcgtacggtacgggaaacggggtacctaacgggttaactttaccccgaaccgttacgttaacccggtacccgtaaaggggtaacccttaaaggtttaacccgaaaccggtaaccgtcggtacgttaagttacgttacccttaaggtaaagtccgggtaacacgtacccgtagaacgggtataccgggtgaaccgggacctaacgggtcgttaactagtttaacgttgggttaccggggtaggaacgggtaacggtacggaacgttttacggacgggttaaccgggtttaggggttacggggtaccgggtaccggtaaccggggg

SEQ ID NO: 268762 - DNA, 793 bp, Homo sapiens
  misc_feature: GYAE6OF02GZ518.28.57.F02.1.454.CMB.1.raw
  modified_base (295)..(295): a, c, t, g, unknown or other
  misc_feature (295)..(295): n is a, c, g, or t
  modified_base (320)..(320): a, c, t, g, unknown or other
  misc_feature (320)..(320): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagcgtggtttccgtgtgctattttaaggtgtcagtgtgaggtgcagcgtggtggagtcggtgggggagcgttggtccagtccggtcggggggttcccctgacgactcctccgtgtgcagtccgtcgtgtacttccacttcaagtttatttangtactacttcgctacgtcgggcccncgacggtccgtaccggaaggggtaacggaccgtaggaaacgttcgtaccgttacgtaccggtaaggtttaagttaaacgggtaagttaaccggtagtaacggtaaaacttaaactagtttaaaactttagttaacttacgggaaacctaaacgttcgtaggttaagggaacgtacgtaatacttaccaaccgacgttcgtaaccggaggtaacctaaccgtaaccgaacgtaacccgagtaccgtaagttaccgttcgtaaaccgtaacggtcggaacctaccggtaacgggtcggttaaacggccgtaagggttacgaccgggtaacccgttgggttaaccgttaggtttacgttaaccgggtttgaccggggggtttaagaagggggttaaacccgtaaggggttaccggttaagggttacgggtaaccggggtttaggggttacggggtacccggtaacgggggaccggg

SEQ ID NO: 268763 - DNA, 744 bp, Homo sapiens
  misc_feature: GYAE6OF02G9RO8.28.57.F02.1.454.CMB.1.raw
  modified_base (303)..(303): a, c, t, g, unknown or other
  misc_feature (303)..(303): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgcttattttaaaggtgtccagtgtgaggtgcagctggtggagtcgtggggggaggcgttggtccgaggcccgtgggggggtcccctggagaccgtctcccgtgtgccagccttctggtacttcctaccttcagttatttaangtactatcgcgacgtcggggtcccgccgacgggccttaccggaaggggaagggtacctagggtaaactagttcgtccgtacgtaaggttacgttaaggaaagttaagtagacgtaaaagtaactaaagttaattaattaagtacgtaactaaacgttcgtaggtaggaacgggtctaagtacgttaccaacctacgttacccgtaccggaaacgggtacctaaacgttaacccgaaacgaaaccctacggtaccttagtaccttaccgtaacgtaaagtcgggacgacgtacccgttaggaacgtacggtacgtaacgggtacgggaacccgtaccgtacggttagttacttaacggttacgtggggtacggtaggaaggtagggtaacgtaacggttacgggtacggttaggggttacgggtcggggaccggtaacgggg

SEQ ID NO: 268764 - DNA, 742 bp, Homo sapiens
  misc_feature: GYAE6OF02JSYAY.28.57.F02.1.454.CMB.1.raw
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgtgctatttttaaaggtgtccagtgtgaggtgcagtctgggtggagtcgtgggggaggcttggtccagccgtggggggtccctggagtactcgtccgtgtgcagccttctgggattcgacctttcagttatttangctagtgctacgtgggtcccncacggctccgagggaacgggtactggaatatagtcgtacaggttattaaggaagtaatcgtacgaaataacgatacttaattataggtactaaaacgtcgttaggtacggtaaacgggacaaggttactttaaccaccctaaggttacctccggaaacggggtaaactaacgttaaaccaaacggtaaacctacgacgtttaagttacttaccgtttaaacgaaaaggttccggggtaacaacggtcccgtttaacggaggtacgttaccggttacggggaacgttaaacggaaccggtttacgtaacgttaacgtttaaacgtttacccgggtggtaggggggtaacggaaacgggtccggggtaagttaacggttttaggggaaacccggttttggggggtaacggttccgggggaaccgttcggggg

SEQ ID NO: 268765 - DNA, 710 bp, Homo sapiens
  misc_feature: GYAE6OF02H9HWJ.28.57.F02.1.454.CMB.1.raw
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaggtgtccagtgtgaggtgcagctggtggagttcgtggggggaggtcgttggtccagccgtggggggtccctgngactctcctgtgcngcctgtggattcaccttcagtatttatgctatgcacgtgggtccnccgaggctccggagggaaggctaggaatatgtcacgtaggtattacgaagtaagtgtaacgaaataaacataattaattatacgtactaaactgttaggtaggaagggtacaggtaacttcccgaaacctacgttccgtaacccggtaacgggtaactaaaccgttaaccgaaacggtaacctaacccggtacctttagttaaccgtttaccgtttaacgtaaacggttacgggacctaacggtccgttaagggacgtacggacggttacgaacggaccgaacgggttcgtaaggttactttaacggttagttacgggtaggggtaaggaagggtaacgggtaacggtaagggtttaacggtaaccgggtttaggggttacgggtccgggggacggtaaccggggg

SEQ ID NO: 268766 - DNA, 739 bp, Homo sapiens
  misc_feature: GYAE6OF02HII3B.28.57.F02.1.454.CMB.1.raw
  modified_base (268)..(268): a, c, t, g, unknown or other
  misc_feature (268)..(268): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttattttttaaaggtgtccagtgtgaggtgcagcgtggtggagtcgtgggggagtcgttggtccagccgtgggggtccctgacgtactcgtcctgtgcagcctntggattccaccttcagttatttatgtactatgctacgtcgggtccgccgaggtcctaccggaggggaacggtacgtaggtaattacgttgtaccgtacgtaaggttaacgttaaggtaaagttaacgtagaacgtaaataaactaattaagttaatttaagtacgtaacctaacgttacgtaggtaggaacgggtactagtaacttaccgaccttaacgtaccgacgtaacggaactaaactaccgaaagaaccctagttactagttaacttctaaacgtaaacgtcgggtaccacggtacctaggaagtccggtacgttaggaaacggaaccggtacggttaacgttagtactttaaaccgggttgttagggggtaaccgggaaggtaacgggtaacgtacgggtttaacggttacgggtaaaacgggtttaggggggtttacggtacggggtacccgtaaaccgggggg

SEQ ID NO: 268767 - DNA, 675 bp, Homo sapiens
  misc_feature: GYAE6OF02GVGDE.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcgtttggtccagtccgtgggggggtccctggagacctcctcctgtgcacgcctacgtggtattccacctttcagttatttatgtctatcgctacgtcgggtcccgaccgacggtccgtccggaagggggaacggtacgtaggtaattagtcgttactacgtaaggttattaaggtaaacgttaagtacgaacgtaaattaaacgaatttaataagtttatacgtaacctaaacttgtaggtaggaagggactacgtattaccaccctattcccgtaccgacgggaaccttaaacgttaaccaaagtaacccacgtacttagtacttactacgtaaacgtggacagccgtagagacgcgtagacgaccgtacgtcgtaggtattacgttaggtgggtaggaaggaggaaggtacggtaagttacgggtaagttcggggttcggacggggtagtaaccgggg

SEQ ID NO: 268768 - DNA, 716 bp, Homo sapiens
  misc_feature: GYAE6OF02J2DS8.28.57.F02.1.454.CMB.1.raw
  modified_base (144)..(144): a, c, t, g, unknown or other
  misc_feature (144)..(144): n is a, c, g, or t
  modified_base (176)..(176): a, c, t, g, unknown or other
  misc_feature (176)..(176): n is a, c, g, or t
  modified_base (213)..(213): a, c, t, g, unknown or other
  misc_feature (213)..(213): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (409)..(409): a, c, t, g, unknown or other
  misc_feature (409)..(409): n is a, c, g, or t
  modified_base (549)..(549): a, c, t, g, unknown or other
  misc_feature (549)..(549): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgngctgggttttccttgttgctatttttaaaggngtccagtgtgaggtgcagctggtggagtcgtgggggnggtctttggtccaggccgttgggggtccctagagctctcctgtgctgcctcgtggtacttcaccttnagttattntgcttaancgtactgtcgggtccccncgaggccttaccgaagggtacgggtactggtaaattcgttgtccgtaggaggttaattaaggaacgtaatcggactaaatactagtataagttancgactaatctaggtacgagggtctagtactacacctagttccacggaagtaactaacttaccggaaactaccggactagttacgtaactttaccgaaccgtaaaggtcgggaaccacccgttacgtaaggaacccgggtntaccgggtaacggacccggtaccgtagttaccgttaacggttacgttaacggtacgggttacgggtaaggacggtaacgggttaaaccggttaacggggtaacggttttacggggttaaaccggggtttggggttaacccggggtacggggttacccgtaaacgggg

SEQ ID NO: 268769 - DNA, 679 bp, Homo sapiens
  misc_feature: GYAE6OF02FZZ90.28.57.F02.1.454.CMB.1.raw
  modified_base (312)..(312): a, c, t, g, unknown or other
  misc_feature (312)..(312): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggagtcgttggtccaggccgtggggggtccctggagactctcctgtgcacgcctcgtggattccaccttcagttatttagtgtctatgctacgtgggtcccnccgaggcctccggaggggaacggactaggaattatgtctacgtaggttaattagaagtaatgaacgaataacatattattatagactaaacgtcgtagtaggtaacgggactagtacttaccactaagtcccttacggaaggtaacctaacgttaaccaaagaaccgacgttctagttacttacttaacgaaattcgaacgacgtacgtaccgtaggaacgtgtaccgaaggtacggaaccgacgggtacttagttaaacgttagtttaaccgggtgggtaacggggtaagtaaggggtacggtaacgggttaattaaccgggggtaaacgggttttggggttacggggtaccggggtaacccgggg

SEQ ID NO: 268770 - DNA, 736 bp, Homo sapiens
  misc_feature: GYAE6OF02HQ6BN.28.57.F02.1.454.CMB.1.raw
  modified_base (195)..(195): a, c, t, g, unknown or other
  misc_feature (195)..(195): n is a, c, g, or t
  modified_base (289)..(289): a, c, t, g, unknown or other
  misc_feature (289)..(289): n is a, c, g, or t
  modified_base (636)..(636): a, c, t, g, unknown or other
  misc_feature (636)..(636): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagcttgggttttccttgttgcttattttaaaggtgtcagtgtgaggtgcagntggtggagtcgtgggggagcttcggtccagccggtggggggtcccctgacgactctcctgtgctacgcctcgtgacttctaccttcgtaagttntttaatcgtactagtcgctacggtcgggtcccgtccgcggtcctcccggaagggggaacgggacctaagggaactaagttgttacccgtagtaggttatttaaaggaagttaaagttaggacgttaaataaaacctattaacgtttaaatttactacggaactaaaccgttagttaggttaacggaaaggggtacctaaggtaacctttcccgaaccctacgttacccacggtaacggtaactaaaccgttaaaccaaaggtaaccgaccgtactagttaccttacttaacgaaggtacgacgttacggaccgttagaacgtacgactagggtaaccgagtaccgtntacgttagttacgttggaaggttggggaaacgtgggtaacggaacggtaaggtttacgggaaccggtttagggtacgggttaccgggacggttaaccggg

SEQ ID NO: 268771 - DNA, 710 bp, Homo sapiens
  misc_feature: GYAE6OF02H6DTX.28.57.F02.1.454.CMB.1.raw
  modified_base (277)..(277): a, c, t, g, unknown or other
  misc_feature (277)..(277): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagcgttgggttttccttgttgctatttttaaaggtgtccagtgtgaggtgcagctggtggagtcgtggggaggcgttggtccagccgtggggggtcccctgagcttctcctgtgcagcctcgtgattcaccttnagttagtttatgctatgctacgtcggtccgcacggctccgaagggaaggactaggaactagtcgtctacgtaggtaattaagtaagtaaatcgacgtaaataaatagtaataagttaatacgtacgtaaaaacttcgttaggtacggtaaacgggataacgtaacgttacccgaactaaccgttacctaccggaaagggaacctaaacgttaacccgaaaacggaactacccgtacgtttaagtacttaaccgttaacaaaacggttcgggaaccctaaggtacccgtaggtaaacggacgtaccgtacgggaaacgtagaacccgtgttaagtacttaacgtttaccgggaggtaacggggaagtaagggtaaccgaggttaaggttacggtaaagggtttcggggttaacggcggggtaccggtaacgggg

SEQ ID NO: 268772 - DNA, 814 bp, Homo sapiens
  misc_feature: GYAE6OF02JCCQJ.28.57.F02.1.454.CMB.1.raw
  modified_base (173)..(173): a, c, t, g, unknown or other
  misc_feature (173)..(173): n is a, c, g, or t
  modified_base (281)..(281): a, c, t, g, unknown or other
  misc_feature (281)..(281): n is a, c, g, or t
  modified_base (418)..(418): a, c, t, g, unknown or other
  misc_feature (418)..(418): n is a, c, g, or t
tcagagtacgctatcacgaccggtgctcgatttagctcgatatagttggggtctgggagaggagcccccgccctgggtttcccaggtgttctcatttggtgatcagcactgcacacagaagagtcatgagggagtttgggctgagctgggttttccttgtgctattttaaggngtccagtgtgaggtgcagctggtggagtcgtgggggagtcgttggtccgagccggtggggggttccctgagactcgtcctgtgcagcctcgtggtacttccaccgttnaacgttatttatcgctatcgactcggtcgggtaccgacagggcctaccgaagggaacgggtacgagtaacgtagtcgtcgttacgaagttattaaggaaacgtagtagacgtaaaactaataataacttattaaganaccttaactcgttaaggtacggaaagggtcaaggtacttaaccgaactacctaccgtaaccgtaacgtaaccgtaacgttaaaccgaaacggaacctaacgtacgttacgtaaccgttaaccgttaacgtaaacgtaccgggtaaccgtaccggtacgtacgggtaaccgtacgtaaccggtaacggggtaacgtaaaccgggaaccgtttacggtaagtttaaccgttaacggttttaacccgggtagggggtttaacggggtaaacgggggttaaacggggtaacccgggtttaaacgggttaacggggtttaaaaccggggttaaccggggttttaaaggggggggtttcccgggggtttaaaccgggggtaccggggggttaaacccggggg

SEQ ID NO: 268773 - DNA, 910 bp, Homo sapiens
  misc_feature: GYAE6OF02IE763.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtggggggagtcgttggtccaggccgttgggggggtcccctggagtacgtccgttcctggttcgaccacgcccttacgtcggtaactttcccgtaaccgtttacgtaaggtttacttttaaggtcgtacttacgttcgaccgtacggttccggggttccccgtacccggacggtcccgttacccgggaaaggggtaaaccggggtacgttaacggggaaacttacgttacggttaccttaaccggtaaaggtttaagttaaggtaaaacgttaacgtacggtaaaccgtaaaacttaacaaattaactttaacgtttaataacgtaacgtaaaaccttgtacggttaacggaacgggtactaaggtaacttaccgaacctacgttaccgtaccggaacggtaaccgttaaacgttaacccgaaaacgtaaccgaccggttaccttaacgttaacccgttaacctttaacggtaaaacggtccgggtaactaccgtaccgtaaggaacgtaccggttaacgggaagtaaccgggtaccggaacggttacccggttagttaaccgtttaacggttaccggtaaggggtgggggtaaacggtaaccgggggtaacggttaaccgggtttaaagggttaaccggggttaaagggggtttaccgggggtttaacggggtacccggggggtaacccgggttaaccgggggg

SEQ ID NO: 268774 - DNA, 835 bp, Homo sapiens
  misc_feature: GYAE6OF02HHQ15.28.57.F02.1.454.CMB.1.raw
  modified_base (743)..(743): a, c, t, g, unknown or other
  misc_feature (743)..(743): n is a, c, g, or t
tcagagtacgctatcacgaccggtgctcgatttagctcgatatagttgggtctgggagaggagcccccgccctgggtttcccaggtgttctcatttggtgatcagcactgcacacaagaagagtcatgacggtagtttgggctgagcgttgggttttccttgttgcttaatttttaaaggtcgtcctagtgtgaggtgcgagctggtggagtcggtgggggagtcgttggtccaggtccggtcggggggtcccctggacgtacctccgttccgtgtcgcacgtcctcgtggactttccacctttcgtagtttatttatcgtctaacgtgccgtacgttcgggtacccgcccgaacgggtcctaccgggtaagggggaacgggtaccgttaaggtaaacgtttagtcggttaccgtaccggttaaggttaagttaaacggtaaaggttaagtacggtaaaccgtaaaaagttaaacttaactttaagtttaacgttaacgttacgtaaaccgtaaaacctttcgttagggttaacggaaacgggtaccgtaaacggtttaaccttacccgaaccccgttaattaccccggtaaacggaaccgggttaaaaaccttaacgttaaacccgaaaacggttacccgtaaacgtccggtttaaggtaaccttttaaccgtaaacggtaaacgttccgggaactacgtcccgttaggaacgtcgtacgtacgggacggtacgtaccggtntaacgtgttaacgttcggtagggtacggagtaacgggtagacggttaacggttggtaaccggtttgggggacgtacggggtacggtaacggg

SEQ ID NO: 268775 - DNA, 820 bp, Homo sapiens
  misc_feature: GYAE6OF02HCXLO.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggtttttccttgttgctatttttaaaggtgtccagtgtgaggtgcagcgtggtggagtcgtgggggagtcgttggtccagccgtggggggtccctgagactctccgtgtgcagcctcgtggattccaccttcagttattttatgctatcgcacgtgggtcccgccaggcctaccggaggggaacgggactgggaacttagtgtctacgtagggttaattaaggaaagttaatcggaacgtaaaacttaaacgaattaattaaatttactagtaacctaaaacttcgttaggtaggaaagggtactaaggtaacctttaccgaaccgtaacgttcccgttaacccggtaaacggggtaaacccttaaaccgtttaacccgaaaacggtaaaaccccgtaaacccggtaccgtttaacgtttaaccgtttaccgtttaaaccgttaaaacggtaccggggtaccgtaaccgggtaccccgttaggaaccgggtaacggtaccgtttagggaaaccgggtaacccgtaaccgggtacgttaagttacgtttaacgtttaccggtaagggttacgggtaaggggtacgggtaacgggtaacggttaacgggttttaacgggtaaaccgggtttaaggggggttttcggggtacgggggtaccgggtaacccggggg

SEQ ID NO: 268776 - DNA, 748 bp, Homo sapiens
  misc_feature: GYAE6OF02GUW4T.28.57.F02.1.454.CMB.1.raw
  modified_base (175)..(175): a, c, t, g, unknown or other
  misc_feature (175)..(175): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaggngtccagtgtgagtgcagctggtagagtcgtgggggagtcgttggtccaggccggtggggggtcccctggacgtactcgtccgttgtcgcgacgtcctcgtggtacttccaccttactagttaactttagtcgtacgtacgtgaccgtcggtacgggtcccgccgacgggtccctacgggacggggaacggtacgtagggaacttagttcgttacgtacggtaaggttaacgttaagtaaacggttaacgtacgtaaacgtaaacgtaaataacgttaatttaacgttataaccgaaaccgtaaacttcgtaaggtaaggaacgggtaccaagttaccgtacacctacgtcctaccggaacgtaacctaacttaaccgaaacgtactaacgttctacgttaacttacgtacgtaaggtccgggtacaaccgtcgttagaacgtgtacgtaaggaccggtaacgtcggagtacttagttacgttacggttggaacgggtagaacgggggtacgttaaaccggtaggttaacgggtacggttaacggggtttgggtacccgggtacggtaccgggg

SEQ ID NO: 268777 - DNA, 771 bp, Homo sapiens
  misc_feature: GYAE6OF02HKP5P.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgtcttatttttaaaggtgtccagtgtgaggtgcagctggtggagtcgtgggggagtcgttggtccagtccggtggggggtccctgacgactctcctgtcgcacgtcctcgtggtacttcctaccttctagttatttatgtactatcgacgtaccgtcgggtcccgaccgtcggccgtaccggaaggggaacgggtacgtaggtaacttagtcgttactacggtaggttaagttaaggtaaacgttagtaggtaactaaagtaaactattaaacttttataagtacggaaccttaaaccgttcgttaagggtaggaaacgggtcaagttaaccttcccaaaccgttactaccgaacccggtaaggaacctaaacttaacccgaaacggtaaccctaacggttcttactaacgtttcgtaaacgtaaactcgggaaccaggttccgaggtaacgcgggtaccgtaagggtaacccggaacgttaaccggacgttacgttaagtttacggtttaggtacgggtaaggggacgggaaaccgggtaaggtacggttaacggttaacggggtaacggttaggggggtttaccggtacgggggcccgttaaccggggg

SEQ ID NO: 268778 - DNA, 712 bp, Homo sapiens
  misc_feature: GYAE6OF02JZAYF.28.57.F02.1.454.CMB.1.raw
  modified_base (175)..(175): a, c, t, g, unknown or other
  misc_feature (175)..(175): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
  modified_base (571)..(571): a, c, t, g, unknown or other
  misc_feature (571)..(571): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagttttgggctgagctgggttttccttgttgctatttttaaggngtccagtgtgaggtgcagctggtggagtcgtgggggagcgttggtccaggccggtggggggtccctgacgactctccgtgtcgcacgcctgtacggtatttccaccttcgtagttacttttaagtcgaccgttatcggaccgtacggttcgggtaccccgccgacggtccgttacccggaaggggaacggggtactagggtaattacgtcgtctagacgggttaattacgaaaggttacgtggaacgtaactaaacgtattaatttaagtacttcgaactaaacttcgtggtaggtaacgntaagtacttacaaccgtntaccgtaacgaaggtactaacgtaccaacgaaccacgtcttagtactctaacgtaagcgggactaggacctagaagnggtaacgtacgggaacgacccgtagtacgttaagttaaggtaccttagggtgggttaaggggacggtaaaggggccgtaaggtttaacgggttaggaaacgggggttttcgggtagggtaccgggggtaccggtaacgggg

SEQ ID NO: 268779 - DNA, 688 bp, Homo sapiens
  misc_feature: GYAE6OF02JRXL4.28.57.F02.1.454.CMB.1.raw
  modified_base (228)..(228): a, c, t, g, unknown or other
  misc_feature (228)..(228): n is a, c, g, or t
  modified_base (468)..(468): a, c, t, g, unknown or other
  misc_feature (468)..(468): n is a, c, g, or t
  modified_base (475)..(475): a, c, t, g, unknown or other
  misc_feature (475)..(475): n is a, c, g, or t
  modified_base (559)..(559): a, c, t, g, unknown or other
  misc_feature (559)..(559): n is a, c, g, or t
tcagagtacgctatcacgaccggtgctcgatttagctcgatatagttgggtcgtgggagaggagcccccgcccctcgggtttcccaggtgttctcatttggtgatcagcactgcacacagaagagtcatgacggagtttgggctgagctgggttttaccttgttgcttattttaaaggtgtccagtgtgaggtgcagctggtggagtcgtgggggaggcttggtaccngccgtggggggtccctgagacgtccttcctgtgacgcgtccttcgtggtacttcctaccttcgtagtttatttaagtcgtaccgttgtcgtccgtaccggtcggttacccgccggacggcctacccggaggggaacggtaccgtaggacttcgtagtccgtagaggttactagaaagtacgtagtacgtaaactaacatagttaacttagtcaaccgtaaatcgtacggtaagaacgggntaacgtntacccacgtaattcctacggtaacgaactaacgtacgaaacgaccgagtcccttagtactttccgtaaagtaccgcggtaaccngtacgcgagtagcggttacgaacgggtacaccggtagtacggtattaacggttacgaggttacggaacggtgtaacggacgggttaagtaccgggtagggtttaggtcggggttacgggaacgtacggg

SEQ ID NO: 268780 - DNA, 633 bp, Homo sapiens
  misc_feature: GYAE6OF02GGGVH.28.57.F02.1.454.CMB.1.raw
  modified_base (356)..(356): a, c, t, g, unknown or other
  misc_feature (356)..(356): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtggggggaggcttggtccgaggccgtgggggggtccctggagtacctctccgtgtcgccagccctcgtggattccgaccctttacagttaatttatgtcctaagtgcacgttgggtcccgccgaggcctccgaggggaaggactggaatntgtctgaggttatagaagtaatgacgtaataacataatattatagactaaactgtagtaggaggtcaagtacttacacctaatcctaccgaggaaactaaccttaccgaaagaaccacgtactagttaactacgttacaaacggtcgggactacgacgtggaagtcgacgtgaaccggtacgacggtacgtagttattacgtaggtgggtaggggtaacagggtacggacggtaagttacgggtaacggttaggggtcggtaggggccgtaacgggg

SEQ ID NO: 268781 - DNA, 754 bp, Homo sapiens
  misc_feature: GYAE6OF02F9RMQ.28.57.F02.1.454.CMB.1.raw
  modified_base (335)..(335): a, c, t, g, unknown or other
  misc_feature (335)..(335): n is a, c, g, or t
  modified_base (599)..(599): a, c, t, g, unknown or other
  misc_feature (599)..(599): n is a, c, g, or t
  modified_base (609)..(609): a, c, t, g, unknown or other
  misc_feature (609)..(609): n is a, c, g, or t
tcagagtacgctatcacgaccggtgctcgatttagctcgatatagttgggtctgggagaggagcccccgccctgggtttcccaggtgttcctcatttggtgatcagcactgcacacagaagagtcatgacggagtttgggctgagctgggttttccttgttgctatttttaaaggtgtccagtgtggaggtgcagctggtggagtcgtggggggaggtcgttgggtcaggtccgtcgggggggtccctggacgacgtcctcctggtgcacgcctcgtggtacttccacccttacgtagttatttatggtacctgtacgctacgtcggggtacccncgtacgggcctaccgaagggggtacggacgtggtaactatggtcctagtaaggtattaaggaacgttagtacggaacgaaagtaactaattaagtttaattaagtcggtaaacctaaacgttagttcggttagggaaacgggtactagggtacctttaaccgactacttacggtaccggaaggtaactaaacttaccgaaacggaaacgtaccttacgggtacttttactacgttaaacgtaacggtggaccgtgacccggttnaaacccgggntacggttagtaaccgggattaacccggggtcttacggtttagtacgtttccgggtaagggtaaggggaccggttaagggacgggtaacggttaacgtttagggggtaacccgttaggggtacgggttaccggggacgtacggggg

SEQ ID NO: 268782 - DNA, 743 bp, Homo sapiens
  misc_feature: GYAE6OF02GCWR9.28.57.F02.1.454.CMB.1.raw
  modified_base (311)..(311): a, c, t, g, unknown or other
  misc_feature (311)..(311): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgttggggggtccctggacgactcctcctgtgcagcctctggacttcctaccttcagttatttatgctatgctacgtcgggtcccnccgaggcctaccggaggggaacggacgtaggtaatatgtctagtaggttattaagtaaagtaatcgaacgaaataacgtattaattattaacgtacgaactaaactcgtaggtaggtaacgggactagtacttacccgtaacctacgttaccgtacccgggtaaacgggtaaaccttaaacgttaacccgaaaacggtaaacccgtacggttaccgtttaacggtttaactttaaccgttttaaaccggaaaaacggtttccgggggaactaccgggtaccgttagggaacgtacggtacggtaacgggaacggtacccgtaacggtacgttagttacgttacgttacgggtagggtagggaacggtaaggacggtaaggttaaggttagggtaacgggttaggggttacgggtaccgggacggtaacgggg

SEQ ID NO: 268783 - DNA, 757 bp, Homo sapiens
  misc_feature: GYAE6OF02H4D7S.28.57.F02.1.454.CMB.1.raw
  modified_base (494)..(494): a, c, t, g, unknown or other
  misc_feature (494)..(494): n is a, c, g, or t
  modified_base (729)..(729): a, c, t, g, unknown or other
  misc_feature (729)..(729): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttggctgagcttgggttttccttgttgcttattttaaaggtgttccagtgtgaggtgcagtctggtggacgttcggtgggggacgtcgttcggtccgacggtccggtcgggggggtcccctaggtacggaccttccttcctggttcgaccgacgtcccttacgtacggtactttacctacctttcctaagtttaacttttatcgtaccttaagtggtacctaccgggttccggggtcccggacccggtacggtacccgtaacggggagggtaaccggtacggtagtacgttcgtcgtacctaggttaagtaagtaaggtaagttacgacgtaagtaaaataaagtattaacgttttaanacggtaactaacgttaacttacggtaggtaacggaagtaccgtagtaccctactacttacgacctaacgggaactaaccttaaacgaacgaaccgtaacgtcctgtttaacgtaacttaaccgtacggttaaagccggtaacgccgtaggtacacgtaggtacgacgtacgtacggtaacgttctaatacgtttaacgtggtaacggtagaggacgtagtagttagggttacggnggtttaggggcggtacggaggtacccgg

SEQ ID NO: 268784 - DNA, 696 bp, Homo sapiens
  misc_feature: GYAE6OF02HY3ZD.28.57.F02.1.454.CMB.1.raw
  modified_base (366)..(366): a, c, t, g, unknown or other
  misc_feature (366)..(366): n is a, c, g, or t
tcagagtacgctatcacgaccggtgctcgatttagctcgatatagttgggtctgggagaggacgccccccgccctgggtttcccaggtgttctcatttggtgatcagcactgcacacagaagagtcatgacggtagtttgggctgagcgttgggtttttccttggttgcttaatttttaaaggtgtccagtgtggaggtgacagcgtggtggagtcggtgggggagtcgttgggtccacggccgtgggggggtccctggacgactcgtccgtgtgcagcctgtaggtactcctacttcagttattagtgactatgactacgtcgggtccacggacgtcaccggagggagacgtagtataacgtgtntaacgagttaagtaagtaatagacgtaagtaataatatagttaactatagtaactaaactgtacggtagaagacgtaagtacgactacaataccgtacgaacgtaactacaccgaaacgacgacggttactacgttacttaaacgtaacggtaagcgggtaaacgtcccgtaagtaagtacgaccgttacgaaggtaccggaacgtacggtacgtagttaccgtaattacggttaggggaaacgggaggtaaaccggtaagggtaccggttaaaggttacggggtaaaccggtttagggggttacggggtaccgggagggttaaccgggg

SEQ ID NO: 268785 - DNA, 680 bp, Homo sapiens
  misc_feature: GYAE6OF02GNJ8S.28.57.F02.1.454.CMB.1.raw
  modified_base (516)..(516): a, c, t, g, unknown or other
  misc_feature (516)..(516): n is a, c, g, or t
  modified_base (542)..(542): a, c, t, g, unknown or other
  misc_feature (542)..(542): n is a, c, g, or t
  modified_base (584)..(584): a, c, t, g, unknown or other
  misc_feature (584)..(584): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccgagccgtggggggtccctggagactctcctgtgcacgcctctaggtactttcctaccctttgtaacgtttagttttaacgtcgtacttactgtccgtacgttcgggtcccgcccgacggccttacccggaagggggaagggtaccgtaggtaattacgttgtaccgtacgtaagggttattaaggtaagtaacgtagacgtaaataactaattaatttattaagttagaactaaactcgtagtaggaagggcagtacttccgaactctcacgaagactacgtacaacgacacgtntagtattaccttagaagtcggtaccnggtaccaggtaacgcgtagtccgggaaagcccgaccgggttntaggttaattacgtttacggaggggttacggaggtaaggtacgtacggtaagttaccggggtaagttaggggtttcgggtaccgggaggtaacggg

SEQ ID NO: 268786 - DNA, 747 bp, Homo sapiens
  misc_feature: GYAE6OF02GV07K.28.57.F02.1.454.CMB.1.raw
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
  modified_base (509)..(509): a, c, t, g, unknown or other
  misc_feature (509)..(509): n is a, c, g, or t
tcagagtacgctatcacgaccggtgctcgatttagctcgatatagttgggtctgggagaggagcccccgccctgggtttcccaggtgttctcagtttggtgatcagcactgcacacgagaagagtcatgacggagtttgggctgagtcgtggttttccttgttgtcttaagtttttaaaggtgtccagtgtgtaggtgctagcgtggtcggagtcgtgggggagtcttggtccagccggtggggtacccngacgctctcgtgtcncgacgcctcgtaggtcttaccgaccttcgtagtttaactttgttcgacgttatggcctacggttcgggtacccgaccgtcggtcccttaaccgggaacggggtaacgggaccgttaggaacgttaccgttcgttaccgtccgttaaggttaagttaataaagggttaacgtaacgacgtaaaacttaagaatttaatttagttagtactaaaccgtaaacctgttacggtaggaccgggtaaancgtactttaccgactacgtacccgttacgaacgggtaaacttacgttaaccgaaacgtaaaccgtaccgttaccgttagttaacgttaaccgttaaaccgtaacggtacggaccgacggttaccgagtaaaccgtgaacgtacggaaccgtacgaccggtagttacgttagtagttacggtaagggtacggaggtaaggaccgttagagttcggtaggtacggtggaccggagtacgg

SEQ ID NO: 268787 - DNA, 818 bp, Homo sapiens
  misc_feature: GYAE6OF02F6CUS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtgggggaggcgttggtccagccggtggggggttccctgagactctcctgtgcagcctcgtggtacttccacctttcaagttacttttatggctatcgacctacgtggggtcccgccgaggtcctaccggaaggggaagggtacgtagggtaacttaggtcgttcgtacgtaagggttaatttaaggaaagttaatggaccgtaaaatttaaaccgatttaataacgttttaagacgtaaccgtaaaaccttcgttagggtacggtaaacggggtaccaggtttaacgttaccgaacccttaaagttccccgtaacggtaacgggaaccttaaaacgtttaacccggaaaacccggaaaccgttacggtaccgttaggttactttaccgtttaacctaaacgggttcgggaaccgaaccgttccgagggaacggtcggtaccgtacggggaacgtaaccggtaaccgttcgtaacggtttacgtttaactacgggtttaggggacgggtaacgggtaaggggtaaccgggttaagggtaacgggtttacggggtaaacgggggttttacggggggttacgggttaccggggggacccgggttaaccgggggg

SEQ ID NO: 268788 - DNA, 581 bp, Homo sapiens
  misc_feature: GYAE6OF02H2PD0.28.57.F02.1.454.CMB.1.raw
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
  modified_base (384)..(384): a, c, t, g, unknown or other
  misc_feature (384)..(384): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (515)..(515): a, c, t, g, unknown or other
  misc_feature (515)..(515): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaaggtgtccagtgtgaggtgcagctggtggagtcgtggggggagtcgttggtccaggccggtggggggtccctggagtacctctcctggtgccgagtccctgtcggtnttccaccttcgtagttatttangtctatcgctacggtcggtccaccgtagcctaccggagggaacggtacgtaggtaatgtgtaccagtaagtactaagaagtanagacgtaatacatatatananactatntagngtaagctagtatcactatcacgagtacactacaanacanttatactctatagtacgcacgtcagacgagcgagcgacgacgtacgtagtactacgttcgnggtaacggtaggaacggtagacggtagtaacggtaacggttggggtacgacggggtagtaaccggg

SEQ ID NO: 268789 - DNA, 728 bp, Homo sapiens
  misc_feature: GYAE6OF02GC0Z4.28.57.F02.1.454.CMB.1.raw
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccaggccgtggggggtccctggagactctcctgtgcagcctcgtggattcaccttcagttattatgtctatgcacgtgggtcccnccgaggcctaccgaagggaacgggtaccgtggaatagtgtctacgaggttattaagaagtaaagtgacgtaaataaacgattaattacttaatcgtaactaaaaccttcgttaggttaggaaacgggtacgaacgtaactttaccgaacctaacttccgttaccggaacgggtaaaccttaaacgttaacccgaaaagaacccgtaacgtacttagttacttaccgttaacaaacggtcgggaactacggtacccgtaggtaacggaacgttcgtagggaacgggtaaaccgacgggtaccttagtaagttaaccgtttaacggtggggttaacggggtaaggaacgggtacggtaacgggtaaaggtttacgggtaaaccggttagggggtttacgggtacgggggtaaccggtaaccggggg

SEQ ID NO: 268790 - DNA, 798 bp, Homo sapiens
  misc_feature: GYAE6OF02FNXUO.28.57.F02.1.454.CMB.1.raw
  modified_base (275)..(275): a, c, t, g, unknown or other
  misc_feature (275)..(275): n is a, c, g, or t
  modified_base (791)..(791): a, c, t, g, unknown or other
  misc_feature (791)..(791): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccaggggaagggactggaatatgtctcaggtattagaagtaatgcgaataacatatattatgcaaactctgtgaaggcagatcaccatctcaggacatccaagacacgctgtactcttactaaagtcgggacacgccgtgaagngctagacgacgacggactgtaatacgttaacgtggtagggagacgggtacggtacgggtaactttaacgggaaacgtttaggggggttcgggtaccgggggtaccgtaacgggggtacggtacccccggttggggttacccgtaacccgggttcccgttaccctcgtaaccggtcccccgttaccccggaaaacccggtaaccccggggtaccccttaacggtccccgggtttaccccgttttacccccccggtcggggttcccccgtcccccgtacggttaccccgtacccgggaacgggtaacccggtacccgaccccgttacccgggtaacggaccgtacccgacccgttacgggaccccggtccccggttaccggggtcccgtaccggtacccgggtacgggtttacccaacgggttaacccgttaccgttacccgtaacgttacgtcccttacgtcccggtagacgggtccgggtaccgtacggcgtaaaccgggcgtcgaacggttacgngcagtac

SEQ ID NO: 268791 - DNA, 931 bp, Homo sapiens
  misc_feature: GYAE6OF02F9UCR.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagtttggggctgagtcgtgggtttttccttgttgcttatttttaaaggtgtccagtgtgaggtgcagcgtggtggagtcgtgggggaggtcttggtccaggccgtggggggtccctgacgtactcgtcctgtacgcacgcctcgtaggacttccaccttcgagttagttttatgtcttaatcgtacgtacgtcgggtcccgaccgtaggtcctaccgaaggggtaacgggtaacgtacggaaagtagttcggtactcgtaaggttaagttaagtaaacggtaatacggtaaactaaacttaaactaagttaatttaatttaacggtcgtaaaccgtaaacctttacggttaacggtacgggtaaaacgggggtactaaacgggttaacttacccgtaaacccttaacggttaccccgttaaaccggtacgggggtaaaaccttaaaccgtttaaacccgaaaacggtaaacccgtaacccggttacgtttaaacggtttaagtttaccccttaaacggtaaaccggtttccggggaacgttacccggtaaacgtttacgggaaccgggtaacgtcccggtaaagggttaaccggaaccggtaaccgggttaccgttaacggtttaacgtttaacggtttaaccgtttacggggggttaaccggggtaaggttaaaccggggtaacgggggttaaacccggttttaaaagggggttaaccgggttaaaacggggggtttttacggggttttaaccgggggttaacccggggggggttaccccgggttaaaaccgggggg

SEQ ID NO: 268792 - DNA, 669 bp, Homo sapiens
  misc_feature: GYAE6OF02GSDYS.28.57.F02.1.454.CMB.1.raw
  modified_base (179)..(179): a, c, t, g, unknown or other
  misc_feature (179)..(179): n is a, c, g, or t
  modified_base (289)..(289): a, c, t, g, unknown or other
  misc_feature (289)..(289): n is a, c, g, or t
  modified_base (319)..(319): a, c, t, g, unknown or other
  misc_feature (319)..(319): n is a, c, g, or t
  modified_base (507)..(507): a, c, t, g, unknown or other
  misc_feature (507)..(507): n is a, c, g, or t
  modified_base (531)..(531): a, c, t, g, unknown or other
  misc_feature (531)..(531): n is a, c, g, or t
  modified_base (543)..(543): a, c, t, g, unknown or other
  misc_feature (543)..(543): n is a, c, g, or t
  modified_base (564)..(564): a, c, t, g, unknown or other
  misc_feature (564)..(564): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtntccagtgtgaggtgcagctggtggagtcgtgggggagtcttggtccagccgtgggggtcctgagtctcctctgtcgctagcctctggacttccaccttcagttaatttcngtacttatgcctacgtcgggtcccgaccgngggtccctccggaaagggggaggtaccgtaggtaacttagtcgtactacgtaggttaattaaagaacgttatagaaccgtaaataacaagttaattaactatacgtaacgtaaaacctcgtaggtacggaagggactaagtcttaccgaccctatccgaccgaaggtacctaatacgaaacgcacgtntacgtatcggactaggcgaaccgngacctggaacgngtccgtagacggcgtaccggnttacgtaatttaccggtcgtaggggtacggtaaaggagggtacggttacgtaacgggttacgggtaaccggtttaggggtaccggggtaccggagggtacccggg

SEQ ID NO: 268793 - DNA, 651 bp, Homo sapiens
  misc_feature: GYAE6OF02FOJ19.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttttccttgttgctatttttaaaggtgtccagtgtgaggtgcagctggtggagtcgtgggggagcttggtccagccgtggggggtccctggagactctcctgtcgcagcctcgtggacttccacctttcgagttattatgctatgcacgtgggtcccgccgaggcctaccgaggggaaacgggactagggaattagtgtcttacgaaggttaattaagaagttaatcgtacgaaataaacattaattataatgactaaactctgaggtaaggcagtacttcacagtctacgaggtacaactaccgaacgaacgactctagttaactcgttaacaaacgttgggactacgtccgtaaggacgtacgcgttagggaacggtaaccgtaacggtcgttagttaacgttaggtttaccgtgggttacgggaaggaggggtacggtaaccggttaaggttacggttaaacgggttaggggttacgggcggggtaccggtaacgggg

SEQ ID NO: 268794 - DNA, 650 bp, Homo sapiens
  misc_feature: GYAE6OF02FRSCQ.28.57.F02.1.454.CMB.1.raw
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (557)..(557): a, c, t, g, unknown or other
  misc_feature (557)..(557): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgtgctatttttaaaggtgtccagtgtgaggtgcagctggtggagtcgtgggggaggcgttggtccaggccgtggggggtccctgagactctcctggtgcagcctctggattccaccttcagttactttatgtctatgctacgtgggtcccgccgtaggcctccggaggggaacgggacgtaggtaatagtcgtctcgtaggtattagaagttangagaanaacatatatatagactaactctggtaggacggtcagtacttacacctatccgtaccgacgggtaactaacttaccgaaacgtaacgaacgttacgttacgttacttaccgttactaaaggtcggaccggtacgtaccgtaggagacggcgttagggacggtaccgacggtactagtaattnttaacgggtcggtagggaacggagggtaacggtaggttaaggttacggggtaagggttaggggtttacgggttaccgggggtacgtacggggg

SEQ ID NO: 268795 - DNA, 670 bp, Homo sapiens
  misc_feature: GYAE6OF02GCHOQ.28.57.F02.1.454.CMB.1.raw
  modified_base (582)..(582): a, c, t, g, unknown or other
  misc_feature (582)..(582): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttatttttaaaggtgtccagtgtgaggtgcagctggtggagtcgtggggggaggcttggtccagccgtcggggggtccctgagactctcctgtgcagcctctggtacttccaccttctagttatttatgctatcgctacgtcgggtcccgccgacggcctaccgaagggggaacggacggtaggaattacgtcgttactcgtaaggttataagtaagtaagtgacgtaaataactaattaattattaatacgaactaaaccttacgtaggtaggaacgggactaagtacttaccaacctatcccgtaccgaaggtacctaaacttacccgaaacgaccgaccgtctttacgttaacttaccttaacgaaaggttcgggacctaacggcgtagaggtacgcgtagggacgacgacggtnttagttatagttacggtagggtggaacggtaggtaaggtacggtaagtacgggttagggttgggtcgggtacgggaccggtaacgggg

SEQ ID NO: 268796 - DNA, 911 bp, Homo sapiens
  misc_feature: GYAE6OF02GILW0.28.57.F02.1.454.CMB.1.raw
  modified_base (174)..(174): a, c, t, g, unknown or other
  misc_feature (174)..(174): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaggntcagtgtgaggtgcagctggtggagtcgtgggggagtcgttggtaccagccgttggggggtccctagagtaccgttccgtcctgtacgcgacgccttgtcggtattcctaccttactagtttatttactcgcttagtcgcgtacggttcgggtacccggaccagggtacctaccgggaaggggtaacggtccggtaggtaacttagtacgttcgtacgttaaggttattaaggaacgttagtacggtaacaaacttaagtacgttaactttaagtttaacgtaccggtaacttaaaaccgtccgttaagggtaccggggtaaaacgggctaaacgggttcctttaacccgaacccgttaagttaaccccgtacgggtaaaccgggtaaccttaaaccggttaaacccgaaaacggttaaaccccgaaacccgggtttaccgttaacgggtttttaaaccctaacccggttttaaaaccggtaaaaccgggtttacccgggaaacgtacccgggttaacccgttaagggtaacccggttaaccggggtaccggttaaccgggaacgggtttaaaaccccgtaacccggggtcgtttaaaccggttacgtttaactttaaccggggtggggtaaacggttaaacgggtaacggggttaaccggtaacggggtttaacgttaagggttaacccggggttaggggttttaacccggggtgggggaaaccccggttacgggg

SEQ ID NO: 268797 - DNA, 660 bp, Homo sapiens
  misc_feature: GYAE6OF02F8GFA.28.57.F02.1.454.CMB.1.raw
  modified_base (176)..(176): a, c, t, g, unknown or other
  misc_feature (176)..(176): n is a, c, g, or t
  modified_base (510)..(510): a, c, t, g, unknown or other
  misc_feature (510)..(510): n is a, c, g, or t
  modified_base (525)..(525): a, c, t, g, unknown or other
  misc_feature (525)..(525): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
  modified_base (562)..(562): a, c, t, g, unknown or other
  misc_feature (562)..(562): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggngtccagtgtgaggtgcagctgggtggagtcgtgggggagtcgttgggtccaggccgttgggggggtccctggacgtactcgtcctgtcgcacggcctcgtaggtacttccacctttcgaagttatttagtgtacttagtagaccgtacggttcggggtcccgtacgacgggtcctaccgggaagggggaacgggtacctagggtaatacgtgtacgtacgtaggttaattaacggaaagttaagtcgaacgtaaataacgtattaattagttatcgaactaactgtagtagaaggcaagtctacgactatccgacgagataactccaaagaccncgtatgtactcgtanaacgtggcagtcgngagcgtcgngaacgacgtacgtntagttactagttaacggtgggtacgggaaggtgggtaacgtaggttaaggttacgggtaaccgggttggggtacgggttaccgggacgggtaaccggg

SEQ ID NO: 268798 - DNA, 591 bp, Homo sapiens
  misc_feature: GYAE6OF02HXPWT.28.57.F02.1.454.CMB.1.raw
  modified_base (285)..(285): a, c, t, g, unknown or other
  misc_feature (285)..(285): n is a, c, g, or t
  modified_base (363)..(363): a, c, t, g, unknown or other
  misc_feature (363)..(363): n is a, c, g, or t
  modified_base (465)..(465): a, c, t, g, unknown or other
  misc_feature (465)..(465): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtgggggggtccctgagactctcctgtgcagcctcgtggattcaccttcagtattttangtctatgcacgtcggggtccgccaggcctccgaaggggaacggactaggaatagtgtctcgaggtattaagaagtaangagaaataacagtatattatagacaaactcgtagtaggaaggcagtattcaactatcacgaggaactaactaccgaaagaacacgtctagtaatccgttaanaaagtcggcacgtcctagacgacgcgtaggaacggacacggtcgtagttactagttacggtggtacgggaagaggacgacggttaagttcgggtaaagttggggtttaggacggggcgtaacgggg

SEQ ID NO: 268799 - DNA, 794 bp, Homo sapiens
  misc_feature: GYAE6OF02H0J3U.28.57.F02.1.454.CMB.1.raw
  modified_base (308)..(308): a, c, t, g, unknown or other
  misc_feature (308)..(308): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgcttatttttaaaggtgtccagtgtggaggtgcagcgtggtggagtcggtgggggagtcgttcggtccgacggtccggtggggggtccctggagaccttcgtccgtggtgcacgtccgtgtggtacttccaccttactagttattttancgtactagtcgctacggttcggtcccgacgacggtaccgtcggaacggggtaagggtacgtaggaattacgtgtacctacggtaaggttaagtaaggtaaattaaggtacgtaacggtaaaacttaaactaagttaattaacgtttaacgacgtaaacctaaaaccgtttcggtaacgggttaagggaaacgggtccgtaaaggttaaccttacccgtaaccgtaaccgttaccggtaaacccgggaagggtaaaacctaaaccgttacccgaaaacggaaccctaacggttaacgttacgtttaaaccttccttaaaacggtaaacggtaccgggactaccgtaccgtaggtaaccggacgtaccggttaaggaaacgaccgtacgtacttagttagttaacgtaggtagggtaggaacggaacgggtaacggaggttaaggttaggtaaccgggtttaggggtacggtacgggcggtaaccggg

SEQ ID NO: 268800 - DNA, 684 bp, Homo sapiens
  misc_feature: GYAE6OF02I44RD.28.57.F02.1.454.CMB.1.raw
  modified_base (321)..(321): a, c, t, g, unknown or other
  misc_feature (321)..(321): n is a, c, g, or t
  modified_base (426)..(426): a, c, t, g, unknown or other
  misc_feature (426)..(426): n is a, c, g, or t
  modified_base (532)..(532): a, c, t, g, unknown or other
  misc_feature (532)..(532): n is a, c, g, or t
tcagagtacgctatcacgaccggtgctcgatttagctcgatatagttgggtctgggagaggagcccccgccctggggtttcccaggtgttctcatttggtgatcagcactgcacacagaagagtcatgacggagtttgggctgagctgggttttccttgttgctatttttaaggtgtccagtgtgaggtgcagctggtggagtcgtggggggagtcgttggtccagccgtgggggggtccctaggagtacctcctccgtgtcgcgacgcctcgtggattccaccttcagttatttatcgactagtgcgacgtcgggtcccnccgacggctccggaggggacggacgtaggaatagtcgtctgagttattagtaagtagtgagaataacattatattagcgaacaacttgtacgtagggaacggtanagtattcccgaatcgtacctacgaaggtaactaacctaacaacggaaccctacggttactacgttaactttacccgtaagtaacggtacggtaacgcgggtaaccngtaaacggtcggtacgttcgggaaagggaccttaacgggcgtttagttaatccggtttaggtcggggtaagggtaacgggaggtaacccggttggtaaacggttacgggttaaagggttgggggttaacggtcgggggtacggtaaccgggg

SEQ ID NO: 268801 - DNA, 863 bp, Homo sapiens
  misc_feature: GYAE6OF02GSO3I.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggttttccttgttgcttaatttttaaaggtgtccagtgtgaggtgcagtcgtggtggagttcggtgggggaggtcttggtcccgaggtccggttcgggggggtccctaggacgtaccgttccgtccgttggtcggacgtccgtccgttcgtagggttacttccgtaacccgtttccgtaagtttaacgtttttactacggtacctttaagtccgtacttaccggtcggggttccccgacgtacgggtcccgtaccgggtaacgggggaacggttacgtacgggtaataacggttcgttaccgtaacgtagggttaattaagggtaaaacgttaagttacggaaaccgtaaattaacgtaagtttaacgtttaacttaaggttacgtaaacccgttaaaacgttccggtttaaggtaacgggaacgggtaccgtaaaggtttaccttacccgtaaaccgtaggttccccgtaaccgggtacggtaaaaaccgttaaccgtaacggtaaaaccgacgtaaccgtttacgtaaggtttacttaaccgttaagaaacgttccgggactacgtacccgtaaggtaacgtgttaacgaacgggtaccaaaggtacccgttagttaaccgttacgtaaggttcgttaggggaggaaggtacggtaccggtaggtaaccgttgggtttaacggtgggttacgggtccggtaacggtacggg

SEQ ID NO: 268802 - DNA, 845 bp, Homo sapiens
  misc_feature: GYAE6OF02HOHLW.28.57.F02.1.454.CMB.1.raw
tcagagtacgctatcacgaccggtgctcgatttagctcgatatagttgggtctgggagaggacgcccccgccctcgggtttcccaggtgttctctatttggtgatcagcactgcacacagaagagtcatgacggtagtttgggctgagtcgttgggttttccttgttgtactttaagtttttaaaggtcgtacctagtgtgtaggtcgacgagtcgtggtaggagttcggtagggggacgtcgttcggtccgtacggtccggtcggggggttccctaggacgtaccttccgtcccgtggtcgacgacgtcccgttacgtcggtacttaccctaccgtttacgtaagtttaatttacgttcgtacttacgtcgtaccgtaccggttccgggtacccgaccgtaacggtcccgtaaccgggaaggggtaacggtacgtaaggtaacttacgttcgtacgtacgttaaggttaattaaaggtaaagtaactaggaactaaacgtaactaattaagtttaattaacgaacgtaaaccttaaacgtggttacggaaacggacggtactaacgtacttaccacctaacgttacgaccggtaaagtaacctaacgttaccgaaacggtaacctacgttaatttaacgtaccgttttacgaaacgttacggacggtaccgtacgtaccgtaggaacgtaggaccgtacggaaaccgggttacgaaccggtttacgtaagtttacggttaacgtttacgggtaagggtacggggacgtaagggtaacggttaaggttaacgggtacgggttaaacgggtttacggggtacgggttacggggaccgttaacgggg

SEQ ID NO: 268803 - DNA, 799 bp, Homo sapiens
  misc_feature: GYAE6OF02IC5FI.28.57.F02.1.454.CMB.1.raw
  modified_base (286)..(286): a, c, t, g, unknown or other
  misc_feature (286)..(286): n is a, c, g, or t
  modified_base (447)..(447): a, c, t, g, unknown or other
  misc_feature (447)..(447): n is a, c, g, or t
  modified_base (707)..(707): a, c, t, g, unknown or other
  misc_feature (707)..(707): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgaggagtttgggctgagtcgttgggttttccttggttgtcttaagtttttaaaggtgtccagtgtgaggtgcagctggtggagtcgtgggggagcgttggtccaggtccggtcgggggtccctggacggactcgttcctggtcgccagtcctcgttggnttacccaccgtttctaagtttagtttactcgtacgttctcgtacctacggttcggtccccgaccgacggtcccgtaccggaagggggtaacggcgtacggtaataggttccgtacctaggttaaggttaagttaacggtaagttagaacggtaccttaaanaaactacgttagttaacttatacgtaacctaaacgttcgtaaggtacgggaaacggtacggtataaacgttcccaacgtacgttacccgacccggtaaggtaaaccgtactaaaccgaaacgtaacctcggtaaccttagttactaacccgttaagtaacgggtacgtcgtacgtaccggatacggaacgttccggaagtaacccggtaggtaacccgttgtaattacgttttaaaggtccggtttaagggaaaccgggntaaaaccggggggttaccttaacgggtagggtttaaaccggttaccgggtttagggggttaccggtacggggggaacctttaaccccggggg

SEQ ID NO: 268804 - DNA, 731 bp, Homo sapiens
  misc_feature: GYAE6OF02GZR2I.28.57.F02.1.454.CMB.1.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (421)..(421): a, c, t, g, unknown or other
  misc_feature (421)..(421): n is a, c, g, or t
tcagagtacgctatcacgaccggtgctcgatttagctcgatatagttgggtctgggagaggacgcccccgccctgggtttcccaggtgttcctcatttggtgatcagcactgcacacagaagagtcatgacggagtttgggctgagtctgggttttccttgttgcttagttttaaggtgtcagtgtgaggtgcagctggnggagtcgtggggagcttggtccngccgtgggggtccctgagactcctcctgtcgcagtcctctcggtacttccgaccttctaaggttattttagcgtctaacttcgactaccgttcggggtcccgaccggtacggcccttaccgggaaggggtacgggaacttacggggtaaatacgttcgttaccttaccgtaagggttaaacttaagtaaaaggttaanacggtaccggtaaaaacttaaacgtaacgtttaattaaggtttaactcggtaaaccttaaaaccttcggtaggtaaacgggtaacgggtactaaagtacctttaaccaaccgtacgttaccctaaccgtacggggtaaacctaacgtaaccgtaaaacgaccgaacgttcgtacgtacttaccgtaacaaacgttcgggactacgaccgttggaccgtagcgtacgaggactacggtactattagtaacgtcgtggaaggtaggaggtagagtaagttcggtaaggttgggtacggcgggtacgtacggg

SEQ ID NO: 268805 - DNA, 766 bp, Homo sapiens
  misc_feature: GYAE6OF02JJRYY.28.57.F02.1.454.CMB.1.raw
  modified_base (303)..(303): a, c, t, g, unknown or other
  misc_feature (303)..(303): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagtcgttggtccgagtccggtggggggttcccctggacgtacctcctccgtgtcgcacgtcctcgtggacttccaccttcagttatttacncgactagtcgcacgtcggtcccgccgaggccgtaccggaaggggacggtactagggaaacttagttcggttactacggtacggttaattaacggaaagttatcggaaccggtaaaataacgtaattaacgtttattaacgtagaacctaaaaccgtttcgtagggttacggaaacgggtacctaagtacttccgaaccgtacgtaccgtaccgaagggtaaacctaacgttaaccgaaacgaaaccttaccgcttacgttaaccgttctaacgtaacgttcgggaacctacggtacgttagaacggtacgtagtaacggaaccggcgtaaccgggttattacgttaacgtttacgtagggttacgggtacggggaaagggtaacggtaacggtaacggttaacgggttaacggggttaaacgggtttaggggtttcgggacccgggggtaaggtaaccggggg

SEQ ID NO: 268806 - DNA, 717 bp, Homo sapiens
  misc_feature: GYAE6OF02H70B3.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtctggggggagcttggtccagccgtggggggtccctggagactctcctgtgcagcctctggattccacctttcagttatttatgcttatgctacgtggtcccgccgaggcctccgagggaagggactggaatagtgtctcgtaaggttattaaggaaagtaagtgaacgtaaattaaactaattaattaatttagtagtacctaaacttcgtgtacgggaagggtacctaaggtaccttaccaacccgtacttcccgtacccgggaaagggtaaacctaaaccgttacccgaaagtaaacccgaccggtactttaacggttaacttacccttttaacgaaaagggttccgggtacctaacgggtacccgtggaaacgtacggtcgttagggaaccgggtacaccgggttactagttacttaggtttaccgtggggtagggaacgggtagggtaacggtcgggtaagttagggtaaccgggtttgggggtttcggacgggggtccgtaacggggg

SEQ ID NO: 268807 - DNA, 653 bp, Homo sapiens
  misc_feature: GYAE6OF02FRTF4.28.57.F02.1.454.CMB.1.raw
  modified_base (295)..(295): a, c, t, g, unknown or other
  misc_feature (295)..(295): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
  modified_base (450)..(450): a, c, t, g, unknown or other
  misc_feature (450)..(450): n is a, c, g, or t
  modified_base (514)..(514): a, c, t, g, unknown or other
  misc_feature (514)..(514): n is a, c, g, or t
  modified_base (547)..(547): a, c, t, g, unknown or other
  misc_feature (547)..(547): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgagttgggctgagctggggtttttccttagttgcttatttttaaaggtgtccagtgtgaggtgccagctgggtggagtcgtggggggagtccttgggtccaggcccgtggggggtccctggtacgactcctccgtgtgcagcctcgtgattcacccttgaagtttnttacttgccttatcgtcaccgttgggccctcgagctaccgaaggggaaggactagggaaatctggtctacagggttattagaaacgttaggaccgtataaacagttanaatttangactaaaactcttggtaggaagggcagtacttacactacnctccgaaggactaaacttacaaacgaagtaccgattagtaattaccgttataaagtgggcgtanaccgtaagtacgaagtcgttggaaacggtaccngggtacctaggtttacttaagtaccggttagggtggaaggtagggaaggtacgggttaattacgggtaaccggttggggttacgggtgggggttaccccaaggggg

SEQ ID NO: 268808 - DNA, 811 bp, Homo sapiens
  misc_feature: GYAE6OF02HBJ12.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagttatttatgctagtgctacgttcggggtcccgccgacggtcctccggaaggggtaacgggacctaagggtaacttaagtgtaccgtcgtaaggttaagtttaacggaaagttaagtggaaccggtaaattaaacgtaatttaagtttaatttaacgttaacggaaccgttaaaaccttcgttaacgggtaaggtaaacggggtacaaacgggtttaccttaccgtaaccccgtaacgttaccccgtaccggaaacgggttaaacctaaaccgttaaccgaaaacggaacccgttaccggtaccgttacgtttacttaccgttaacgtaaaacgggtcgggtaacctacggtaccccggttaaggaccgggttaacgtccgggtaaggtaacgggaacccgtacggggttccttaagggtttagttaaccgtttacgggttggggtaagggtaaccggggaggtaccggtaagggttacggttacgggttaaccgggtttagggggttacgggtaccgggggaccgtaacgggggg

SEQ ID NO: 268809 - DNA, 819 bp, Homo sapiens
  misc_feature: GYAE6OF02G3XTT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaaggtgtccagtgtgaggtgcagtctggtggagtcgtgggggagcttgttccagtccggtggggggtccctgacgactctccgtgtgcagcctcgtaggtacttccacctttcaagttattttatcgtactagtcgcctaccggtcggggttaccccgccgaacgggtcctacccgggaaggggtaacggggtacctaggggtaaatagttcggttcctacgttaagggttaagttaaaggtaaacggttaagttacggaacgtaaaaacttaaactaaatttaaagtttaatttaattacggtaaaccctaaaacgtttcgttaaggttacgggaagggtactaaggtactttaaccctaacccgacttccccgttaccggaaacgggtaaccttaaacgttaacccgaaaacgtaacccgtaccgtcgtttaacgtaccttttaccgtaaacgtaaaacggtcgggaacctacggtacccgtaggaaccgtaggtacggttaacgggacgaaaccgtcggtacttagttaactttaaggttacggtaacggggttagggaaacgggtaggaaaccgggttaagggtaacgttaacggggtaacggtttaggggggtcggggtaccgggtaccgggtaacccggggg

SEQ ID NO: 268810 - DNA, 837 bp, Homo sapiens
  misc_feature: GYAE6OF02IWWBG.28.57.F02.1.454.CMB.1.raw
  modified_base (140)..(140): a, c, t, g, unknown or other
  misc_feature (140)..(140): n is a, c, g, or t
  modified_base (213)..(213): a, c, t, g, unknown or other
  misc_feature (213)..(213): n is a, c, g, or t
  modified_base (303)..(303): a, c, t, g, unknown or other
  misc_feature (303)..(303): n is a, c, g, or t
  modified_base (514)..(514): a, c, t, g, unknown or other
  misc_feature (514)..(514): n is a, c, g, or t
tcagagtacgctatcacgaccggtgctcgatttagctcgatatagttgggtctgggagaggagcccccgccctgggtttcccaggtgttctcatttggagatcagcactgcacacaagaagagtcatgacggtgttgggntgagtcgttgggttttccttgttgtcttaagttttaaaggtgtccagttgtggtaggtgacagtcgtggtggngtcggtgggggagtcgttcggtccacggtccggtcgggggtccctggactctctccgtggtgcgtacgcctcgtaggtacttccaccttntaagttatttagtacgtcttaagcgtaccggtcgtccgggtcccgaccgtacggccctaaccggggtaagggaacgggtacgtacggtaaagtccggtagttaccgtaggtaaggttaagttaaagggaaaacgttaggtaaccgtaacgaaactttaaacaagttaaatttaacgtaagtaacgtaacctaacgttggtaacgggttaanacggggtacctaaaggtacctaacctactaaccgttccgtaaacggtacggaaacctaacgtaaaccgtaaacggtaaacctacggttcgttaaacgttacgtaaccgttaaacgtaaacggttccgaaccggtttaccgaaccgtacggtaaacgtaccggtaacccggtaggtaaacccgtacccggtaaacgtacgtttacgttaagttaacccggtttaggtacggggtaaaggtacggaacgggtacggttaaacggttaaccggttaagggtaacgggtttaaggggccgggtttacgggggaccggttaacggggg

SEQ ID NO: 268811 - DNA, 909 bp, Homo sapiens
  misc_feature: GYAE6OF02HLPO8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaaggtcgtccagtgtgaggtgcagcgtggtggagtcggtgggggagcgttcggtaccagtccgtcggggggtccctgagtacctcgtccgtgtgcacgtcctcgtaggtattcctaccttcgtaagtttacttttaagtcgtacttaagtcggacctacggtccgggggtcccgccgtaacggggtcccgttaccggaagggggtaaacgggtaccggtaggtaagttacgtacgttccgtacgtaagggtttagttaaaggtaaagttaagtacggtaacgtaaacttaaacaagtttaattaagtttagtacgtaacctaaaacgttcgtaagggtaggaagggtaccgaaagttaccttaaccgaacccttacgttaccccgtaacccgggtaaacggtaaaacctttaaacggttaaacccgaaaacggtaaaaccccgttacccggttaaaccgttttaaccggttaacttttaacccgttaaacggtaaacggttccggggtaaaccgcccgggttaaaccgtacgggtaaaccgtacggttaaccggtaacggggaaacccgggtaacccggttaaggttaacccgttagtttaacgtttaacggttttaccgggtaaggggacggggttaacgggaaaggggtacgggttaaaccggttaagggtttaacccgggtaaagggtttcgggggtttaagggggtaccgggggaacccggttaacgggggg

SEQ ID NO: 268812 - DNA, 728 bp, Homo sapiens
  misc_feature: GYAE6OF02FWGJB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggtcttggtccagccgtggggggtccctgacgactctcctgtgcagcctctggacttcaccttcagttatttatgctatgctacgtgggtcccgccgaggcctaccggaggggaaggtacgtagggaacttagtcgtactcgaaggttaattaagaagttaagtgacgaaataaacgtataattattaatagaactaaacttcgtaggtaggaagggtcaagtacttaccgaacctactccgtaccgtaagggaacctaaacgttacccaaagaacccaccgttactagttacttaccttaacgtaaacgttcgggaactacgtaccgtaggtaaggacgttacgacggaacgggaaccggtacggtacgttacgttaacgttaaccgttacgggtttaagggtagggggtaacggaaaggggttaccggtaacggggttaaggtttaccggggttaaacggggtttacggggggtttacgggttacccggggggaacccgtaacccggggggg

SEQ ID NO: 268813 - DNA, 793 bp, Homo sapiens
  misc_feature: GYAE6OF02HAI4X.28.57.F02.1.454.CMB.1.raw
  modified_base (661)..(661): a, c, t, g, unknown or other
  misc_feature (661)..(661): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagcgttgggttttccttgttgcttaagtttttaaaggtgtccaggtgtgaggtgcagtcgtgggtggaggttcgggtaggggggaggttcggttcggtccgacggtcccgggttacgggggggtcccctaggaacgtcctccgttccgttggtccgcgtaccggtcccttcggtcggtactttaccctaccgttacgttaagtttaactttaagtcgtaccttagtcgtccgtaccgggttccgggcccaccggacggttcccgaccgggtaaggggacggtacgtaggaaacttgtcgttacgtaagtaggttaataaggtaatacggtaggtaactaaattaacgtattaacttagttacgtaacgtaacctaacgttcgaagggttacggagggttactacgttaccgtacctaaccgtactacccggtaacggtaacggtaacttaaccgtaaccgtaacgaacgtaccgttaacgttacgttacttacgtaaacggagtcggtacgacacgngaccgagtacgaggtccgtacgacggttacttacggttactaaggtacggtacgggaggtaacgggtacggaacgggttaggtaacgggttaggtaaccgggttggggttaccggccgggttacggaccggg

SEQ ID NO: 268814 - DNA, 679 bp, Homo sapiens
  misc_feature: GYAE6OF02JU3WM.28.57.F02.1.454.CMB.1.raw
  modified_base (192)..(192): a, c, t, g, unknown or other
  misc_feature (192)..(192): n is a, c, g, or t
  modified_base (212)..(212): a, c, t, g, unknown or other
  misc_feature (212)..(212): n is a, c, g, or t
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
  modified_base (428)..(428): a, c, t, g, unknown or other
  misc_feature (428)..(428): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagctgggtttttccttgttgcttaatttttaaggtgtcagtgtgaggtncagtcgtaggtcgagttcgngggggacgtcgttggtccagccggtgggggtccctgatacctctccgtagtgctacgcctgtgacttcaccgttnagttattatgacctagngtcgagtcggtccgaccgngtacctaccgtaaagggacggtcgtagaatacgtgttctacgagtaagttacgaagtaatacggactaaaactaagtataagtttataaagtcgtaacaacgttnttacgtaaggagtcgtaacgtatacccacgtactccgtacgtaaacggtaacgtaacttaccgaaacgtaacgacgtacgttacgttaactacgttaaatacggtacggacacggtacctaggacgtagaacgttacggaacgtacggtaccgtagtacggttaactaggttaggtcggtaaggtaagaacgggtagaacggttagtaccggggtaagtttacggggtacgggtaggtacgggtaacccgg

SEQ ID NO: 268815 - DNA, 996 bp, Homo sapiens
  misc_feature: GYAE6OF02IDZYW.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagccgttgggttttccttggttgactttaattttttaaacggtgttccagttgtggaggttgcctaggtcttgggtggacgttccggtggggggacgtcgtttcgggtcccaggtccggttcgggggggtacccctggacgtaccgttccgtccgttcggtacgccgacggttcccctcgttacgggttactttacccgtaccccgttttataacggtttaacttttacgtcggtaccttaagtcgtaccgttaccggttccggggttaccctcccggacgggttacccgttaccggggaaacgggggtaaacggggtacccgttaagggtaaacgttacggtttacggttacccgttacggtaaaacggttttaacggtttaaaagggtaaaaacggtttaaacgttaaccggggaaaccttttaaaaaaccggtttaaaacctttaaacggtttaaaattttaaacgttttaaacgttaaccgggttaaacccttaaaaacccggtttacgtttaacgggtaaccggggttaaaacgggtacccgttaaacgtttaccgttaacccgtaaaccctttaccgttaacccggtaaccggtaacgggttaaacctaaaccgttaacccggaaaacgtaaacccgtacgttacggttcttaaacgttaccttaaccgaaggtaccggagtaccgtacgaggtacgtacggtactacgggaaccgacgtaccggttaattacggttacgtttaacgttacggtacgggtacgggtaaggaccgggtagttacccgggttagggttacggtaaagggtttaccgggggtttaggtacccgggggacgtaaccggggg

SEQ ID NO: 268816 - DNA, 929 bp, Homo sapiens
  misc_feature: GYAE6OF02FIIRS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggtttttccttgttgtcttaatttttaaaggtgtacctagtgtgaggtgcagcgtggtggtagtcggtgggggagtcgttggccaggtcccggttggggggtccctgtacggtacctccttccgttggtacgcgacgtccgttcgtcggttacttccgtacctttagtaacgtttatttacgtcgtacttagtacgtacgttaccgggtcggggttccccgacccggacgggttacccgtaacccggggaagggggaaccggttaacggtaaggtaaattacggtcgtacccttaggtaacgggtttaattaaacggtaaacgttaagtacggtaaacgtaaaactaacgtaagttaactttaagttaactacgaacttaaacgtcgttaagggtaacgggtaacgtacgtaacgtacgtaacccgtaacctacgtaccgttaacccgggaaacgtaaccttaaaaccgtacgaaaaccgaaaccgttaacgttacccgtaagttttaccctagtttaaaaccggaacgggttacggtaaccgtaacggtaacccggtaaggtaaccgggtacgtaaccgggtaaacggggtaacccgtaaaccgggttaccggttaagttaacggtttaacgtttaccggtttaaggggttcggggttaaaccgggggaagggttaacggggtaaaccgggtaaccggtttaaaggggtttaaccgggttaaacgggggtttaacggggttaccggggttaaccggggggaaccgggtttaaccggggg

SEQ ID NO: 268817 - DNA, 847 bp, Homo sapiens
  misc_feature: GYAE6OF02G3K3O.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttggctgagcttgggttttccttgttgcttattttaaaggtgtccagtgtgaggtgcagctggtggagtcgtgggggagtcgttggtccgagtccggtgggggtccctgagactctctgtcgcacgtcctcgtggtacttcctaccttacctaagttattttaatcggtacttagtcgcctacggtacgggttacccgccggacggtccgttaccggaaggggtaacggtaacgttaacggtaacgttacgttacggttaccgttaacggtaaggttaaagtttaaacggtaaaccgttaaagtacggtaaccggtaaaactaactaaacgttaagtttaacgttaacgtaacggtacctaaaacgttcgttaaggtacggtaaggtaacgtaagtaccttaaccgaccgtaaacgttccccgtaacgggaaggtaaaccctacgttaaaccgaaacggtaacctaccggttaattacgttaacgtttacctaaagtaaaacgggtcggtaaccgttaaccgaccggttaggtaaaccgtactaaccggaacggtttacggaaacccggttcggttacctaaggtttacttaccggttaaggttaacgggggtaacgggaagtaaccgggaaggtttaaccggttaaacgggttaaccgggttaaggttacgggggggttttacgtaccggggaaaacccggggtttgggggg

SEQ ID NO: 268818 - DNA, 963 bp, Homo sapiens
  misc_feature: GYAE6OF02IJ9OC.28.57.F02.1.454.CMB.1.raw
  modified_base (175)..(175): a, c, t, g, unknown or other
  misc_feature (175)..(175): n is a, c, g, or t
tcagagtacgctatcacgaccggtgctcgatttagctcgatatagttgggtctgggagaggagcccccgccctgggtttcccaggtgttctcgatttggtgatcagcactgcacacagaagagtcatgacggagtttgggctgagctgggttttccttgttgctatttttaaggngtcagtgtgagtgcagctggtgagtcgtggggagcgttggtccagtcgtcggggggtacctgacgtactctcctgttacgctacgtcctacgtggtacttacctacctttccgtaagttttaacttttagcggttaccgttaagttggtacccctacgggtttcccgggggttacccccgtacccggtaacggtccccggttaacccgggaaaggggggtaaaaccgggtaccgttaagggttaaacttaccggtttcggttacccgttacgggtttaaagggtttaaacgtttaagggtaaaaccggtttaaagtcggtaaaccggttaaaaacgtttaaaaccttaaaggttttaatttaaagttttaacgtaacggttaaaaccttaaaccggtttacggttaacgggttaaccgggggtaaaacgggtttccaaacgggtttaaccgtttacccaaaccgttaacgtttaacccggtacccgggaaaggggttaaacccgtttaaccgttaaaccggaaaacgtaacccggttaacggtaaccttttaacgggttaacctttaaacggtttaaccgaaaaccggtcgggtactaaacggttccggttaggtaacggtacggtaccggtaggtaaccggggtaacgtacggggttaccttagttacccgtttaaggtttacggttaacggggaaggggttaccggaaagggtaaccgggttagggtaaccggtttagggggaaaccgtttagggggtacggggttacggtacgggtaacccgggg

SEQ ID NO: 268819 - DNA, 785 bp, Homo sapiens
  misc_feature: GYAE6OF02IOPGT.28.57.F02.1.454.CMB.1.raw
  modified_base (673)..(673): a, c, t, g, unknown or other
  misc_feature (673)..(673): n is a, c, g, or t
  modified_base (709)..(709): a, c, t, g, unknown or other
  misc_feature (709)..(709): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggtttttccttgttgcttaagttttttaaaggtgtccagtgtgaggtgcagctggtggagttcgtgggggaggcttggtccaggccgtcggggggtccctgacgtactcttccgtgtcgaccgagtccctctaggtactttcctaaccgtttctagtttatttaacgtcgtcttaatcggtacctacggttcgggtccccgaccggacggtaccgtaccgggaacggggtaacggggtacgtaaggtaagttcgttaccgttcctacggttaaggttaagttaaaggtaagtaacgttaggaacgtaaattaaaccttaattaaatttaagtttacgtacgtaacctaaacgttcgttaaggtacggaagggtccaagttactacctaacctgtaacccgtaccggtaaacggtaactaacttaaccgaaaacgtaccacgttacgtactttaacgtaccttaagacgtacggactaccgacgttagaacgtaggtccgtaaacggtacggactaccgggttnttacggttactttaaggtacggttgggtaaccgggngggttaacggacgggttaaggttaggttaacgggtacggtttaacggggttcgggtaccggtacgggtaacccggg

SEQ ID NO: 268820 - DNA, 986 bp, Homo sapiens
  misc_feature: GYAE6OF02FQMR0.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtcgggttttcttgttggtcttaagtttttaaaggtgtcctagtggttgaggtgcgtagcgtggtcggagttcgtgggggacgtcgttggtaccgagccgtacggggggtccctggagtacctccgtaccgtcggtcgcgtacggccgttcgtgggttacttacccgtacctttaccgtaacggttttatttaacgtacgggtactttaagttcgtaaccggttcggttaccggggtcccggacccggtacgggtaccccgtaccggttaacggggggaaaccgggttaccggttacgggttaaacctttaaccggtagggtttacccgtaaccggttaagggttttaaacggttaaacgggttaaacggtttaagtaaccggtaacccggttaaacgtaaaccgttaaacgttttaacgtaaacggttttcggttaaacgtaaaccctaaaccgttttcggttaacggggttaacgggtaacggggtaaccgtttaacgggttaaaccctttaccgggttaaaccctaaccggttttacccgggtaaaccccggtaaaaccggggttaacctttaaaacttaaccccgggaaaaccgtaaacccgtggttaacccgttttaacggtttaactttacccggttttaaacggaaaacgggtttccgggaaactttacccggtttagaccgggttaagggttacgacggtttaaccggggaccgtaaacgggtttccaccgttacggttacttaagttacccgggtagggtcggggtaaacgtacgggtcggttaagggtacgtaggtttaacgggttcgggtacgggtccggacggtacggg

SEQ ID NO: 268821 - DNA, 696 bp, Homo sapiens
  misc_feature: GYAE6OF02FP7GG.28.57.F02.1.454.CMB.1.raw
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
  modified_base (597)..(597): a, c, t, g, unknown or other
  misc_feature (597)..(597): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggtttttccttgttgcttatttttaaaggtgtccagtgtgaggtgcagctggtggagtcgtgggggaggtcgttggtccagcccggttgggggggtcccctggacgacctcctccgtgtgcacgcctcgtggattccaccttcagttattatgctatgcacgtggtccgcgagctcgagggaggctaggaatntgtctcgagttactaggaagtatgacgaatacatatattanagactaacttctggtagaaggtcaagtacttaccaacctcgtacctaccggaagggtaacctaacgttacccgaaagtaacccgtacgtccgttaattacttacctttaacaaaggttaccgggacctaccggtacccgtagggaacgtacgtcgttaacgggaaccggtaacccgagggtaccgttaacgttagttaacgttcggttaagggngggaaacgggtaacgggtacggtaacggttaacggtttaggggttaaacccgggtttagggggttaccggggtaccgggggtaccgggtaaaccggggg

SEQ ID NO: 268822 - DNA, 742 bp, Homo sapiens
  misc_feature: GYAE6OF02G3FQU.28.57.F02.1.454.CMB.1.raw
tcagagtacgctatcacgaccggtgctcgatttagctcgatatagttgggtctgggagaggagcccccgccctgggtttcccaggtgttcctcatttggtgatcagcactgcacacagaagagtcatgacggagtttgggctgagcgtggtttcttgttgcttatttttaagtgtccagtgtgaggtgcagctggtggagtcgtgggggagcttggtccagtccgtggggggtccctgagactctcctgtacgcacgtcctcgtggtacttcctaccttcgtagtttatttactgtctatcgctacggttccgggtcccgccgacggtccgtaccgggaagggggaacggtaccgtagggtaaattggtcgttcgtacgtaaggtttaacgttaaggtaaagttaagtacggtaacctaaaagttaaacctaagttaaatttattagtaacgtacctaaacgttcgtagggtaacgggtaaggcgtaacgtacttaccgtaccctactttacccgaccggtaacggtaaacctaaaccgttaaccgaaacgtacccgtaacggttccttaagtttcccttaacttacgtaacgttcgggacctacgttaacgaccggtaggtaaccgtcggtaacgaacggtacgaccgggttattaccggttatttaccgtaggtggtacggaagggtggtaacgtacggttagtacgggtacggttagggtgggtacggcggtaaccggg

SEQ ID NO: 268823 - DNA, 653 bp, Homo sapiens
  misc_feature: GYAE6OF02F5NND.28.57.F02.1.454.CMB.1.raw
  modified_base (497)..(497): a, c, t, g, unknown or other
  misc_feature (497)..(497): n is a, c, g, or t
  modified_base (568)..(568): a, c, t, g, unknown or other
  misc_feature (568)..(568): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtgagtcgtggggaggcttggtccagccgtgggggtccctgagctctcctgtgcacgcctctggtacttcctacctttctagtttatttacgttgacttagtcgtacgtaccggttcgggttcccgacccgacgggtccgtaccggaagggggtaacgggtacgtaggtaattacgttcggtacgtcgtaaggttagttaagtaagtaacgtagacgtaaataactatattatatgactaactgtagtaggaaggtcagtacttccactactctacgaggtaactacgttacaaacgtacncgtcgtatacttacgtataacgtgggacctaacgcgtgaacgtctcgttagaccgtacgtacgtgtaattntacgttaggtacgggtaggaacggaggtagggtaacgtaaggttacggaacgggtttaggccggggttacggacccggtacgggg

SEQ ID NO: 268824 - DNA, 669 bp, Homo sapiens
  misc_feature: GYAE6OF02G0DIW.28.57.F02.1.454.CMB.1.raw
  modified_base (175)..(175): a, c, t, g, unknown or other
  misc_feature (175)..(175): n is a, c, g, or t
  modified_base (438)..(438): a, c, t, g, unknown or other
  misc_feature (438)..(438): n is a, c, g, or t
  modified_base (573)..(573): a, c, t, g, unknown or other
  misc_feature (573)..(573): n is a, c, g, or t
tcagagtacgctatcacgaccggtgctcgatttagctcgatatagttgggtctgggagaggagccccgccctgggtttcccaggtgttctcatttggtgatcagcactgcacacagaagagtcatgacggagtttgggctgagctgggttttccttgttgctatttttaaaggtntccagtgttgaggtgcagctggtgagtctgggggagcttggtccagccgttgggggtccctgagacgtctcctggtcgacagcctcgtggagttccacctttcaggttatttactgctatgtcacgtcgggtaccgccgaaggtcctccgaaggggtaagggcttaggggaattagtacgttcctacgtaagggtatttaaggaacgttaatcggaccggtaaactaaacgattaaataacgtttatcaacgttaaaacccgnggtttagtgaaaacggggtctaacggactttaacgacctactacttacctaacgggtaacctaaagtttaccaaacggaacctaacgtcgttacgttacgtaccttacgtaatacgggtactacggaccacgganacgtacgtgtacgggacacggtctagtatacgttagtcggtaggtacggaaggagacggaattcggaacgttagggtacggttagggacgtacggg

SEQ ID NO: 268825 - DNA, 794 bp, Homo sapiens
  misc_feature: GYAE6OF02HVA27.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggtttttaccttgttgcttaagttttttaaaggtgtccagtgttggaggttgcagcgtgggtggagtcgtgggggagtcgttggtccacggccggtagggggggtcccctaggacgtacgttcctccgtagtgctacgcccgtgtggtacttacctaccgtttacacggttattttaacgtcgtacttaagtacggcctacggttccgggtaccgaccgtacggtccgtaccggaaggggtaacggacgtaggtaaacgtattacggtccgtacgttaaggttaagttaagtaaacggttagtaacgtaacgggttaaacttaaactagtttaatttaaacgttagtaacgtaaacggtaaacctttacgtaggttaacgggaacgggtactaacgttaactacccgaacgtacttaccgtacggaacggtaacttaacgtaaccgaagaaccgtacgacgtttacgtacttacgttaacgaagtccgggacttaaccgtacgtaaggacgtcgacgggtagtaaccgacggacgttacgtagtttaacgtagttaacggtcgggagggtacggaaacgggtagtaccggttaagttagggaaacccggttttaggggtacgggtacggggtaccggtaacgggg

SEQ ID NO: 268826 - DNA, 640 bp, Homo sapiens
  misc_feature: GYAE6OF02GCO4C.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattccaccttcagttatttatgctatgcacgtcggtcccgccaggcctccgaggggaagggctaggaatatgtctcgaggtataagaagtatgacgaataacatatattatgactaactctaggtagaagggcagtactttccaactatcctaccgacgggtaactaaacgttaccgaaacgaaccgacgtacttacgttacgttaccttaacgaaaacgttcgggacgtacgaccgtggaacgtgacgttaggacggaccgacgtcgttacgtattaacgtttacggtagggtacgggtaaggagggtaacggtagggtaaggtttacgggtaaacgggtttaggggttacgggtacggggacccggtaacgggg

SEQ ID NO: 268827 - DNA, 745 bp, Homo sapiens
  misc_feature: GYAE6OF02FXSS8.28.57.F02.1.454.CMB.1.raw
tcagagtacgctatcacgaccggtgctcgatttagctcgatatagttgggtttgggagaggagcccccgccctgggtttcccaggtgttctcatttggtgatcagcactgcacacagaagagtcatgacggtaggtttgggctgagcttgggttttccttgttgcttagtttttaaaggtgtccagtgtgaggtgcagcgtggtggagtcggtgggggaggtcgttggtaccgaggtcccggttcgggggggtccctaggacggtaccttccgttcccgtggtcgcacggtcccttcgtggtactttcctaccgttcgtaagtttatttagtcgtacttagtcgccgtacggttccgggtacccgaccggtacggtccgtaccggaaggggtaaccgggtacgtaggtaacgttagtcgtctacgtaggttaagttaaggtaagtacgtaggaacgtaaactaacgtaattaagttacgtttagtacgtaactaacgtcgtaggtaacgacggtactacgtactaccacgacttcgacggaagtccaaacgttacgaagaccgctacttaagtaccttacgtagaacggttcggaactcgacgagggtactaccgaggtaaccgacgtaaccgtccgtagtacgttaactagttacgggtacggagggtaacggacggcgttaaacgggttggttaacgggtaaccgggttggtaaccggggtcgggaccgtacgggttacccgg

SEQ ID NO: 268828 - DNA, 619 bp, Homo sapiens
  misc_feature: GYAE6OF02H70VO.28.57.F02.1.454.CMB.1.raw
  modified_base (254)..(254): a, c, t, g, unknown or other
  misc_feature (254)..(254): n is a, c, g, or t
  modified_base (388)..(388): a, c, t, g, unknown or other
  misc_feature (388)..(388): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtgggggggtcccctgagctctcctgtncagcctcgtggattccacctttcagttactttagtgctatgcacgtcggtccgccgaggcctccgaggggaacggacgtaggaatattcgctcgaaggttaattagaagtaagtgacgaaataacatatattancgacaaactctgtaggaaggcgtagtactactaccagtcctaccgaaggactaaacgttacccaaagaaccaacgtcttagtacttacttacgaaagtcggacagacgtagacggaacgctacggagaacgagggtctattagtaactttacgtgggttacgggaggtaagggaggacgggttaacgttaggggaaccggtttagggggtaggtcgggggacgtaacgggg

SEQ ID NO: 268829 - DNA, 801 bp, Homo sapiens
  misc_feature: GYAE6OF02J0YVV.28.57.F02.1.454.CMB.1.raw
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (315)..(315): a, c, t, g, unknown or other
  misc_feature (315)..(315): n is a, c, g, or t
  modified_base (334)..(334): a, c, t, g, unknown or other
  misc_feature (334)..(334): n is a, c, g, or t
  modified_base (637)..(637): a, c, t, g, unknown or other
  misc_feature (637)..(637): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttggttgtcttatttttaaaggtgtcagtgtgaggtgcagctgggtggtagtcggtgggggnggtnttcgggtaccaggccggttcgggggggttcccctaggacggtactcctccgtggtacgccacggccctacgtggtacttacccgtccgtttanaggtttattttacgtggtnttaacgttcggaccttaccggtttaccgggtccccggaccgtaggggtaccccgttacccggtaagggggaaacgggtaccggttaagggtaaacttacgtcgtaccgttaagggtaaggtttaagttaacggtaaaaggttaacgtcggtaaacgtaaaactaaacgttaagttacttaaagttataaccggtaaataaacccgttttaggaggttaaaccggggaaagggttacctaacggtaactttacccgtaacgtacgttacccgacggtacggtaaacctaacgtaccgaaagacncggaaccttgtaacctgtacgtaacgtcgacacgtcctaggcgacgtcgtaagggtccgagtaacgtgtaggtattaacgtgggtacggagggtagacgggacgttaagggttacttacgggtaaaccgggtttggggaacgggtaccggggtcgtaacggggg

SEQ ID NO: 268830 - DNA, 712 bp, Homo sapiens
  misc_feature: GYAE6OF02I1S96.28.57.F02.1.454.CMB.1.raw
  modified_base (601)..(601): a, c, t, g, unknown or other
  misc_feature (601)..(601): n is a, c, g, or t
  modified_base (666)..(666): a, c, t, g, unknown or other
  misc_feature (666)..(666): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagttgggctgagcgttggtttccttgttgcttatttttaaaggtgtcctagtgtgtaggtgcagcgtggtggagtcggtgggggaggtcgttcgggtccacgtccggtcggggggtccctggacgtacttccgtccgtggtcgcgacgtccgtacgtggtacttcctaccttacgtaagttattttagtctcgtactcgtactacggtccgggtcccgaccgtacggtcgtacccggaaggggtaacggtactagggtaactagtacgtaccgtcgtaacggttaaagtaaggtaagttaagtaacgacgttaaaagtaactaattaagttacgtaagtactaacctaaactcgtaagggtaggacgtaacgtacgtaacttaccgacctaagttaccgttacggaaggtaaacttacgaaaccgtaactaacgcgtacgttacgttaatacccgtaataaggccgtacngtactacggagaccgtacgagaacgtaccgtaagtcgtagttagttacgtaccggtggaacgggngtaaggacggtagtagttacggtagtcggtagggtaggacgtccgg

SEQ ID NO: 268831 - DNA, 724 bp, Homo sapiens
  misc_feature: GYAE6OF02GM9BN.28.57.F02.1.454.CMB.1.raw
  modified_base (278)..(278): a, c, t, g, unknown or other
  misc_feature (278)..(278): n is a, c, g, or t
  modified_base (466)..(466): a, c, t, g, unknown or other
  misc_feature (466)..(466): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgttgctattttaagtgtcagtgtgaggtgcagctggtggagtcgtgggggagtcgttggtccagccgtgggggtccctgagctcgtctgtagcacgtcctacgtggtacttcgtaacccgttntaacggtttatttattcgcttagttcgactcgttcggggaccctaccgtaggtcctcggaaggggtacgggacgtaggtaattcggtcgtttacgacgttaacgttaaggttaagtaaggtagtacgaacgtaataactaagttaagtactttagacgtaacctaaactcgttaggacggtacggtancgtacgttcccaacgtacgttaccgtaccggacggtaaactaacgttaaccaaacggtacctacgtacgttacttacttacgtaaactaaggtcgacgtcgtacggtacacggacgtagttacgggaacgtacgaccggtattaacgtttacttacggttaccgttagggtagggtaggtacgggtaccggttagggtacggtttaccgggttaagggtttacggggttacggtaccggggggaccgttaaccggggg

SEQ ID NO: 268832 - DNA, 818 bp, Homo sapiens
  misc_feature: GYAE6OF02F0185.28.57.F02.1.454.CMB.1.raw
  modified_base (741)..(741): a, c, t, g, unknown or other
  misc_feature (741)..(741): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctgagcgttgggtttttccttgttgcttaatttttaaaggtgtccagtgtgaggtgcagcgtggtggagtcgtgggggagtcgttggtccgaggccggtggggggtccctggacgactccgtccgtgtcgcgacgcctcgtggtactttccacctttctaagttaattttactgtccttagtcgcgtacgttcgggtacccgccggtacgggtcctaccgggaagggggtaacggtacggtaacggtaaagttacgttcggttacctacggtaagggtttaattaaaggtaaagttaaacgtacggtaaacgtaaaacgttaaacgtaaattaagttttaaatttaacgtacggtaacttaaaaccgttcgttacgggtaaacggtaaacgggtaataacggtttaccgtttaaccaacccgttaacgtccggtaaccggaaacgggtaaaccttaaaccgtaccgaaaaaccgtacgtacccgttataacggtttaactaccgttaaagtaacggtcggaactccgtaccgtaggacgtacgtacgaaggaaccgtaccgtagtacgtagtaacgttcgtttaacggtgggtaacgggnggtaaacggttcggtaaagggttaggtaacgggttaaccgggttaggggtttacggtacgggtaaccgggttacggg

SEQ ID NO: 268833 - DNA, 746 bp, Homo sapiens
  misc_feature: GYAE6OF02FPANR.28.57.F02.1.454.CMB.1.raw
tcagagtacgctatcacgaccggtgctcgatttagctcgatatagttgggtctgggagaggagccccccgccctgggtttccccaggtgttctcatttggtgatcagcactgcacacagaagagtcatgacgggagtttgggctgagcttgggtttttccttgttgcttaatttttaaaggtgtcctagtgtgaggtgcagcgtggtggaggtcgtgggggagtcgttcgggtccaggtcccgggtcgggggggtcccctggaacgtaccttccttccgtggtcgcgtacgtcctcgtaggtacttcctacccttataagttaatttagtcgtactatcggctaccggtcgggtacccgccgtaacggtcccgtacggaaggggtaacggtacgtaaggtaattagtcgttaccgtaggtaagggtttaagtaaaggtaaagtaacgtacgtaacgtaaactaacgtaaattagttaagttagtaacgacctaaacgttgttaggtaacgggaaggtactaggtactacccgtaaccgtaatccgtaaccggaacggtaactaaccgtaaaccgaaacgaccgtacttacgttaattacttaacctaggtaaaggtccggactacgtcgaggacgacgtgaacggacgacgtgacgttatacgttgtaggtacgggtagtaacgggtaggacggttaaggtaggttagggttaacggttggggtacgggttacgggaccggtacgg

SEQ ID NO: 268834 - DNA, 772 bp, Homo sapiens
  misc_feature: GYAE6OF02IJ5D4.28.57.F02.1.454.CMB.1.raw
  modified_base (635)..(635): a, c, t, g, unknown or other
  misc_feature (635)..(635): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgacttaatttttaaaggtcgtccagtgtgaggtgcagcgtggtggagtcggtgggggacggtcgttcggtccacgccggtcggggggtcctggacgtacctccgtccgtgtcgcacggtcctctggtattcctaccttcgtaagttattttacgtcgtacttagtcgtacgtaccgttcgggtccccgacgacgggccttaccgggaagggggaaacggtcgtaacgggtaatagttcggtactacgtaggttaattaaggtaaacgtagtcggaaacgtaaataactattaatttaattacgtagtaacctaaactttcgtaaggttacggacggtaataacggtaacttaccgaactaaccgttccgtaaccggaaacggtaaccttaaaccgtaccgaaaacggtaacccaccgttagtttaacttaacgttcctaaacgtaagggtccggactaccggtagtcgaacggngtacgtaagggacgtaccgtaagtcttaaggttctaaacggttcgggagggtaacggggaggtaaacggacggtttaaggtaacggtttacggggaacggttttggggtacgggtaccggggaccggttaaccgggg

SEQ ID NO: 268835 - DNA, 865 bp, Homo sapiens
  misc_feature: GYAE6OF02G2CTT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagttgggctgagcgttgggttttccttgttgtacttaagtttttaaaggtcgtaccagtgtaggaggtcgcgagtcgtgggtaggagttcgggtaggggggacgtcgttcggtccgaggccggttcggggggtccctgacgtacctccgtcctggtcgctacgtcctcgtcgtacttcctacttctaagtttacgtttatcgtacttagcgtaccgtacggtccggggtacccgtaccggacgggtacccgtaccggggaacggggtaaccggtaaccgttaaggtaacgttaacgttccggttacgtaggtaaacggttaagttaacggtaagttaacgtaccgtaaagtaaactaaagtattaagtttaactaacgtaacggtaactaacggttcgtagggttaacgggacgtacgtaacgttaactaccgtaaccgttacttaccgaaccgggtaacgtaaccgtaacgtaaccgaaacgtaccgtaccgtacgttacgttacttaaccgttaagtaacggtacgggactacggtaaccgtacggaacggtaacgtacggttaacggaaccggtacgtaacggttaccgttagtttaacccgttaaggtttaacgggtaggggtaaacgggtaacggtaaggggtaaccggttaagggtttaacgggtacgggttaaaaccgggggtttgggttaaccggggtacccgggggtaccggttaacccggggg

SEQ ID NO: 268836 - DNA, 847 bp, Homo sapiens
  misc_feature: GYAE6OF02HTJOW.28.57.F02.1.454.CMB.1.raw
  modified_base (669)..(669): a, c, t, g, unknown or other
  misc_feature (669)..(669): n is a, c, g, or t
tcagagtacgctatcacgaccggtgctcgatttagctcgatatagttgagtctgggagaggacgccccccgccctgggtttcccaggtgttctctatttggtgatcagcactgcacacagaagagtcatgacggtagtttgggctgagtccgttgggttttcctttggttgcttaatttttaaaggtgtcctagtggtgagggtgcgagtcgtgggtcggaggttcggtggggggaggtcgtttcgggtaccgacgggtcccgggttacggggggggtcccctaggacggtaccttcccgttccgttggtcgcgaccgtccttcgtggtactttcctaccttaccgtagtttaactttatcgtactagtcgtccgtaccgggtccggggttccccgacccggtacggtccccgtacccgggaaggggggtaaacggtaccgtagggtaacttcgtacgttccgtacgtaggttaattaaggaaacggttagtacggtaagtaaaacttaacgtaatttaacttatttaagtacgtaaacttaaacgtcttaaggtacgggtaagggaccgtagtaacttccgaaacctactcccgaaccggacggtaaacctaaccgtaaccgtaacggaaccctacgtacgtagttaccgttaactaacgttaacggnggtacccgacggtccgtaaggacggtacggtacgtcggaaccgggtaacgtaccggggtacttagggttacttaaggttaacggttagggtagggaacggggtaaggtcggggttaaacgggttacgggttaacggttaagggggtttccggggttttaggggacggggtacccgggg

SEQ ID NO: 268837 - DNA, 867 bp, Homo sapiens
  misc_feature: GYAE6OF02HLYDD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaggtgtccagtgtgaggtgcagctggtaggagtcgtgggggagcttggtccagccggtggggggtccctgagacctctcctggtgcacgccttcgtcggtacttcctacctttactaaggtttatttatcgtacttagtcgacctacggtcggggtccccgccgaacggtccgtacccgggaagggggaaacgggtacttagggtaaattacgttcggttaccttacggtaagggtttaagttaaaggtaaaacggttaagtacggtaacgtaaaacgtaaactaagtttaaactttaagttaaagtaccgtaaaaccgtaaacctttccgggttaagggtaaacgggtaaacgggggtcctaaaggtttacccttacccgaaaccccgttaacgttaccccggtaaccgggtaaacgggttaaacctaaaccccggtttaaccggaaaaacggttaacccgtaacccggttccgttttaaacgacccgttttttaacccgtaaacgtaaacggttcgggaaccctcggttaccggtaggtaccgtaagtcggtaaggaaccggtacgtaaccgggtagtttacgtaacgtttcggttaacggtgggggtaacgggtaacggagggttaacgggtgggttaaggttaaccgggttaccggggtttaagggtccggggtacgggtaccgggaacggg

SEQ ID NO: 268838 - DNA, 771 bp, Homo sapiens
  misc_feature: GYAE6OF02F39PJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagctggtggagtcgtgggggatacgttggtccagccggttggggggtccctgacgtacctctccgtagtcgacacgtcctcgtggtacttccaccgttactaagtttatttacgtcgtacttagttcgacgttaacggttcgggtaccccgaccgacgggtcccgttaccggaagggggaaacgggtacgtagggtaaattagtcgttaccgtacgtaaggttaagttaacggtaaagttaacgtaggaacgtaaattaaacgtaagttaattaatttaacgtacgaaaccttaaacgttcggttagggtaacggaacgggtactaaggttacttacccgaacttacgtacccgtaccggaaggtaaaccctaaacggttaacccaaacgaacccgtcgttacgttagttaacttactaacgtaaggtcgggactacggtacgtaggaagacgtacgagggtaacgaccgtaacggtcgttaatagtttaacgtacggttagggtacgggaaggttaaggacggtaacggtaggttacgggtaaggttccgggtagggtaccgggacgtaaccgggg

SEQ ID NO: 268839 - DNA, 657 bp, Homo sapiens
  misc_feature: GYAE6OF02G9XK3.28.57.F02.1.454.CMB.1.raw
  modified_base (179)..(179): a, c, t, g, unknown or other
  misc_feature (179)..(179): n is a, c, g, or t
  modified_base (251)..(251): a, c, t, g, unknown or other
  misc_feature (251)..(251): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
  modified_base (398)..(398): a, c, t, g, unknown or other
  misc_feature (398)..(398): n is a, c, g, or t
  modified_base (501)..(501): a, c, t, g, unknown or other
  misc_feature (501)..(501): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcctgtagctatttaaggtgtccagtgngagtgcagctggtggagtcgtgggggagtcgttggtccagccgtggggggtccctgagtacctctcctgtanctagccctgtggtacttccaccttcagttatttangtacctatcgcgtaaccgtcggggtacccnccggtacgggtccctaccggaggggtaacggacgtaggaatctgttctacgtagtagttaagacgtaatagacgaaataacnttaatacttagagtacctaatctaggtacggaagtccgagtattaccgacaacgtcacgaagactactaacgtaacacgtacctacgtactacttaccgtaanaggttaccgggcgagtacccgtaggtagaaccgtcggacgaacgggtaccgtaaacgtgtaacgttaccgttaggtaagcggggttaggtaaggaacggtaaggtcggtaagttacgggtacggttaagggttcgggtaggggaccgtaaccgggg

SEQ ID NO: 268840 - DNA, 786 bp, Homo sapiens
  misc_feature: GYAE6OF02HL3H4.28.57.F02.1.454.CMB.1.raw
  modified_base (176)..(176): a, c, t, g, unknown or other
  misc_feature (176)..(176): n is a, c, g, or t
  modified_base (263)..(263): a, c, t, g, unknown or other
  misc_feature (263)..(263): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctggagctgggtttccttgttgctatttttaaaggtntccagtgtgaggtgcagctggtggagtcgtgggggaggtctggtccagccgtggggggtccctggagtactctccgtgtgcagcctntcggattccaccttctacgttatttatgtctatcgtcacgttcggggtcccgccgagggcctaccggaacgggggaacggacgtaagggtaacttgttagttcctagtaaggttaagttaaggtaaagttaatacggacctaaaacttaaacgtaattaacgttaacgtttaagtacgaaaccgtaaaacttcggttaggttacggggaaacgggtacttaacggtaacctttccgaaacctacgttaacccgtacccggtaaagggtaaccttaacgttaacccgaaacggtaacccgaacgttcgttaacgtttaactacccgtttaaagtaacgggtacgggtacctaaccggacccgttaggaaccggtgtaccgtaagggaacggtaccggtaacggtcgttacgttaacgttacgttttacgaggggttagggaaagggttaacggacgggtaaggttaaacgggttaacggggtaacgttttacggggggtcgggtaccggggtacggtaacgggg

SEQ ID NO: 268841 - DNA, 844 bp, Homo sapiens
  misc_feature: GYAE6OF02FZTSG.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagcgtggtggagtcgtgggggagtcgttggtccgagccggtgggggtccctgacgctctcctgtgcagcctcgtggtattccaccttcaagttattttatgtactatcgtcaccggttgggtcccgccgtacggtcctaccggaagggggtaacgggacgtagggtaaacttacgtgttacccgtagtaagggtttaattaagggtaaagttaacgttacgaacggtaaaactaaacgtaataagtttaactaagtcgtaactaaacgttccgttaggtacggggtaaaggaccgttaagtaacttaacccgaacctacgttcccgtacccggaaacggtaaccgttaaacttaacccggtaaagaaacccgtacgttacgtaacgttaacttccgttaaacgtaaacgggttcgggaactaacggaccgttaaggtacgtaaccggtactacgggttagaaacccgggtaaccgttacgggtacccgtttaagttaacgtttaaccgggtttttaacggtaccggggttaagggggtaaacggtaaaacgggggtaacccggggttaacgggtttaacggggttttaaaccgggtaaaacccggggttttgggggggttttaacggggtaccccggggggttaaacggggg

SEQ ID NO: 268842 - DNA, 805 bp, Homo sapiens
  misc_feature: GYAE6OF02JR40N.28.57.F02.1.454.CMB.1.raw
  modified_base (112)..(112): a, c, t, g, unknown or other
  misc_feature (112)..(112): n is a, c, g, or t
  modified_base (116)..(116): a, c, t, g, unknown or other
  misc_feature (116)..(116): n is a, c, g, or t
  modified_base (181)..(181): a, c, t, g, unknown or other
  misc_feature (181)..(181): n is a, c, g, or t
  modified_base (219)..(219): a, c, t, g, unknown or other
  misc_feature (219)..(219): n is a, c, g, or t
  modified_base (288)..(288): a, c, t, g, unknown or other
  misc_feature (288)..(288): n is a, c, g, or t
tcagagtacgctatcacgaccggtgctcgatttagctcgatatagttgggtcgtgggagaggacgcccccgccctgggtttcccaggtgttctcattggtgaatcagcaacngcanacagtaacagtcaatgtacgggatttgggactgaggtccttggggttttcctgttagttacgttnccccgtttaaaaggttgtccaaggttgtagaggtcggngaggacttggtggggatcgttgggggacggcttgggtccggaaactcgtcgggggtccctgagtacgtntcctacggcgtgaagtcctccgtgtacggttctaccttctagtaggtttaacttggcctgtcgggtctacgtgggtcccgcccgagggattcccgtaaaaggggtaacggttagtagtaatagtcgtactagtaagtaccgtaaacgttaatagtcgtcaaattaacgagttaacgtaagttacgtaggtaacgtaaacctcgtaggttacgaaccgggtacgaacgaaactttccccgaaacgtaacgttacctaaccgtaagggttaccgtaaccgtttaccgaaaacgtaacgtaccgtacgttaacgtaacgttacgttaaccgaaaggttgggtacccgtaacggtacccgggacgtaacggttaaccgaacgtaggaacgggttaaccgtaagggtacccgttaacggttacggttaaacgttcccgggtaaattggggtaaacgtagggggtaacggtaagggggtaacccgttaacggggtttacggttaccgggttacgggttacggg

SEQ ID NO: 268843 - DNA, 678 bp, Homo sapiens
  misc_feature: GYAE6OF02F2SNJ.28.57.F02.1.454.CMB.1.raw
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
  modified_base (514)..(514): a, c, t, g, unknown or other
  misc_feature (514)..(514): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcgttggtccagccgtggggggtccctgagacctctcgtgtgcagcctctggacttcaccttcgagttacttatcgctatgctagtcgggtccgacgtaggctacggaggggaacggactgggaaattgtacgtctacgtaggttaattagaaagttaaancggacgtaaactaaacattaattaattagtanaacgtaaactggtagaaggaaggacagtacttacaactactcctacgaggtaactaactacgaaacgaacgtacgtacgtagtaacttacttacgaaacgtcgggaacncggtacgtagacgaaggtcgttacggaacggtaacggaccggtacgttagttacgttaacgttacggttggtaacgggaagggtaacgggtaacgggtaacgggtaaggttacgggttaaacgggtacggggtttacgggtacggggtacccgggtaaccgggg

SEQ ID NO: 268844 - DNA, 720 bp, Homo sapiens
  misc_feature: GYAE6OF02GQBH3.28.57.F02.1.454.CMB.1.raw
  modified_base (126)..(126): a, c, t, g, unknown or other
  misc_feature (126)..(126): n is a, c, g, or t
  modified_base (142)..(142): a, c, t, g, unknown or other
  misc_feature (142)..(142): n is a, c, g, or t
tcagagtacgctatcacgaccggtgctcgatttagctcgatatagttgggtcgtgggagaggagcccccgccctgggtttcccaggtgttctcatttggtgatcagcactgcacacaagaagagtnatgacggagtttgggntgagcgtgggttttccttgttgtcttaatttttaaaggtgtcctagtgtgaggtgcagcgtggtggagtcggtgggggaggtcttggttccagtcccggtggggggtccctggagcctctcctgtcggacacgtccgtcgtggtacttccgaactttcgaagttactttattgtcttattccgaggttccggaccgtccgaggctaccgaagggaaggtcgtaggaatacgttcgtctacgtaaggttagttaagtaacgtaaacgttgaacgtaaataaagtaattaacttaattaagttaccgaaacttaaaccgtgttaggtacggtaaggaccaagtacttaacgacttactacgacgttaacggaacgtaacaacgtaaacgaacgtaccgtctaagttactaccttaaacggatacggggaactaaccgccgaaggtagtaaacggctacgggaaaggaacccgtggtaccgttaaagttacttacgtacggtagggacggggtaagggacgtacggacggttaacggttaagggtacggttaagggtgggttacggggacgagggtcccgg

SEQ ID NO: 268845 - DNA, 738 bp, Homo sapiens
  misc_feature: GYAE6OF02HHDZW.28.57.F02.1.454.CMB.1.raw
  modified_base (113)..(113): a, c, t, g, unknown or other
  misc_feature (113)..(113): n is a, c, g, or t
  modified_base (308)..(308): a, c, t, g, unknown or other
  misc_feature (308)..(308): n is a, c, g, or t
  modified_base (418)..(418): a, c, t, g, unknown or other
  misc_feature (418)..(418): n is a, c, g, or t
tcagagtacgctatcacgaccggtgctcgatttagctcgatatagttgggtctgggagaggagcccccgccctgggtttcccaggtgttctcatttggtgatcagcactgcanacagaagagtcatgacggagtttgggctgagctgggttttccttgttgctatttttaaaggtgtccagtgtgaggtgcagctggtcgagtcgtgggggagcttggtccagtccgtgggggtccctggacgactctcctgtgcacgcctctggattcctacttcagtatttatgtctatgacacgttcgggtaccnccgaggtcctaccgaggggaacgggtactagggtaatagtcgttcgtcaaggttagttaagaagtaagttgaacgaaattaacgataagttattaagtcgaataaacctntagtacggaagggctaggtacttacaaccgacttaccgtacccggtaagggaacctaaacgttaacccgaaacgtaaaccgtaaccggtcttaacggttaacttaccgtttaaacgaaacgtttacgggaccaaccggtacccggtaagtacgggtaaacgtcgggttaagaaccgggtaaaccacggggtactttacggtaacgttttacgtttaccgttaagggggtaaccgggaagggtaacggaacgggttaaccgttaaggtttaccggggtaaacggttaaggggtttacgggtaggggacccggtaacggggg

SEQ ID NO: 268846 - DNA, 810 bp, Homo sapiens
  misc_feature: GYAE6OF02FRFTY.28.57.F02.1.454.CMB.1.raw
  modified_base (333)..(333): a, c, t, g, unknown or other
  misc_feature (333)..(333): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagctgggttttccttgttgcttatttttaaaggtgtccagtgtgaggtgcagctggtggagtcgtgggggacgcgttggtccagcccggtggggggtccctggacgtactcctccgttgtcgccacgtcctcgtggtacttccaccgttctagttatttaactggacttagtgacctacgtcgggtcccnccgaggtcctaccggaaggggacggtactagggaattagtgttctagtaaggttactttaaaggaagttaagtcggtaaacgtaaataaactaattaagtttaactttaagtagaaaccttaaaacttccgttaagggttaggtaaacgggtacgtaagttaactttaccccgaacctaacgttccgtaaccggtaaacgggtaaacccttaaacgtttaaacccgaaaacggtaaccctaacggttaccttaagtttaaccgttaccttaaaccggtaaaggttcgggaacctaaccggtaccgtacggaacgaacgttcggtaaacggaccggtaacgtaccggtaccgttagggttactttaacggttaccggtagggtaaggggtacggtaaacgggtacgggtaacggttagggtttaacgggttaaacgggttagggggttacgggtaccgggggttaccggtaaccgggg

SEQ ID NO: 268847 - DNA, 727 bp, Homo sapiens
  misc_feature: GYAE6OF02HEGJA.28.57.F02.1.454.CMB.1.raw
  modified_base (171)..(171): a, c, t, g, unknown or other
  misc_feature (171)..(171): n is a, c, g, or t
  modified_base (349)..(349): a, c, t, g, unknown or other
  misc_feature (349)..(349): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggtttcctgttgctatttttaaggngtccagtgtgaggtgcagctggtggagtcgtgggggagcgttggtccacgccgtggggggtccctggagctctccgtgtcgcgagcctcgtggattccgtaccttgacgttatttatgtcttagtgctacgtcgggtccgacgacggcctccgaaggggtaccggacgtaggaacttntcgtcgtcgtaaggttagtaggtaaagtaatacggacgtaaataacgtaataatttaacgttagtacgtaaccttaaaacgtcgtaaggtaagggtaacgggacagggttaaccttccgaacctacgtttaccggtacccggaaacggggtacttaaaccgttcccaaaacgggaaaccctggttacttagttaaccttactaactaaggggtaccgggactaacgtccggtaagacggttaacgcgttacggaaccggtacgtaccgggtattggttaacgtttccgttaggtagggtaagggaacgtaggggacgtaaccgggttatttacggggtaaccggttagggggttcccgggtagggtacccgtaacggg

SEQ ID NO: 268848 - DNA, 725 bp, Homo sapiens
  misc_feature: GYAE6OF02GP1TN.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcgttggtccagccggttgggggtccctgagactctcctgtgcagcctcgtggacttcaccttctagttatttatcgctagtcgccgtacgttcggggtcccgacccgtaggtcccgttaaccggaaggggtaaacgggtcgtaacgggtaattacgtgttaccgtcgaagggttataaggaattaactgaacgtaaataactaagtaattaactttaagcgtaaccaaaccttcttaaggacgggtaaacgtcgaatacttaccactacgttccacgtaacgggaacctaactaccgaaacgaactcgtactagttacttccgtaacaacggtcggaactcgtaccgtagacgacggtacgtagggaaccgacgtacgtaccgttaagttaccgttaagttaccgttaggggtaacgggtacgggaacgggttaacgggaacggttaaacgggttacggggttaaaacggtttgggggtttaacggggtcgggggtaacccggtaacgggg

SEQ ID NO: 268849 - DNA, 637 bp, Homo sapiens
  misc_feature: GYAE6OF02GOFFT.28.57.F02.1.454.CMB.1.raw
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgagactctcctgtgcagcctcgtggattccaccttcagttatttatgctatgcacgtcgggtcccgcgaggcgtccgaagggaacggacgtaggaattgtgtctgtaggtattaaggaatagtgagaataacattaatattangtactaaactntgtaggacggganagtattaccactactcgtaccgacggaactaacttaccgaaacgtaacgaaccgtattagttaacttcctaacgtaaacggtcgggaccgtacgaccgtacggaagtacgtcgacgaacggaccgaacggacgttagtacgttaagttacggtgggtacgggtaagggacgggagggtaacggtagttaacggggtacgtaaggggtttgggacgggcgggtaacgggg

SEQ ID NO: 268850 - DNA, 798 bp, Homo sapiens
  misc_feature: GYAE6OF02FP3YV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaggtgtccagtgtgaggtgcagctggtggagtcgtgggggagcgttggtccagcccggtggggggtccctgacgacctctccgtgtcggcacgccttcgtggtacttcctaccgttcagtttaattttacgtgtaccttagtcgtaccgtacgttcgggggtccccgccccgtaggggtaccccttaccggaaggggggtaaacggggtaccgttaagggtaaacgttaagtttcgttaccgttacgttaaggtttaagttaaggaaaagtttaacacggtaacggtaaaactaaacttagtttaaagttaactttagtacgtaactaaaaccgtttgtagtaggaacgggcaagtattaccaccgtatcccgtaccgaagggtaccctaaacgttacccaaagaaccgtaccgtacgttagttacctttacttaacgtaaacggtcgggtaccgtaacggtccgtagggaagtacgtcgttaacggaacggacccgttagggtacgtacgttagtttaacttacggttacgggtagggacgggttaaagggacgggttaaccggttaaggtaacgggttaacgggttacgggggttacgggtaccgggggtacgtaaccgggggg

SEQ ID NO: 268851 - DNA, 976 bp, Homo sapiens
  misc_feature: GYAE6OF02GX8ZW.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcagtgacggtagtttgggctgagtcgttgggttttccttgttgtacttaatttttaaaggtcgtcagtgtgtaggtgcagtcgtggtggaggttcggtggggggaggtcgtttggtcccacggtcccggttcggggggggtccccttggacgtacccgttcctcccgttggtcgtcaccgtccgttcgtggttacctttcctaccgtttacgttaggtttaattttagtcgtcttagtcgtaccgtaccgggttccggggtccccgtaccggacgggtaccccgtaccgggaaaggggggtaaacggtaccgggtaaggtaactttacgttcggttacgttacggtaacgggttttaaagttaaacggttaaaacggttaagtaccggtaaactaaaactttaacgttaagtttaaattttaacggttttaacgaccgttaaaccgttaaacctttagggttacggtaaaccggggtaacgggtaacgtaaccggttaaccgtttaacccgaacccttaccgtaccggttaacccggaaacgggttaaaccgtaaacgttaaacccgaaaggtaaacccgtaacggttaccgtttaacgttaacgtttaacccgttaacggtaacgggttaccggtaccgtaaccgggttacgtacgggtaagtaaccgggtcgttaaccggggaacggtaccggtaaccggttcgttaacggtttacgttacggtttacgggtacggggttaagggttaacgggggaaggtttaaccgggggtaactttaacgggggttaacgggttaacggggtttaacggggggttacgggggttaccggggtaccggttaaaccggggg

SEQ ID NO: 268852 - DNA, 774 bp, Homo sapiens
  misc_feature: GYAE6OF02JAOVN.28.57.F02.1.454.CMB.1.raw
  modified_base (202)..(202): a, c, t, g, unknown or other
  misc_feature (202)..(202): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctagagcgttgggttttccttgttgacttaatttttaaaggtgtcctagtgtgaggtgcagngtggtggagtcggtgggggaggtcgttggtccagcccggtggggggtccctggacgtacctccgtcgtgtcgcgtacgtcctcgtaggtacttccacccttacgtaagtttaatttagtacgttcctagtcgtaccgtacggttcggggtcccgaccgtaacgggtcccgtaaccgggaaggggaaccgggtacgttagggtaaacgtttcgtcggttactacggtaacggtttaaagttaaggtaaaacgttaaggtacggaaacgtaaaagttaactaagtttaagtttaactttaagtacgtaaacctaaacgttacggttagggtaacggtaagggtacctaaggttaccttaccgtaactaacgtacccgtacggaaacggtaactaaaccgtaccgtaaaacgaccgtacgttacgttacgttaacttactaacgaaggtaccgacgtacgtactggagacgtagtacgacggtacacgtagtacgttatcgtaggtaggagggtaggacggtaggtaacggtacggttaggaaccggttgggtacgggtcggtacggtaacgggg

SEQ ID NO: 268853 - DNA, 866 bp, Homo sapiens
  misc_feature: GYAE6OF02JGZ13.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaaggtgtccagttgtgaggtgcagcgtggtggacgttcggtggggggaggtcgtttggtcccgacggtccggttcgggggggtccctggacgactccgtccgtgtgccacgtcctcgtggtacttccgtaccttacgtagtttatttacgtcgtacgttagtcgtaccgtacggttccggggtccccgaccggtaccggtcccgtaaccgggaaagggggtaaaccggttaaccggtaaggttaacgttaacgttaccgttacgttaacggttaaggtttaacgttaaagtaaaggttaagtaacggaacgttaaaattaaacgtaattaagtttaagttaagtaacgtaaacgttaaacgttacgttacgggaaggtaacggtaacgttaacgtaacccgtttaccaaacgttacccgtacgtacccgggaaacggtaaacctaaacgtaaacccggaaacgtaaccgtaccgtaccgttagttaccttaccgtaaccgtaaagcccggaacgtcggtaccgtagacgtacggtcgtaaacggacgtaaccgacgggtttacaagtttacgttaacggtttaacggtggggtaagggtaaggtaacggggttacgtaaaccgggggtttaaggttaccgggttaaggggtttacgggggtaccgggttacggggaaccgggttaacccgggg

SEQ ID NO: 268854 - DNA, 796 bp, Homo sapiens
  misc_feature: GYAE6OF02H144Q.28.57.F02.1.454.CMB.1.raw
  modified_base (403)..(403): a, c, t, g, unknown or other
  misc_feature (403)..(403): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgcttatttttaaaggtgtccagtgtgaggtgcagctgggtggagttcggtggggggaggtccgtttcgggtacccgacggtccggttcggggggggttcccccttaggaacggtaccgttcctccccgttggttcgaccgacgtcccttcgttcgggtaactttaccgtaacccgtttacgtaagtttaactttttacgtacgtacttacgtccgtaccttacggttccgggggttacccncccggtaacgggcccgttaccgggaaacgggggaaggggttaacgtagggtaaacgtttaacgttggttaccttaacgtaagggtttaagttaacgggtaaaacgttaagttaccgaacgttaaaataaaccgtaattaagtttattaacgtacgaacctaaacgtgttacggtaaggaacgggtacagtactaccacctacgtcgaccgaaggtacctaactaccgaaacgtacacgtatacgttatctaaacgaaggtcgacgacgtcgtagagacggatacggacgacgtacgacgttagtactacggttacgtagggtacgggaggtaaggtaacggacggttaaggtacgggtaacggtttgggttaccgggacgggttcgaacgggg

SEQ ID NO: 268855 - DNA, 699 bp, Homo sapiens
  misc_feature: GYAE6OF02I81HU.28.57.F02.1.454.CMB.1.raw
  modified_base (329)..(329): a, c, t, g, unknown or other
  misc_feature (329)..(329): n is a, c, g, or t
  modified_base (416)..(416): a, c, t, g, unknown or other
  misc_feature (416)..(416): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgcttaatttttaaaggtgtccagtgtgaggtgcagcgtggtggagtcgtgggggaggtcgttggtccaggccgtggggggtccctggacgtacctctccgtggtcgcacgcctcgtggtacttcaccctttcaagttattttaatgtctatgctacgtcgggtcccnccgaggcctccggaaggggaacgggctaggaattatcgtctacgaaggttattaagaagtaatgaacgaaataaacataattaattntgtaactaactctagtaggaacggcaggttacttaccgacctattccccgacgaacgggtaactaaacgttaccgaaacgtaacgaccgttctagttaccttacgttacgaaagtcgggactacggtcctaaggagtcgacttgggaacgtaccaccgggtattacgttaagtcgtttaacggtgggtaaggggacgtaacggggtaacggtacgggtttaaaggttacgggaaaacgggttttgggggttaccgggttacgggggacccggtaaaccggggg

SEQ ID NO: 268856 - DNA, 623 bp, Homo sapiens
  misc_feature: GYAE6OF02FX0UA.28.57.F02.1.454.CMB.1.raw
  modified_base (271)..(271): a, c, t, g, unknown or other
  misc_feature (271)..(271): n is a, c, g, or t
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
  modified_base (485)..(485): a, c, t, g, unknown or other
  misc_feature (485)..(485): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggtcttgggtccagcccgtggggggtccctggagactcctcctgtgcagcctcgtggtnttcaccttcagttatttatgctatgctacgtgggtccgcgaggcctcgaggggaaggctggaatntgtctcgaggtattagatancgagaatacatatattancataactntgtagacgggnagtactacgacctacttcgtacgagaacgtaacttaccgaaacgtaacacgttctagttacttaccttacgaacgtcggacctacgctgganagtacgaggaagacccggtagtcgttacgtagttacgttacggttagggtagggtaacggacgggtaggtaacgggttaacggttacgggttaaaccggggttgggtttacggggtacggggtacccgggtaacgggg

SEQ ID NO: 268857 - DNA, 655 bp, Homo sapiens
  misc_feature: GYAE6OF02HUIK8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgtcttattttttaaaggtgtccagtgtgaggtgcagctggtggagtcgtgggggaggcgttggtccagccgtggggggtccctgagtactctccgtgtgcagccttcgtggacttccgtaccttcagttatttatgtctatcgcctacgtcggtccgccaggcctccggaagggaacggctagggaactagtgtctacgtaggttattaagaagttagtacgataagtaactatattaattatagtacaaacgttcgtagtacggagggacagtacgttaccactataccgacgaggaactaacttacgaaacgtaacgacgttctacgttacgttaccgttagtaacgtacggtactacgtaccgtagagacgtcgaggtacggacgaccgtgtaacgttagttacgttacggtggttagggacggagggtaacggtaggttaaggttacgggtaacggtttagggttcggggttacgggcggtaaccgggg

SEQ ID NO: 268858 - DNA, 850 bp, Homo sapiens
  misc_feature: GYAE6OF02IYPOG.28.57.F02.1.454.CMB.1.raw
  modified_base (669)..(669): a, c, t, g, unknown or other
  misc_feature (669)..(669): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggtcgttggtccgagccgtgggggggtcccctgagactcctccgtgtgcagcctctggattcaccttcagttatttatgctagtgactacgtcggggtcccgccgacggcctcccggaagggggtaaacgggggaccgttaggggaaattaacgttcggttacctacgtaagggttaaagtttaagggtaaaaggttaaacgttagggtaaccggtaaaaacttaaactaatttaatttaatttattaacgaacctaaaaacgttcgttacgggttaggaaacggggtaccgtaaggttaactttacccgtaacccctaatttccccgttacccgggtaaacgggggtaacccttaaaacgtttaaaccccgaaaaccgaaaacctaacccgggtaccttttacgttaaacctttacgttaaccgtaaaacgtcggggaccgacgtaccgtaacggngtaaacggaccggtaggaaaccgggaccaaacgggtcgttaagttacgttttaaacggtttacggttcggggttaacggggtaagggtaaggggtaacgggtacgggaaagggttttacggggttaaacgggtttaacggggggttacggggtttaccggggggaccggtaacccgggggg

SEQ ID NO: 268859 - DNA, 688 bp, Homo sapiens
  misc_feature: GYAE6OF02H4KIQ.28.57.F02.1.454.CMB.1.raw
  modified_base (182)..(182): a, c, t, g, unknown or other
  misc_feature (182)..(182): n is a, c, g, or t
  modified_base (305)..(305): a, c, t, g, unknown or other
  misc_feature (305)..(305): n is a, c, g, or t
  modified_base (482)..(482): a, c, t, g, unknown or other
  misc_feature (482)..(482): n is a, c, g, or t
  modified_base (492)..(492): a, c, t, g, unknown or other
  misc_feature (492)..(492): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggttttccttgttgcttaagttttttaaaggngtcctagtgtaggaggtgcagctggtggacgtcgtgggggagtcttcggtccaggccgtggggggtcccctagacgcttcctccgtgtgccagtccctgtggtacttcctaccttctaagttntttagcgtacttatcgtcacggttccggggtacccgcccgaggtcctaccgggaaggggaacggtacgttaggaattacgttcgtcgtacgtaaggttaagttaacggtaagtaagcgaacgtaaaataactaatagtttaattagacgtaactaaaccttgtaggtaggacggtanagttctaccncttacgtccctacggaacgtaataacttacaaacgacaccgtcttagtaacctctaaacgtagtcggactcgtacgtagcgacgcgtaggccggactacgtagtactagttacgtaggtgggttacgggaaggtacggtaggtagttaacggtagggttaccggttagggggtttacggcgggaacccggtacggg

SEQ ID NO: 268860 - DNA, 721 bp, Homo sapiens
  misc_feature: GYAE6OF02GNKEM.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtcggggggtccctgagactcctcctggtgcacgccctcgtggtacttccacctttacagttatttatcgtcttagtcgcgtaccggtcggggtaccccgcccgtacgggtacctaccggaagggggtaacggggaccgtagggtaaatagttcgtaccgtacggtaaaggttaagttaagtaaaacgtaagtcggaacgtaaataacgtaattaattattagtaggtaacctaaacttctaggtaggtaacgggactaagtacttaccaccgtatccgtaccgaacgggtacctaacgttacccaaacgtaaccaccgtactagttacttaccttaacgtaagtcggaccacgacgtgaggactcgtagacggaccgtacggattacggtattacgttaacgtggggtagggtacggtaagggaacgggtagttaaacggttacggggttaaacggttcggggggttacgggtacggggtacgggtaccgggg

SEQ ID NO: 268861 - DNA, 743 bp, Homo sapiens
  misc_feature: GYAE6OF02F50RF.28.57.F02.1.454.CMB.1.raw
  modified_base (278)..(278): a, c, t, g, unknown or other
  misc_feature (278)..(278): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcgttggtccagccgtggggggtccctggacgactctctgtgcacgcctctggacttccaccttnagttattatgactatgactacgtcgggtccacgaggctcccggaagggtaagggtacctaggaattagtggtacctcgtaaggttacgttaagaagttaagtacggaaccgttaaagtaaactacgtttaattaagtttacgtaggtaacctaaaaccgttcgtaggtacgggtaaagggtctaacggttacgttaccaacctacgtacccgtacccgtaaagggaaacctaactttacccgaaagtaaaccgtaaccggttactaaggtttacccttaacgttaaacgtaaacgttcgggaacctacggtaccgtaacggtacgacggtacgttaaggaccggtaaccgtaaccggtcgttaagtacttaacgttacggtggtaagggtacgaaagggcgttaacgggttaacggtttcgggtaaacggttaccgggtgggtttaccggggaccgtaacggggg

SEQ ID NO: 268862 - DNA, 918 bp, Homo sapiens
  misc_feature: GYAE6OF02GI6WC.28.57.F02.1.454.CMB.1.raw
tcagagtacgctatcacgaccggtgctcgatttagctcgatatagttggggtctgggagaggagcccccgccctgggtttccccaggtgttctcatttggtgatcagcactgcacacagaacgagtcatgacggagtttgggctgagctgggttttccttgttgctatttttaaaggtgtccagtgtgacggtgcagctggtggagtcgtgggggaggtcgttcggtccaggtcccggttcgggggggttcccctggacgtaccgttccgtcccgtggttcggccgaacggttcccttaccggttagggtactttaccctaacccgttttacgtaaggtttaactttagtcgacttaacgtcggacctaccgttcgggtccccgaccgtacgggtccttaccggaaggggtaacgggtaccgttaagggtaacttagttcgtaccgtacggtaggtttacgttaaggtaagttaacgtaggtaacggtaaacttaaaccgtagtttaatttaacgtttaacgtacgaaacctttaaaccgtcggttacggtaagggaaacggggtctaacggtactttaacccgaaccgtaccgtttccgaaccgggaaacgggttaacctaaacctttaaaccggaaacgtaaccgtacgttaaccgttagggttaacctttaccgtaaacgaacggttccgggaaccctaacggttccgtaaacggtacggtaccggttacgtaccggggaaaccgggtaccgtaaccggttcggttaacgtttaaccgtttacggttaacgggtggggttaaacggggacggttaaaccggggtaccgggttaagggttaacggttttaacgggggtacccgggttttaagggggtttaccggggtaccggggtaaccccggggtaacccggggg

SEQ ID NO: 268863 - DNA, 767 bp, Homo sapiens
  misc_feature: GYAE6OF02JP8YF.28.57.F02.1.454.CMB.1.raw
  modified_base (211)..(211): a, c, t, g, unknown or other
  misc_feature (211)..(211): n is a, c, g, or t
tcagagtacgctatcacgaccggtgctcgatttagctcgatatagttgggtctgggagaggagcccccgccctgggtttcccaggtgttctcatttggtgatcagcactgcacacagagagtcatgacggagtttgggctgagtcgttcgggttttccttgttgcttaagttttaaaggtgtccagtggtgaggtgcgagtcgtggtcggngtcggtgggggagtcgttggtaccgaggccgtcggggggttccctggacgtacgtcctcgtagtcgacgcgtccgtcgttggtacttaccgtacctttacgtaagtttacttttaacgtcgaccttgtcgtactcggttaccgggtcccgaccgacggttccgaccggaagggtacggtacgtagtaagtacgtcgtcctaggttacgtaattaaggtaagtaacgtagtaaccggtaaaacttaatacgttattaacttaacgtacgtacgtaaaacgtttcgtagaaggtaacggtactaagtaacgtcctaactgtacccgtacgaacggtactaaacgaccgtaaacgtacaccggttaacttgttaactcggttaaacaaaggttccggacgttacgacgtaacgtagtacccggtaacgttaacggacggtaaaccgtcgggtagttaaccgtacgttaacgtacggtcgggtaaaggcgggtaaacgtcggaacggtttaacgtacgggttaaccgggtttagggtacgggtaccggacggttaacggg

SEQ ID NO: 268864 - DNA, 1057 bp, Homo sapiens
  misc_feature: GYAE6OF02I85OA.28.57.F02.1.454.CMB.1.raw
  modified_base (195)..(195): a, c, t, g, unknown or other
  misc_feature (195)..(195): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggtttttccttgttgcttattttttaaaggtgtccagtgtgaggtncagcgtgggtgagtcgtgggggagtcgttggtccaggccggtcggggggtccctggagtaccgtccgtccgtggtcgcgacggtccctcgtgggtacttcccgtaccctttctaggttaattttacgtggtacctacgttcggtacgtacccggttcggggttccccgacccggtacgggtcccgttaccggggaacggggggtaaccgggggtaaccgttaaggggtaaatttaccggttcggttaccgttaccgggttaagggtttaaccgtttaaagggtaaaacggtttaaaccggttagggtaaccgttaaaaaactttaaaaccggttaaactttaaaagttttaaactttaaacgttaaccgtaaaccgttaaaaccgtttccggtaaggttaaccggggtaaacgggggtaacctaaacggggttaccgtttaaccccaaaccccgtttaaccgtttcccccgggtaaaccggtaaaccgggtaaaacctttaaaccggttaaaccccgaaaacgggtaaaccccgtaccggtttaccgttaaggttttaaaccctttaacccgttaaacccgggttaaaaacggtccgggttaaccggtaaacccggttaccgggtaacgggaaaccgggttcgggtaaccccggttacggggaaaccgggttaaccccggttaacggggtaccgtttaacgggttttaaaccgttaccggttttaaccgggttcgggggtaaacggggggtaacggttaacggggggtaaccggttaacggggttaacgggtttaaggggttaaacccggggttttgggggtttacggggggtaacccggggtacggggttaaccccggggg

SEQ ID NO: 268865 - DNA, 713 bp, Homo sapiens
  misc_feature: GYAE6OF02HVVRK.28.57.F02.1.454.CMB.1.raw
  modified_base (416)..(416): a, c, t, g, unknown or other
  misc_feature (416)..(416): n is a, c, g, or t
  modified_base (532)..(532): a, c, t, g, unknown or other
  misc_feature (532)..(532): n is a, c, g, or t
tcagagtacgctatcacgaccggtgctcgatttagctcgatatagttgggtctgggagaggagccccgccctgggtttcccaggtgttctcatttggtgatcagcactgcacacacgaagagtcatgacggagtttgggctgagctgggttttccttgttgcttattttaaaggtgtccagtgtgaggtgcagctggtgagtcgtgggggagcgttaggtccagtccgtggggggtccctgacgactctcctgtgcagtcctcgtggattccactttcagttactttagtcgtctatcgacgtacgtcggtaccgacccgtaggtcccttaccggaggggtaacgggacctaggaacttaacgttgtaccgtacgaaggttaacgtaagtaaacgttaagtgtacgtaaacgtaanaacgtttaacgtaaagtttacgtacgtaacctaaaaccgttcttaaggtcggaaagggtactaacgtacgttaccacgttaactcgtacccgaaggtacctagtaccaaaggtacncggtactagtacctctagaaggtcgacaggtacaggtaacgcgtcgacgtacggaaacgtacgtacgttacgtacttacggtttaacgtggggttaaccggagggtaacggtaccgggacgtttaaacggttagggaaccgggttttaacgggggtgtaaccgggggtaccccgtaagggg

SEQ ID NO: 268866 - DNA, 748 bp, Homo sapiens
  misc_feature: GYAE6OF02F7MZO.28.57.F02.1.454.CMB.1.raw
  modified_base (318)..(318): a, c, t, g, unknown or other
  misc_feature (318)..(318): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgctattttaaaggtgtccagtgtgaggtgcagctggtggagtcgtgggggaggcgttggtccaggccgtcgggggggtcccccgagactctccctgtcgcaggccctcgtggattccaccttcagttaatttatgtactatcgcaccgtgggtcccnccgaggcccgtaccgaggggaacgggactagggaactagtcgtactacgaaggttaattaagaaaggtaatcggaacgtaaaataaagtaataattaagtttactacggaactaaaaccgttgtacggtagggaacggtacaaggtactcaacccgtatacccgtaccggaacggaaacctaacttaaccgaaacaaccgtaccgtattacgtaaccttacttaaccgtaaaggtccgggtaacacgggtaccttacggaggtaacgcgtaaggaccggaacgtacggacgttaagttaacttacggttacgttaggggtgggtaaacgggtaacgggtaacgggttaacgggttaaaccggttaggggttaaccggggttaggggtttaccgggggtaaccgggggaacgggtacccggggaacccggg

SEQ ID NO: 268867 - DNA, 689 bp, Homo sapiens
  misc_feature: GYAE6OF02JXW16.28.57.F02.1.454.CMB.1.raw
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (280)..(280): a, c, t, g, unknown or other
  misc_feature (280)..(280): n is a, c, g, or t
  modified_base (465)..(465): a, c, t, g, unknown or other
  misc_feature (465)..(465): n is a, c, g, or t
  modified_base (530)..(530): a, c, t, g, unknown or other
  misc_feature (530)..(530): n is a, c, g, or t
  modified_base (562)..(562): a, c, t, g, unknown or other
  misc_feature (562)..(562): n is a, c, g, or t
  modified_base (572)..(572): a, c, t, g, unknown or other
  misc_feature (572)..(572): n is a, c, g, or t
  modified_base (592)..(592): a, c, t, g, unknown or other
  misc_feature (592)..(592): n is a, c, g, or t
tcagagtacgctatcacgaccggtgctcgatttagctcgatatagttgggtctgggagaggagccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggagcttggtccagccgtgggggtccnganactctccgtgtcgcagcctcgtggattcaccttcagttattacncgtctaagtcgcgtacgtgggtccgacgacggcctaccgaggggaaacgggcttagggaaacttgtcggttacctaggaaggtttaacgtaacggtaaagttaacgtcggaacgtaaacttaaccgtaattaacgtttagtttaacgagtaacctaaaacgttcgtaggtaacgggtaacgggtntaacggtactttacccaacgtaaccttccggtacgagggtaaccttaacgtaccgaaagtaaccncgttacgtagtactcttaacgaaggtcggacncgtatcgaancggactagacggaccaggtntacgtagttcgtaacggtggtaaggacggtaacggacggttacggtaaacgttaacgggacgggtttaggggtcggttacggggaccggttaacggg

SEQ ID NO: 268868 - DNA, 683 bp, Homo sapiens
  misc_feature: GYAE6OF02IKNV7.28.57.F02.1.454.CMB.1.raw
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
  modified_base (372)..(372): a, c, t, g, unknown or other
  misc_feature (372)..(372): n is a, c, g, or t
  modified_base (422)..(422): a, c, t, g, unknown or other
  misc_feature (422)..(422): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaggtgtccagtgtgaggtgcagctggtggagtcgtgggggagtcttggtccaggccgtcggggggtccctggacgacctctcctgtgcacgcctcgtggattcaccgttcagttactttangtctatgctacgtcgggtccncgacggcctacggagggacggtacgtaggtatagtgtactgtaggttatagaagtaagngacgaataacgattatattagcgactaacgttcgtaggtaaggacgggtnaagtcttaccaactacgtaccgttaccgacgggtaactaacgtaccgaaacgtaaccgacgttctacgttaactccgtttaaagaacgttgggacctacggaccttggaacgtacggcggttaacgaagggtaccgtaccggtatttacggtagtttacgttacgggttgggtaacgggaggggtaacgggcggttaagggttaacggttagggttaaccgggtttaggggttcggggttacggggacccgggtaacgggg

SEQ ID NO: 268869 - DNA, 591 bp, Homo sapiens
  misc_feature: GYAE6OF02FKSP5.28.57.F02.1.454.CMB.1.raw
  modified_base (365)..(365): a, c, t, g, unknown or other
  misc_feature (365)..(365): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgagctgggttttccttgttgcttatttttaaaggtgtccagtgtgaggtgcagctggtggagtcgtgggggaggcttgggtcccaggcccgtggggggtccctgagactctcctgtgcacgcctctggattccacctttcaagttatttatgctatgcacgtgggtcccgcgtacggctccgagggaaggcgtaggaatgtgtctcgaggtaatagaataangagaataacataatattatgactaaactctagtagaagggcagtattacactcgactccgaaggtaacaacttaccgaaagaccacgtctatcttactaacgaatggcagtccgtgagtgacgtagacgacgacgtcctagttatacgttacgttggagggtacggaggtaggtaccggtaagtttagggaaggttacggggtttgggtcggggacggtaccgggg

SEQ ID NO: 268870 - DNA, 811 bp, Homo sapiens
  misc_feature: GYAE6OF02I3L5E.28.57.F02.1.454.CMB.1.raw
  modified_base (179)..(179): a, c, t, g, unknown or other
  misc_feature (179)..(179): n is a, c, g, or t
tcagagtacgctatcacgaccggtgctcgatttagctcgatatagttgggtctgggagaggagcccccgcccctgggtttcccaggtgttctctatttggtgatcagcactgcacacagaagagtcatgacggtagtttgggctgagcttgggtttccttgttgcttattttaaaggtntcagtgtgaggtgcagtcgtggtggtagtcgtgggggagcgttggtccaggccggtcggggggtccctgagacttcctccgtgtcgcacgtcctacgtagtacttccgtaaacctttcgtaacgtttaacttttagtacgtaccttagttacggtacctaaccgggttcgggtacccgaccgtacggtaccgtacgggaaggggtaacgggtacgtaacggtaatacgtcgttacgtaggtaacttaagtaaagaaacgtacgtagaaacgtaaactaaacgtattaattacgttaatacgtaaactaaaacgttcgttaaggtaggaaaccggtagtaacgttaacctaaccaacctacgttaacccgaacgtaaaccggtaaacgtaaactaaaccggaaacaacccgtacgttaacgttacttaaacgttacgaaacccgtaaggacggtaaccgaacgttccggtaaaggtcgtaacgaagggaccgtaacgggaaccgttaaggtacctttaagtacgtttagtaacggggtacgggttaagggaaacggtcgggtaaagggttacggtaaagggtttaccgggtaaaggggttacgggtacggggtaccggtaacggttaccgggg

SEQ ID NO: 268871 - DNA, 743 bp, Homo sapiens
  misc_feature: GYAE6OF02G0DC2.28.57.F02.1.454.CMB.1.raw
  modified_base (192)..(192): a, c, t, g, unknown or other
  misc_feature (192)..(192): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttaatttttaaaggtgtccagtgtgaggtncagctggtggagtcgtgggggagtcgttggtcccaggccggtggggggttccctggagtacctctcctgtacgcacgcctcgtggtactttccgacctttcagttattttactgtccttatcgaccacgttcgggtcccgaccgacggtccgtaccggtaaggggaacgggtacgtaggtaagtatcgttactacgtaaggtttaattaagtaacgtaagtacgacgtaaattaaacgtaatttaattaattagacgtaacgtaaacttcgtaggttaacggaacgggtacgtaacgtactacctactaacgttccgtaacgaacgggtaactaaccgtaccaaagaacccgacgtccttagttaacttacgttaacgtaacgtcgggtacacggtcctaggaacgacgttacgaggaaaccgtaccggtaaccgtcgttaactagtttacgttacggtgggttacgggagggtaaacgggacggttaacggtaaggtttacgggtaaacgggtttaagggttcggggttaccggggacggtaaccggggg

SEQ ID NO: 268872 - DNA, 1038 bp, Homo sapiens
  misc_feature: GYAE6OF02ID5QD.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgcttatttttaaaggtgtcagtgtgaggtgcagcttgggtggagtcggtgggggagtcgttcgggtccgaggtccgttcgggggggtcccctagacgtaccttcctccgtgtcggccgtacgccccttcgtgggttaccttccttacccgtttacgtaacgtttaattttacgtagttccttaaagttcggtacctaaccgggtttcccggggtaccccgtaccccggtaaccggggtccccgttaaccggggaaacggggggtaaaaccgggttaccggttaaacgggtaattttacggttaccgggttccgttaaccggttaaacgggttaagttttaaaacggtaaaggttaaacgttacggaaccgttaaaagtaaaccgtaaattaaacgtttaattttaacggtaccgtaaaacgttaaaaccccgttggttaagggtaaccgggtaacggggtacttaaaccggttaccttaaaccccgtaacccttaacccgttccggtaaacccgggtaaacggttaaccgttaaacccgttaacccgaaaacggtaaccgtaaacccggttaccgttttacggtaaaccttttacccgttaaacgttaaaccgggtcgggaaccgttaccgggtaaccgtcgggtaacggtaccggttaccggtaaacggggtaaacccgacccggttaaagggtacccggttttaagtttaccccgtttaaaggttttaccggggttcgggaacgggggtaacggtaaaggggtttacccgggttaaagggtttacggggtttaaccggggtttaaaccggggttttaacccggggggtttaacggggggttacccccggggtaagggggtttaacccccggggg

SEQ ID NO: 268873 - DNA, 834 bp, Homo sapiens
  misc_feature: GYAE6OF02FRFRU.28.57.F02.1.454.CMB.1.raw
  modified_base (330)..(330): a, c, t, g, unknown or other
  misc_feature (330)..(330): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcttgggttttccttgttgcttatttttaaaggtgtccagtgtgaggtgcagctgggtggagtcgtgggggaggtcgttgggtccgagtcccggtggggggtcccctggagtacctctcctgtcgcacgcctcgtggtattcctaccttcagttatttatgcttagtgacgtacggtcgggtcccncgacggccgttaccggaagggggaacggggtaccgtaaggggtaaacttagtcgttaccgttacggtaaggttaagtttaaaggtaaagttaaagtggaaaccgtaaactaaacttaattaactttaaagtttacgtacgtaaaccgtaaaccgttcgttaagggtaagggaaacgggactaacggttacttaacccgtacctacgttcccgtaaccggtaaacgggaacctaaacgttaacccgaacgtaaacctaccgttacttaggttaacctttacgttaaacgtaaaggtcgggaacgtccggaaccgttacgggaagtacgggtaccgtaagggtacccggtaacggtaaccgggtacgttaacggtttaacgtagtttacgggtaaggggttaccgggggaaagggtacgggtaaccggtaacggggttaacggttacggggttaaaggggtttaccggggttaaggggttcccggggggaaccgttaaccgggggg

SEQ ID NO: 268874 - DNA, 734 bp, Homo sapiens
  misc_feature: GYAE6OF02FW677.28.57.F02.1.454.CMB.1.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacgggagtttgggctgagcttgggttttccttgttgcttagtttttaaaggtgtccagtgtggaggtgcagctggtggagtcgtggggggagtcgttggtccaggcccggttggggggtcccctggacgacctctccgtgtgcacgtccttcgnggtattaccnccttactagttatttattgtactagtacgcctacggttccgggtccccgtacgacggtcccgtaccgggaaggggaaacgggtcggtagggtaaattagtcgtaccgtacggtaaggtttaagtttaaggaaacgttagacggtaaacgaattaaacgtaattattaaagttatacgactaaacttgtaaggtaggaaggtacagtacttaccaccgttactaccgtacgtaaacggaaaccttaacgttaaccgaaaggtaacctacgttacttacgttacgtaccttaacaacggttgaccgtacggcgtaggaggtacgcgtaacggaacgaacggtaccgtcgttaagtacctttagtaacggtagggtacgggaggtacgggaggtaaggttagttagggtaacggtttggggtacgggtacgggtaggtaaccggg

SEQ ID NO: 268875 - DNA, 709 bp, Homo sapiens
  misc_feature: GYAE6OF02HFNSN.28.57.F02.1.454.CMB.1.raw
  modified_base (202)..(202): a, c, t, g, unknown or other
  misc_feature (202)..(202): n is a, c, g, or t
  modified_base (445)..(445): a, c, t, g, unknown or other
  misc_feature (445)..(445): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgaggcttgggttttccttgttgcttatttttaaaggtgtccagtgtgaggtgcagctgggnggaggtcgtgggggagcgttggtccagccgtggggggtccctgagctctcctgtgcagcctcgtggacttccaccttctaagttatttatgctatgctactcggggtcccgccgacggcctaccggaggggacgggtactgggaatacgtcgttactcggtaagttaagttagaagttaagtgacgtaaactaacattaatttaagtagtacgaacttaaactcgtaaggtaaggtaacgggngtaacgtaattcccgaacttacctaccgtaccgaaacgggttaccaaacgtttaaccaaacgtaaacctaccggtacgtacgttaacttccgttaactaacggtacgggtaccacggtacgttacgagtaacggtacgtagggacgaccggaccggttctaagttacgttattaccgggtgggtaggggtacggaagggacggtaacgggttaagttaccggggtaaggttagggggtcgggttaccgggggaggtaaccgggg

SEQ ID NO: 268876 - DNA, 726 bp, Homo sapiens
  misc_feature: GYAE6OF02JOG0N.28.57.F02.1.454.CMB.1.raw
  modified_base (208)..(208): a, c, t, g, unknown or other
  misc_feature (208)..(208): n is a, c, g, or t
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (317)..(317): a, c, t, g, unknown or other
  misc_feature (317)..(317): n is a, c, g, or t
tcagagtacgctatcacgaccggtgctcgatttagctcgatatagttgggtcgtgggagaggagccccgcctgggttcccaggtgttctcattggtgatcagcactgcacacagaagagtcatgacggagttgggctgagcgtgggtttccttgttgctagttttaaggtgtccagtgtgaggtgcagctggtaggagtcgtgggggngcttgggccagccgtggggggtccctgacgactcgtccgtgtcgcagtcctntggactttcacccttnaggttattttagcgtctagtcggactacgtcggggtacccncgacggtcctacggaacgggtaacggtacgaaggtaacgttacgtcgtacgtacgaaggttaacgtaacggtaaacgttagtacggtaaactaaacgtaacgtaattaacgttaattaacgtacgtaacgtaacgtcgtaaggtacggtaacggactaagtaactaccaactacgtaccgtaccgtaaggtaactaaccgtacgtaacgaaccgagttactagttaccttacgtaacgaacggtaccggacgtacgtaccgtaggaacgtcggtaacgtacggaaccggacgtaccggtacgtaagttacgttacgttaacggtagggtaacgggtacggaacggtaccggtagggtaacggttacggggtaaggttaccggggttacgggtccgggtaccggtaaggg

SEQ ID NO: 268877 - DNA, 820 bp, Homo sapiens
  misc_feature: GYAE6OF02G14VY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctggagtcgtttgggtttttccttggttgtactttaagttttttaaagggtcgtcctaggttggtggtagggtgcgtagtcgttgggtggtacgttcgggtggggggtacgttcgttcggtcccgacggtcccgggttcgggggggttccctaggtacgtaccttccgttccgtggtcgcctacgtcctcgtcggtactttcctacccttagtaacgtttatttaacgtgtaccttagtcgaccgtacggtccggggtaccccgcgtacgggtcctaccgggaaggggtaaacgggtacgtaaggaactttagttcgtacgtacgtaagggttaacgttaaggtaaacgtagtacggaaacgaaattaaacgtattaatttaattaagtactaacgtaaacttcgttagggtaacgggacggtaactagttacccgtaccgactaacggttacccgacggaacggttaaactaaccggtaacgaaactccgtatcgttacgttaacttacgtaacgtaggtcgacgtacgtaccgaggtagaccgtacgtacgggaacggttacgtacggacgtttaagtaccttggttacggtcgggtaaggtacggaagggttacggtaacggttaggttaaccgggttagggttacggggtcgggtacgggaccggtaaccggggg

SEQ ID NO: 268878 - DNA, 689 bp, Homo sapiens
  misc_feature: GYAE6OF02IO8W5.28.57.F02.1.454.CMB.1.raw
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagtcttggtccagccgtcggggggtccctggacgacctctcctagtcgcagtcctcgtggacttcctaccttgtaagttactttagtgtcctatgacctagttcgggtacccgtaccagggcctaccggtaggggaacgggtacctgggtaaactgtcgtcctacgtaggtaacttaagaaagtaatggacgtaaactaactagtacttatatcgaactaaactntaggngaacgggcaggtacttaccgactactccgtaccgtaacggaactaccgttaaccgaacgtaaacccagtccggtagttaactactaaacgtaaggcgggttacacgtcgtacggagtacggtcgtaacgggaacgtaacccggcgtacgttagtacgttagttacggtgggtacggaagggtacggtaggtacggttaagttcgggtaaccggtttaggggtaccgggtacggggccggtaaccgggg

SEQ ID NO: 268879 - DNA, 835 bp, Homo sapiens
  misc_feature: GYAE6OF02I4ZQS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccgagtgtgaggtgcagcgtggtggagtcgtgggggaggtcgttggtccaggccggtcggggggtccctggacgacctcctccgtgttcacgtcctcgtggtactttccaccttcagttattttaagtcgtacttagtgacctacgttcgggtcccgaccgtaaggccgtacccgaagggggtaacggacgtagggtaaattaagtcgtctacgtaggttaattaaggtaaacgtaagtggaacgtaaaataaacttaagttaaattaagtttaacgtacgaaacttaaaccgttacgtaggtaaaccggaaaggggtcctaaaggttaacttaacccgtaaacccgtaactaccgttaacccggtaaagggtaaccttaaacgttaaccaaaacgaaaccgtaccgtacgttaaggttactttaaccgttaacgtaaacgtaccgggacgtaacgtaccgttaaggaacgtaacgtcgttaacgggaacggaaccgtaccgggtacttagttaaagttaccgttttaacggtaggggttaacgggtaacgggtaagggttaaccggggaacggtttaaagggttaacgggtaaaccgggggtttaaagggggttcgggttaaccggggggaccgtacgggggttaaaccccggg

SEQ ID NO: 268880 - DNA, 712 bp, Homo sapiens
  misc_feature: GYAE6OF02FWRC2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctggagactctcctgtgcagcctctggtattccaccttcgagttatttaatgtactatgactacgtcggggtccgaccgacggcctaccggaaggggacggacgtaggaatagtcgtactactaagggttaattaaggaagtaagtacgaacgtaaagtaaacaattaagttaattagtacgaaacgtaaaccttcgtacggtaggaacgggctaacgtacttacaccgtataccgtaccgtaaggaacctaaacgtaacccgaaacgaacgtaaccggtacgtagttaacttaccgtaacgtaacggtacggtacgtacgtaccgacgtaaggcgtacgtacggaacggacgtaccgttacgtagtttacgtacgttacggttgggaacgggtagggtaacgggtacggttacgggtaacggttacgggttaaacgggttggggttacgggtacggggtaccgggtaacgggg

SEQ ID NO: 268881 - DNA, 759 bp, Homo sapiens
  misc_feature: GYAE6OF02GT0WW.28.57.F02.1.454.CMB.1.raw
  modified_base (190)..(190): a, c, t, g, unknown or other
  misc_feature (190)..(190): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtagctattttaagtgtccagtgtgaggtgcagtntaggtggagtcgtggggggagcgtttggccagtccggtcgggggtccctgacgctctcgtgncganctcgtgattccacttcagtattatgcttagtgactacgtcggtccgacgaggactaccgaaggggaccggataggtaattagcggttcctagtaggttaattaacggaaagtagtacggaactaaaattaagtaaattacggtttaattaggaacttaagaaaaccttgacgggtttaagaaccgggtactaaagtaacttaccgaaccttactaacccgtaacggtaaccgtaactaaacgttaaaaccgaacggttaaacccgaaggtaccttacgttaacgttaaccgtttaacgaaacgggttacggacggtaccgtaacccgttgtaccgggacggttacgaggttaaccggacgtaacgtacgtacggttaacttaggttacgtaacggggtagggttaaaccggtaacggggtaggtaacccgggttaaagggtttacggggttaaaccggtttaacgggggtttaccgggacgggtaacccggggttaacccggg

SEQ ID NO: 268882 - DNA, 834 bp, Homo sapiens
  misc_feature: GYAE6OF02G2GT8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagtcgttgggtttttccttgttgtcttaagttttttaaaggtgtccagttgtgaggtgcagcgtgggtggagttcggtggggggtaggtcgttggtcccgaggtcccggtcgggggggttcccctaggacgtacctccgttccgtggttcgacgtacggtccccgttcgtcggtaacctttccgttaaccctttacgaacgttttattttaacgcggtaccttagtcgtacgtacgttccggggtacccgaccggacggtccgtacccggaaacggggaacgggtaaccgtagggtaaacttaagtcggttacctacggtaagggtttaaacgttaacggtaaaactttaaaggtacggtaaaccgtaaaatttaaactaattaaacttttaagttaacgtacggtaaacccttaaaacggttcgtagggttaagggaaaccgggtactaacgggttaacctaaccgtaacccttacgtacccggtaacccgtaaagggtaacctaaacggttaacccaaaacggtaacccgacgttaacgttaacgttaacttacgttaaacgaaggttcgggactaacgcgtaagacgtagactaggacgaccgtgtactagttactagttcgtagggagtacggaacgtggtaaccgaggttacgggaaggttagggtcggtcgggacggtaccggg

SEQ ID NO: 268883 - DNA, 714 bp, Homo sapiens
  misc_feature: GYAE6OF02JBIKI.28.57.F02.1.454.CMB.1.raw
  modified_base (174)..(174): a, c, t, g, unknown or other
  misc_feature (174)..(174): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctatttttaaaggngtccagtgtgaggtgcagctgggtggagtcgtggggggagtcttcgggtccaggcccggtcgggggggtcccctgacgtacctctccgtgtcgcacgcctgtggtattcctaccttcagttatttatgtcctagttcacgtcgtcgggtcccgcgtaggccctacggaggggaacgggaccgttaggaaattgtacgtctacgtacggttaagttaagaaagtaagtgaacgtaaagtaaactataagttaattagacgaacgtaaattcgtaggtacggaagggctaagtcttaccgactacgtcgaccggacggtaactaaccgttaccgaaagaacctcgtaccttagttaacttaccttaacgtaacgggtcgggacctacggtaccttaggaagccggtacgtaggacccggtaagaccggttagttaacgttacttaacggttacgtaggggtacggaagggtaggtacggtacggttaacggttagggtaacccggttgggggttaccgggtaccggggtagggtaaccgggg

SEQ ID NO: 268884 - DNA, 854 bp, Homo sapiens
  misc_feature: GYAE6OF02IJO6M.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtctgggtttttccttgttgcttaattttttaaaggtgtccaggtgtgaggtgcagctggtggagttcgtgggggagtcgttggtccagtccggttggggggtcccctgacggaccttcctccgttgtcgccgagtcccttcgtaggtacctttccctaacccgtttcgtaaaggtttatttttaacgcggtaccttagttcgaccgtaaccggttcggggttccccgaccccggtacgggtcccgttaaccccgggaagggggggtaaacggggtaccggttagggtaaagtttagttcgttacccgttaagtaaggggtttaattaaacggttaaacggtaaatcggtaaactaaagttaaactacgttaattaaatttacgaacgtaaacctaaacttccgttagggtaaggaacgggtactaacggtactttacccgaacccgtatacccgtaacgaacgggtaaactaaccgtaaaccgtaaacaaaccgtccgttaacttagttaacttccttaaacgaaggttccgggaccaacgtcggtgtaacgacgtacgttacgggaacggtacgaaccgggtactttaggtacgtttaaccgtttagggcggggtaagggacgggtaacgggtaggaaccggggtttagttaacggggttaacggggttttacgggggtcggttaccggggggacccggtaacgggggg

SEQ ID NO: 268885 - DNA, 1005 bp, Homo sapiens
  misc_feature: GYAE6OF02H85EJ.28.57.F02.1.454.CMB.1.raw
  modified_base (132)..(132): a, c, t, g, unknown or other
  misc_feature (132)..(132): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggngtttgggctgagcgttgggttttccttgttgcttatttttaaaggtgtcctagtgtgaggtgcagcgtggtggacgttcggtgggggaggtccgttggtcccgacggccggttcgggggggtcccctaggacgtaccttccgtcccgtagtggcctacggtcccttccgtaggggttatttacccctaacccttttacgaaagtttacgtttttaattcggtaccttaagttcgacctaaccgggttcggggtacccgaccccgacggtccgtacccggggtaaaggggaaaccggtaaccgttaggtaaacgttaacgttcgttacccgtaacggtttaagggttaattaaaaggtaaaaccggttaagtacggtaacgtaaaaactaaacgttaagttaagtttaaacgtttaaggtactaaccgttaaaaccttcggttacggttaacgggtaaacggggttaacgtaacggttaactttactaaacccctaacgttacccgttaaaccggaaaccggggttaaaacctaaaccgttaaccccgtaaaacggtaaaacccgtaaccgggttaaccgttttaacggttaacctttaaacccgttacgttaaaaccgggttacggggtaccgtaacccggttacccgggttaagggaaaccgggttaccggttaccggttaccgggtaaacgggtacccggaaaacgggtttcccggttaagtttaacggtttaacggttttaacgggttaacgggggtaacgggtaaagggggtaaacggtaacggggtaacgggtttaacgggttaacggggtaacggggttttaacggggggttacgggtttacccgggggggaaggttaacccggggg

SEQ ID NO: 268886 - DNA, 813 bp, Homo sapiens
  misc_feature: GYAE6OF02I907Q.28.57.F02.1.454.CMB.1.raw
  modified_base (643)..(643): a, c, t, g, unknown or other
  misc_feature (643)..(643): n is a, c, g, or t
  modified_base (696)..(696): a, c, t, g, unknown or other
  misc_feature (696)..(696): n is a, c, g, or t
  modified_base (720)..(720): a, c, t, g, unknown or other
  misc_feature (720)..(720): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggtagtttgggctgagtcgttgggtttttccttgttgcttaagtttttaaaggtgtccagttgtggaggtgcagtcgtgggtggacgttcggtgggggtacggtcgtttcggtacccgtacggtcccgggttccggggggttcccctaggtaccgtacccttccgttcccggtggtcgaccgtaccgtcccttcgtacggtacttccctacccttcgtaagtttatttagtcggtacttacgtcgtactaccggttcgggttacccgaccgtaccgggtacccgttccgggaaggggtaacgggtccgtaaggtaacgttagtcgttaccgtacgtaggtttaaagtaacgtaagttagtacgtaaacgtaaactaaacgttattaacgtttaagttacgtaaccgtaacgttaaacgttccgtaggtaacggaacgggtctaaggtttacctacccgtacctaacggtaccgtaaccggaaccggtaataaacccgttaaccaacgtaaccncgttactcttaaccttcgttaaacgagtcggaacctcgtacggtacgcggtanaggtggaaacccggcttacgggtntttaaggtaccttaaggtcgggaggtaaccgggagtagggtacgtagggtttaacggacggttagggtcgggtacggtcgggcggtaaccggg

SEQ ID NO: 268887 - DNA, 822 bp, Homo sapiens
  misc_feature: GYAE6OF02IOBM3.28.57.F02.1.454.CMB.1.raw
  modified_base (182)..(182): a, c, t, g, unknown or other
  misc_feature (182)..(182): n is a, c, g, or t
  modified_base (337)..(337): a, c, t, g, unknown or other
  misc_feature (337)..(337): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgtgggtttttccttgttgcttaagttttttaaggntccagtgtgaggtgcagtcgtgggtgagttcggtggggggagtcttcgggtccaggtccgtcgggggttcccctggtacgtaccttccgtcccgttgtgaccgtacgtccgttcgtggtacctttcctaccgtttcgtaacgtttattttaacgngtaccttagtacgcctacgggtcgggtcccgtcgacggtccgtaccggaagggggacgtacgtaggttaaatcgttcgttaccgtacgttaaggttagttaacggtaaagttaagtacggaacgtaaaacgttaactaattaagttagttaagaacgtaacctaaacttcgtaacggttacgggaacgggacttaagtaaccgtttaccaacctacgttaaccccgacggtaaacggttaaccttaaacgtaaccaaacggtaaccgtaacggttacgtttaacgttaaccgttaaccggttaaataaccgggtacgttaccgaaccggttccgtaagggcttaccgggagtaccggtaacggtacgaccgggttagttacgttacgtttaaccggttgtaacggggtaaggagggacggaaggggttaccgttaagggtaacggttgggttaacccgggggttgtcccggggaacggtacgggg

SEQ ID NO: 268888 - DNA, 773 bp, Homo sapiens
  misc_feature: GYAE6OF02INP8T.28.57.F02.1.454.CMB.1.raw
  modified_base (581)..(581): a, c, t, g, unknown or other
  misc_feature (581)..(581): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggttttccttgttgcttaagtttttaaaggtgtccgagtgtgaggtgcagcgtggtggagtcgtgggggagtcgttcggtccaggccggtcgggggtccctggacgtacctctccgtgtcgcacgcctcgtggtacttcctaccttctagttatttatcgtactagtcgctaccggtcgggtcccgaccgtacggtccgtaccggaaggggtaacggtacgtaggtaacgttgttacgtacgttacggtaaggttaagttaaggtaacgtaagtacgtaaacgtaaacttaaacgtaattaatttattacgtaacggtaaccttaacgttacgttagggtaacggtaacgggtactaacgttaacgttaccctaaaccgttccgtaccgtaaccggaaacggtaactaaccgttaaacccgaaagtaaccncggttaacttacggttaacttaccgttaaagtaacggtcggactacgacgtagacgtacgcgtaagggacgcggtaaccgttattactacgttattagggtacgggtaaggacggtaagggtacggttaaggttaacggttaacggggttaccggttaagggggtcgggtacccggggtaagggtacccggg

SEQ ID NO: 268889 - DNA, 760 bp, Homo sapiens
  misc_feature: GYAE6OF02JLLVV.28.57.F02.1.454.CMB.1.raw
  modified_base (619)..(619): a, c, t, g, unknown or other
  misc_feature (619)..(619): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagcgtgggttttccttgttgcttagtttttaaaggtcgtccagtgtgtaggtgcgagcgtggtggacgtcggtgggggagtcgttacggtccgaggccggtcggggggttccctaggagtccgtccgtccgtggttcgacctacgtccgttcgtacggtacttcctaccgttagagtttactttagtcgtcgtacgtcgcgtacgtccggtaccgacccgaggtccgaccggtaagggtaacggcgtagtaacgtagtacgttactacgaaggttaacttaacgaagttacgtgaaccgtaaagtaactaacttaaagtacttaacgacgtaaaccgtaaacgttcggtaggtaacggaccggtaacgaacggtttaccttacccaccgtacgttacccggtaacgaaggtaacctaaacgtaccgaaacgtacccgacttcgtaacgtttacgaaccttaagaacgttcggaacncgggtctacgggtctaggccgttagaccgacggtacgtacttcggtagtttaccgtcggtaagggtaccgaagggtccgaacggtttaccggtaagttcggggtaaacccgtttggggtaaccggtcggaccgtaacgggg

SEQ ID NO: 268890 - DNA, 858 bp, Homo sapiens
  misc_feature: GYAE6OF02GX7MK.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctagagctgggttttccttgttgctatttttaaaggtgtccagtgtgaggtgcagctgggtggagtcgtgggggaggcttggtccagccgtggggggtccctgagactctcctgtgcagcctctggtattccacctttcgtaagttattttatcgtacttagtcgcgtaccgtcggggtcccgccgaacggtcccgtaccggaaggggggtaaacgggtaccgtagggtaaacttacgttcggttaccgtacggtaaggtttaagtttaaacggtaaaagttaaagtacggtaaacgtaaaattaaaacgtaattaaatttaagtttaagtacgtaaacctaaaactttcggttagggtaaagggtaaacggggtacctaaagggtaccctttaccgaaacccttacgttaccccggtaacccggtaaaggggtaaacccttaaaccgtttaaacccggaaaacggtaaacccgtacggttacccgtttaagtttaacccttaaccgtttaaccgaaaggttccgggaaccgtaccggtaaccgtagggaacggtacgtacggttagggaaaccggacccgtacgggtacttacggttaactttaagtttaccgggtaggggtaacgggtaaggtaaggggtaaccggtacgggttaaggttacgggggttaaccgggtttaggggtttacgggggtaccggggtccggtaaccggggg

SEQ ID NO: 268891 - DNA, 763 bp, Homo sapiens
  misc_feature: GYAE6OF02IGCEZ.28.57.F02.1.454.CMB.1.raw
  modified_base (171)..(171): a, c, t, g, unknown or other
  misc_feature (171)..(171): n is a, c, g, or t
  modified_base (208)..(208): a, c, t, g, unknown or other
  misc_feature (208)..(208): n is a, c, g, or t
  modified_base (633)..(633): a, c, t, g, unknown or other
  misc_feature (633)..(633): n is a, c, g, or t
  modified_base (670)..(670): a, c, t, g, unknown or other
  misc_feature (670)..(670): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggtttcctgttgcttattttaaggngtctagtgtgaggtgcagctggtggagtcgtgggggngtcttggtccaggccgtacggggggtccctggacgactctccgtgtcgacgacgtcctcgtaggtacttcctactttacgaagtttatttagtcggacttaatcgaccgtacggtccgggtacccgaccgacgggtaccgtaccgggtaagggggaacggtaccggtaggtaaagtagttcgtacccgtagtacggttaacgtaaggtaaacgtacgtcggtaaacgttaaagtaacctagttaattagtttacgaacggtaacctaaaacgttcggtaagtacggaacgggtaccgtaggtaaccctttccaaccctaacgttcccgtaacgggacgggttaaaccaacttacccggaaaacggtacgtaaccgttaacgtttacgtaacttaccggttaaacgaagggtcggtaatacccggngttaccggagtacgacgttaggaacgtcgaaccggtntaactagttacgtacgttaggggaacggtggaagggtacgtaacggttaggttaacgggcggtttaaggtaggggtcccggaggtacccgggg

SEQ ID NO: 268892 - DNA, 745 bp, Homo sapiens
  misc_feature: GYAE6OF02G615I.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagcgtggtggagtcgtgggggaggcttggtccagccgtggggggtccctggacgtactctcctggtcgcacgcctctggtacttcctaccttcagttatttatgtactatgcctacgtcgggtcccgccgacggtcctacccggaaggggaacggggtacgtagggaattagttacgtaccgttacgtaagggttaatttaagggtaaacgttaaagtacggtaaccgtaaaataaactaatttaatttaatttaagtacgaaactaaacttccggttaagggtacggtaaggggtaccaaggttacttacccaaaccttacgttaccctacccggaaggtaacccgtaaacttacccgaaaacgaacccgtacgttacttacggtttaactacgttaacgtaaagtcgggaactaccggtacgtaggacgagtcgtacggacggtacgaacgtgtacgtagttaccttacgggtgggtagggacggtaggtaacgggtacggttaagttcgggggtaacggtttaggggtacgggtagggtacccggtagggg

SEQ ID NO: 268893 - DNA, 940 bp, Homo sapiens
  misc_feature: GYAE6OF02JJZ1K.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctggagcttggggtttttccttgttgtcttaattttttaaaggtcgtccagtggtgaggtgcagtctgggtaggagtcggtgggggaggtcttggtccaggtccggtcggggggtccctagacgtcctctccgtgtcgcacggtcccttacgtggtacttcccgtacctttacagtttacttttatggaccttaagttcgacgtacggttccggggtacccgtcccgaacggtccgtaccgggaacggggtaacggggaaccgttagggaaattacgtggtaccctaggtaaaggtttagttaaaggtaataacgtacgtaaacgtaaaccgttaaataacgttaagtttaaattaacggtaggtaaaacccttaaagtttcgtaacgggttaacggggaaacgggtacggtaacggtaacttaccccgtaacctacgttaacccggtacccggtaaacgggtaaaaccgtaaccttaaaccgaaaacccgtaaaccgtaaccgtttacggttaccgttaaccgtttccgttaaaccgttaaagggtcccggtacgtttaaaccggtcgttaaacggtaaggggtaacgttaccgggttaggtaaacccggaccgggttaccggtttaccgttaacgggtttaacgttaccgttaagggttccggggggttaaacgggtaaccgggggtaggtaaacggggtttaaccgggggtttaacggtttaacgggggtaaaccggggttttaccgggggggtttacggggtttaccgggggggacccggtttaaacccggggggg

SEQ ID NO: 268894 - DNA, 729 bp, Homo sapiens
  misc_feature: GYAE6OF02HOKFT.28.57.F02.1.454.CMB.1.raw
  modified_base (578)..(578): a, c, t, g, unknown or other
  misc_feature (578)..(578): n is a, c, g, or t
  modified_base (650)..(650): a, c, t, g, unknown or other
  misc_feature (650)..(650): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctggagactctcctgtgcagcctcgtggacttccaccttcgtagttatttatgtcttaagtcgccgtacgttcggggtcccgaccgtacgggtaccgttacccggaagggggaaacgggtacgttacggaaacgttaggttgttaccgtacggtaaggtttaacgttaaaggtaaagttaacgttacggaaccggtaaaattaactaagttaagtttaacttaagtacgtaacctaaacgttacgtaggtaggaacggtacgtaagtacttacaccgtacttaccgacggaaacggactaacgtaccgaaacgacacgtctttagacttacctaagtagngggtaccacgttacgacgtagacgtcggtacgaacggtcgacggttactaacgggttattaacgtttacggnggggtaacggaggaacggacggtaaggttacgggttaaccggaaggtttacggggtcggtaccgggtacgggtaccggg

SEQ ID NO: 268895 - DNA, 675 bp, Homo sapiens
  misc_feature: GYAE6OF02JHZZS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagtcttggtccagccgtggggggtccctggagactctcctgtgcagcctcgtggacttcaccttcagttatttatgtctatgctacgtcgggtccgccgaggcctccggagggtaacggcgtaggaatgtgtctcgtaggtagttaagaagtagtgacgtaataactatatattagcaactaacttgtaggtaggaacggacagttacttaccgactagttccgtaccgtaggtaactaacgttaccgaaacgtaaccgacgtcttaagttacttaccgttaacgaaaggtccgggtaactaccgtaccgtagacggttacgtaccggtaggaaccggtaccgaacggttccgtagtttaacttacggttacggtgggtagggaacgggttaggacgggttaaccggttaaggttcgggtaaacgggtttaggggtacgggttaccggggtaacccgtagggg

SEQ ID NO: 268896 - DNA, 915 bp, Homo sapiens
  misc_feature: GYAE6OF02HKA2G.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgcttatttttaaaggtgtccagtgtgaggtgcagcgtggtggagttcggtggggggaggtcgttcgggtccgaggtcccggtcgggggggtcccctggacgtacctccgttcccgtgtcgacctagtcccttcgtggtacttcctacctttctagtttatttatggtaccttagtacgccgtacggtcggggtacccgaccgacgggtccgttaccggaagggggtaacgggtacgtagggtaaacttagttacgttaccgtaacgtaagggtttaagttaaagggtaaacgttaaggttaccggaacggttaaaaacttaaaccttaaagtttaagtttaatttaaacggttacgtaaaacccgttaaaacgtttccggttaggggtaaacggggtaaacgggtacccgttaaaggttaacccttttaaccccaacccgtttaaccgttaccccgtaaccgggtaaaccggggtaaacccttttaaacggtaaaccccgaaaaccggtaaaccgtaacccgggttaactttacggttaacctttaccgtttaaccgaaaagggtttccggaacgaaccgtttcggagtaacggtacggtacgagggttaaccggacgtacggtacgttagttaacgttacgtttaacgggtgggtaacgggtaacgggtagggtaaccgggtaaggttaacgggtttacggggttaaccggtttaggggggtaccggttccgggggaaccggtaacccgggg

SEQ ID NO: 268897 - DNA, 965 bp, Homo sapiens
  misc_feature: GYAE6OF02I26I4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcaacgacagaagagtcagtgacggtagtttgggctgagtcttgggttttccttgttgcttaatttttaaaggtgtccagtgtggaggtgcaggtcgtggtggagttcggtgggggaggtcttacgggtcccgaggtcccggttcggggggtccctacggacgtaccgtcgttcccgttggtcgcacgcccttagtcggtattccgaccttacgtaagttatttactcgtcttaagtcgtccgtacggttcgggttcccgaccggaacggtcccctaaccgggaagggggacgggtaccgttaagggaagttacgtcgtacttacggttagtaagttaagtaagtaattacggaaactaaagtaaacgtaattaacgtttaattacgtacgtaaacccgtaaagttccggttaggtaacggtaacgggtaccgggtaataaccgtttaccgtaacccgtacgtaccccggttaaacgaaccggtttaaactaaacccgttaaaccccggtaaataaaaccccggtaaccgttacgttaccgtttaaacgtttacccgttaaaaccttaacgggtttaaccgggggaacccttaacgggtacccgttaaagggtacccggaaagttaccgggacggggttaaaaccgggccccgggtttaaacggttcccgttaaacgggtttaactttaacccggggttttaagggttaccgggggtttaacggggtaaaacggggaggggtttaaccccggggttaaggggtttaacccccgggtttaaaagggggtttaccggggtttaaggggggggtttaaaccggggttacccggggtaacccggggggtttaaccccggg

SEQ ID NO: 268898 - DNA, 657 bp, Homo sapiens
  misc_feature: GYAE6OF02FJRX5.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctgagactctcctgtgcagcctctggattcaccttcagttatttatgctatgcacgtgggtcccgccgaggcctaccgagggaaggactaggaatatgtctagaggttattaagaataagtgacgtaataacattaattattagtagaactaaacttcgtaggtaggaacggtacaagtactcaacctataccgtaccggaaggaacctaaacttaccgaaaacgaaccgtaactcgttacgttaacttacctaacgtaaacggttcgggaacacggtaccgtacggaagtaccgtccgttagggaacggaacgtacgtacgttacggttatacgttacgtagggtagggaacggaggtacggaacggttaaggttacggtaacggttaggggttacgggtaccggggtacgaacgggg

SEQ ID NO: 268899 - DNA, 727 bp, Homo sapiens
  misc_feature: GYAE6OF02IR74Q.28.57.F02.1.454.CMB.1.raw
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcatgacgggagtttggggctgagctggggttttccttgttgctatttttaaaggtgtccagtgtgaggtgcagctggtggagtcgtgggggaggcttgggtccagccgtggggggtccctggagacctctccgtgtcgcacggcctcgtggtattcctacccttctagttaatttntagtcctagtncctacggtcggggtacccgccgacgggcctaccggaagggggaacgggtactagggaactagttcgtcgtactagggttaataagggtaaacgttattacgaacgaaataaactataattaattagtcaacgtaaccttgtggtaacggaaggtccgaagtacgtaccctaactcgttacccgtaccgaacggggtaacctaaccgttaccgaaaaccgtaacccaccggttatacggttaccttaccgttaagtaaacggtacgggactaccgtaacgtcggtaagagtacgtcgggtaaacggacgacggtaccttgttaacttagttacgggtggtacgggtaggtaacgggtaggaccgggtaaggttacggtagggttaggggtttccgggtacggggaccggtaacgggg

SEQ ID NO: 268900 - DNA, 756 bp, Homo sapiens
  misc_feature: GYAE6OF02I5HJO.28.57.F02.1.454.CMB.1.raw
  modified_base (319)..(319): a, c, t, g, unknown or other
  misc_feature (319)..(319): n is a, c, g, or t
  modified_base (434)..(434): a, c, t, g, unknown or other
  misc_feature (434)..(434): n is a, c, g, or t
  modified_base (463)..(463): a, c, t, g, unknown or other
  misc_feature (463)..(463): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttcggctgacgctgggttttccttgttgctattttaaagtgtccagtgtgaggtcgcagcgtggtggacgtcgtcggggagtcgttacggtccagtccgtcgggggtcccctggtaagacttccgtcccgtggtcgccgacggtccttcgtacggacgtttccaaccgttcgaagttactttacnggtccttagtcggtctaacggtcggtaccccgacgtggaccgtccggaagggtacgggaacgttagggaactacggtcggttccctagtgggttaccttaaaggaagtttaccgnggactaaagtaacacgttaatacgttaancgtaacgtaaacgttccgttagtaagggtaaggcctaggtacttacgactacgtaccgttacgaaccggtactaaacttaaccgaactacggtacctcgttaaccttagtaccgttagtacgtcggtaacgtacgtccgtaggtaccgttacgacgtacggtaacggtccgaacggttacttagtaccgttaaggttaaccgtacgggtacggtacggtacggtaacgtacggggtttaacgtaacggttaagggttcgggtaaccgggtttcgggaacccgggttaaccggg

SEQ ID NO: 268901 - DNA, 739 bp, Homo sapiens
  misc_feature: GYAE6OF02G1RQB.28.57.F02.1.454.CMB.1.raw
  modified_base (259)..(259): a, c, t, g, unknown or other
  misc_feature (259)..(259): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtcagtgtgaggtgcagctggtggagtcgtgggggagcttggtccagccgtggggggtccctgacgactctcctgtgcagcctntcggattccaccttcagttatttatgtcttatgcctacgtcggggtcccgccgacggtcctaccggaagggggtaacggggacgttagggaaattagtcggtacgttacgtaggttaactttaaggaaaggtaaattcggaacgtaaaataaactaattaagtttaattaactagaacctaaacttcgtaggtacggaaagggccaaggttaactacccgaacctacgttacctaccgaacgggtaaactaacgttaaccgaaacgtaacccgtacgtaccgtttagtacctttaccttaacgtaaacgtcgggtacaacgtaccgtacggtaacgaccggtgtacgggtaacggaccgtaacgggtacttacggttacgttacgtttaggtaagggttagggtaaggaacgggtaaggtacgggttaacggttacggggtaacggtttaggggtcgggttacgggccgggttaacgggg

SEQ ID NO: 268902 - DNA, 658 bp, Homo sapiens
  misc_feature: GYAE6OF02FHGU2.28.57.F02.1.454.CMB.1.raw
  modified_base (289)..(289): a, c, t, g, unknown or other
  misc_feature (289)..(289): n is a, c, g, or t
  modified_base (333)..(333): a, c, t, g, unknown or other
  misc_feature (333)..(333): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggtcttggtccaggcccgtggggggtccctgagactctcctgtgcacgcctctggacttcaccttcagtatttatgntatgcacgtgggtccgcgaggcctccgagggaaggactggaatntcgtctcgaggttattaagaagtaagtgtacgaaagtaactagttaactttattagtagactaaaactctaggttaggaacgggcacgtaacttacaccgtagtacctaccggaacggtaactaaacgttaccaaacgaacctacgctagtattactacgaaagtcggacacgtcctagtacgagctaggacggacggtacggtactaggttacgtaacgttcggttaagggtacggggaaggtaacggggtaacgggtaacggttaaggttacgggtaaaccggtttaggggggtttgggtacgggggtacggtaacccggggg

SEQ ID NO: 268903 - DNA, 613 bp, Homo sapiens
  misc_feature: GYAE6OF02GVQ02.28.57.F02.1.454.CMB.1.raw
  modified_base (408)..(408): a, c, t, g, unknown or other
  misc_feature (408)..(408): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccaggccgtggggggtccctggagactctccgtgtgcagcctcgtggattccaccttcagttatttatgctatgcacgtgggtcccgccgaggtcctccgaaggggacgggactgggaatgtgtctacgaggttacttaagaagtatgacgaataacatatattatagacaaactcgtgaggacggnagtatacactactcctaccgagggaactaacttaccgaacgaacgacgtctagttactaccttacaagtcgggactacggacctggacgacgtcgtaggacggaccgtacggtcgttacgtattagttcgtacgggtaggaggacgggtaggtacgggtagttacgggtaaccgggttagggttacgggtcggggacgtacgggg

SEQ ID NO: 268904 - DNA, 773 bp, Homo sapiens
  misc_feature: GYAE6OF02I2AOH.28.57.F02.1.454.CMB.1.raw
tcagagtacgctatcacgaccggtgctcgatttagctcgatatagttgggtctgggagaggagccccccgcccctgggtttccccaggtgttctcatttggtgatcagcactgcacacagaagagtcatgacggagtttgggctgagtcttgggttttccttggttgcttaagttttttaaaggtcgtcctagtggtggaggtgacagtcgtgggtggacgtcggtgggggacgtcgttcggtccgaggtcccggttcgggggggtcccctaggacgtaccgtcctcccgtggtagcctcggtccccgttcgtcggtacttccctaaccgttctagtttaactttagtgtaccttagtcggactacgtcggtaaccttccccggacccgtacggtcccggtaccgggtaaacgggggaacggtaacgtaggaattagttcgttacgtacgtaaggttaacgttaaggtaaacgtacgtaggaaccgtaaaataactaagttaattaacgttaagtaccgtaaactaaccgttgttacggtaaggtaaccggagtaagttaccctacgacccttactaccggacgtaacgaaccgttaactaacccggaaacgtacacgttattacctattaccgtaactaggtaccgactacgtaccgagtcgagcgtacggaagacccgtgtacgttatacgttagtaggttacgggaagggtggaaggtacggtaacggtaggttaacgttaggggtacgggttcggttaaccgggacggg

SEQ ID NO: 268905 - DNA, 842 bp, Homo sapiens
  misc_feature: GYAE6OF02ITNSL.28.57.F02.1.454.CMB.1.raw
  modified_base (171)..(171): a, c, t, g, unknown or other
  misc_feature (171)..(171): n is a, c, g, or t
  modified_base (278)..(278): a, c, t, g, unknown or other
  misc_feature (278)..(278): n is a, c, g, or t
  modified_base (576)..(576): a, c, t, g, unknown or other
  misc_feature (576)..(576): n is a, c, g, or t
tcagagtacgctatcacgaccggtgctcgatttagctcgatatagttgggtctgggagaggagcccccgccctgggtttcccaggtgttctcatttggtgatcagcactgcacacagagagtcatgacggagttgggctgagctgggtttccttgttgcttattttaaggntccagtgtgaggtgcagtctggtggagttcgtgggggagtcgttggtcccaggccggtggggggtccctagagactctcctgtgcagtcctgtggtacttcaccttnacgttatttatcgtcttagtgccgtacggtcggtcccgtcgaggtccgttacccgaggggtaaaggcgtacgggtaaattcgtacgtaccggttaggtaacggtttaacgttaaggtaaagttaacgtacggtaaccgtaaaactaaccggttaatttaagtttaattacgtactaaacggtaaacttcgttacgggtaaggaacgggtactaacggttaactccgtaaacctcgttaacctacccgggtaaacgggtaccttaaacgttaaccgaaaacgtacccgttaaaccggtnttaaaccggtttaacctttacgtaaccgtaaaacgggtccgtacctaacggttaaccccggttaggaaaccggtgttccgttaagggaaccccggtacggtaacccggtgttaaaccggtttagtttaaccggtttaaccgggttagggtaggggggtaaaacgtccggggtttaaacggggaaccggtttaacgggtttaccggggaaaacgggttttcggggggttttccggggaacggggggttacccgttaaacccgggggg

SEQ ID NO: 268906 - DNA, 906 bp, Homo sapiens
  misc_feature: GYAE6OF02GJ3TF.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgtcttatttttaaaggtgtccagtgtgaggtgcagcgtggtggagtcggtgggggaggtcgttgggtccaggtcccggttcgggggggtcccctggacgtaccttcctccgttggtcgcacgtcccttcgtggtacttccgtaccctttacgtaagttttaacttttagttcgtaccttaagttcgaccgtaaccggttccgggggttacccccgacccggtaaccggggtccccgtaaccccggggaaacggggggtaaacggggtaaccggtaagggtaaattaacggttccgttaccgttaacggtaagggtttaagttaaaggtaaaacggttaagtacggtaacgtaaaacttaaactaattaatttaagtttaagtaacgtaacctaaacgttcgttagggtaacgggaacgggtaacacggtacctttaaccaaccgttacgttaccgtaacccggtaaggtaaaccttaaaccgttaacccgaaacggaaccctaccggttactttaacggttaacctttaaccgttaaacgaaacggttcggaaccgtaccggtacgtacggaacggtacggttacgtaacgggaaccggtacccgtaacgggtactttaacggttattaacggttacgggtagggtaacggggtaagggtaaacgggtacgggttaaacggttaacggttaggggtaacgggtttagggggttcccggggtaccggggtacccgggtaacgggg

SEQ ID NO: 268907 - DNA, 820 bp, Homo sapiens
  misc_feature: GYAE6OF02IMJQB.28.57.F02.1.454.CMB.1.raw
  modified_base (343)..(343): a, c, t, g, unknown or other
  misc_feature (343)..(343): n is a, c, g, or t
  modified_base (613)..(613): a, c, t, g, unknown or other
  misc_feature (613)..(613): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggtagtttgggactgagtcgttgggtttttccttgttgtactttaagtttttaaaggtcgtccaggtgtgtaggtgcagtcgtagggtggtagtcggtgggggagttcgttcggtccgaggtccgggtacggggggtccctaggacgtacctcgttccgtagtcgaccgtcgtccttcgtaggtacttccgtacttcttaaggttacttttancgtacttagtgtacctacggtccgggtaccgtacccgtacggtccgtacccgggagggggtaaccggtacgtaacggtaaattcggtcttaacgaccggttaaggtttaaggtaaaaggtaacggttaagtcgtaaacgtaaaatttacaatttaacgttatttacgaacgtaactaacgttacggtaggtaacggaacggtataacgtacttacctaacgtacgttaccgacggtaacgtaacttaacgttaacccgaaagttaaaccncgttagtacgttaccttaacgtaacggtaagtacgggaccgttaacgacgtacgggtaacacgggtacgttaggaacccgtaacggaacggttacttaacgttacgtttaacgttcggtaagggaggggttaagggtaacggtacgggtacgttaaagggttacggtaccgggtttaaggggtcgggttacgggaacggtaccgggg

SEQ ID NO: 268908 - DNA, 725 bp, Homo sapiens
  misc_feature: GYAE6OF02GV939.28.57.F02.1.454.CMB.1.raw
  modified_base (351)..(351): a, c, t, g, unknown or other
  misc_feature (351)..(351): n is a, c, g, or t
tcagagtacgctatcacgaccggtgctcgatttagctcgatatagttgggtcgtgggagaggagcccccgccctgggtttcccaggtgttctcatttggtgatcagcactgcacacgagaagagtcatgacggagtttgggctgagctgggttttccttgttgctaatttttaaaggtgtccagtgtgaggtgcagcgtggtggagtcgtggggggaggcttggtccagccgtggggggtccctggagcctctcctgtgcagcctcgtggacttcctaccttcagttatttatgactatcgcgtaccgtcgggtcccgccgaggcctccgaaggggaaggtactaggaatntgtctagtagttataagaagtaagtcgacgtaaataacgtattaataattacagtaactaaactgtaggtaggaaagggctaagtacttccgaacctacttaccgtacccggaaaggaacctaaacgttaccgaaacgaaccgtacgttacttacgttaacttaccgttaacgaaacggttcgggaaccttacggtaccttagggtaacgtacgtacggtaacgtaacggtaccggtaaccggttacgtttaaggttacgtttaacgttaccggtagggggtaagggtaaagggacgggtaacgggtaacgggttaacggttaggggtaaaccggtttaggggggttcgggtaccgggggaccggtaaccgggg

SEQ ID NO: 268909 - DNA, 773 bp, Homo sapiens
  misc_feature: GYAE6OF02HLOWN.28.57.F02.1.454.CMB.1.raw
  modified_base (176)..(176): a, c, t, g, unknown or other
  misc_feature (176)..(176): n is a, c, g, or t
  modified_base (616)..(616): a, c, t, g, unknown or other
  misc_feature (616)..(616): n is a, c, g, or t
tcagagtacgctatcacgaccggtgctcgatttagctcgatatagttggggtctgggagaggagcccccgccctgggtttcccaggtgttctacatttggtgatcagcactgcacacagaagagtcatgacggagtttgggctgagctgggttttcctgttgcttagttttaaggngtccagtgtgaggtgcagctggtggagtcgtgggggacgtcgttcgggtcccgaaggcccgggttcgggggggtacccctaggacggtaccttccttccgtggtcgacacggccccttagtcggtacttcccgtaacctttacgaaggtttacttttacgtgtaccttatcgactaccggttccggggtcccaacgtcggtaccgtaccgggaggggtaacgggacctagggtaattacgtacgtaccttaggaaggtttataaaggtaagtaagtcggtaacgtaataaacgtataactttatagtacgtaacttaaacgttcgtacgggtaagaaggtccgtaagtaccgtcgtaaccgtactaccgtaccgggtaagttaaacacgttaacccgaaaggtactacgtcgttacgttactcgtaagtacgccgggtanaacggtacctaggaacgtcgacgtaaggaccggtacgtaaaccgtgttaacgtacgtttccgttaggaaccgggttgggtaacggtacgggttaacggaacggtttacggtaacgggtacggttagggggttacgggtacggacccggttaaccggg

SEQ ID NO: 268910 - DNA, 674 bp, Homo sapiens
  misc_feature: GYAE6OF02FR40J.28.57.F02.1.454.CMB.1.raw
  modified_base (300)..(300): a, c, t, g, unknown or other
  misc_feature (300)..(300): n is a, c, g, or t
  modified_base (381)..(381): a, c, t, g, unknown or other
  misc_feature (381)..(381): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttatgctatgcacgtgggtccnccgaggcctccgaggggaagggactagggaatagtgtctacgaggttattagaagttagtgacgtaataacattatattangactaaactctagtaggaagggcaagtacttccactatcctacgagggtaactaacttaccgaaacgaccacgtctacgttacttacttaacgtaaacgtcgggacgtacggtccgtagaacggtacgtacgttagggaaccggaaccgtaaccgggtaccgttaagttacgttaacgttaccgggttagggtaacggggtaacggaagggggtaacgggtaagggtttaaaggttaccggggtaacgggtttacgggggtttacggggtaccggggggtacggtaacggggg

SEQ ID NO: 268911 - DNA, 772 bp, Homo sapiens
  misc_feature: GYAE6OF02G5CQP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaggtgtccagtgtgaggtgcagctggtggagtcgtgggggaggtcgttggtccgagccgtggggggtccctggacgactctccgtgtgcacgcctcgtggtattcctaccttcagttatttatcgctatgctacgtcgggtccgacccgaggcctaccggaggggaacggtcgtaggtaactagtggttacctcgtaaggttaattaagaagttaacgtaggaactaaacgttaacaattaagtttaatttacgtacggtaaactaaacttcgttaacggtaggaacgggtacgtaagtaacttacccaaccgttactacccgtacggaaacgggtaacctaaacgttacccgaaaagtaaaccgaccggttattacgtaccgttaacttaacgaaacggttcgggacctaacggtacccgtagggaaccgtagtaccgttagggaaaccgggacccacgggttacgttaagttacgttaacggtttacggtggggttaaacggggaggttaaaccggggaggttaacccgggttaaggtttaccggggtaaacgggttttacgggggttacggggtaccggggtaccggtaaccggggggg

SEQ ID NO: 268912 - DNA, 1063 bp, Homo sapiens
  misc_feature: GYAE6OF02F1N85.28.57.F02.1.454.CMB.1.raw
  modified_base (179)..(179): a, c, t, g, unknown or other
  misc_feature (179)..(179): n is a, c, g, or t
tcagagtacgctatcacgaccggtgctcgatttagctcgatatagttgggtctgggagaggagcccccgccctgggtttcccaggtgttctcatttggtgatcagcactgcacacagaaagagtcatgacggagtttgggctgagcttgggttttccttgttgcttaatttttaaaggngtccagtgtgaggtgcagcgtggtggagttcgtggggggaggtcgtttgggtcccaggccggtcggggggttcccctggacgtacctccttccttggtcgcgacgccgttccgtaggtactttaccacccgtttctaggtttaattttacgtcgtaccttagttcgtaccgtaaccggttccgggggttaccccgcccgtaccgggacccgttacccgggaaacggggggtaaccggggtacggttagggtaaaaccgtttcgttacgggttaccccgtttaaggttaaaccggggtttaaaagttttaaaaccgggtaaaaaggtttaaacggttcggggaaaaacctttaaaacgtttaaaaaccgttaacgttttaaaactttttaaagtttaaacggtaaccgtaaaacccgtttaaaaaccggttttacggtttaacgggttaaaccgggggtaaaccgggtaacgtaaaccgggttaaccctttaaacccgtaaaccccgtttaacggttaaccccgttaaccccgggttaaacgggtaaaacccctttaaaccggttaaaaacccccggaaaacccgggttaaaaacccgacccggtttaaaccgttaccggtttaccttaacgtttaaaacccgttaaaccggtttacgggaccggtttaaccgaccggtttagggaacgtaaccggttaacgggtaacggtaaccggtaacccggtagggtttaacccgtacgtttaaccgttttaacggtttacggttaacggggtaacggggtaagggtaacggggttaacgggtaacgggtttaagggttaacggggttaacgggttttaaccggggtagggggtacccgggggttaccggtaacccggggg

SEQ ID NO: 268913 - DNA, 925 bp, Homo sapiens
  misc_feature: GYAE6OF02HVTX5.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggttttccttgttgtcttaatttttaaaggtgtccagtgtgaggtgcagctggtggtagtcgtgggggagtcgttggtccaggtccgtggggggttcccctggacgtacgtcctacctgtcgctaacgccgttacgtggtacttacccgtaacctttacgtaggttacttttaactgtacgttactacgaccgtacggttaccggtccggacccgtacgggtacctaccggggaagggtaaacggggtaccgtaaggtaaagttaacgttggttaccttaccgtaagggttaacgttaaggtaaaggttaacgtacggtaacgtaaaactaaacgttaaattaataatttaacgtaacgtaacgtaacgtttacgtacgggtaaggtaacgggactaacggtaacgtttaaccgacccttaacgttaccctaaccgggtaacgggtaaacttaaaccgttaccggtaaaccgtaaaccggtaaaccgttacccgtttaagtaaacccgtttaccgttaaaccggtaaaacgggtaccgggtaccggtaaacggtttcccggaaggggtaaccgtaacggtaaccggttaagggaaccgggtaaccggtaaccggggttaacccgttagttttaaccgttaaggtttaaccggttaaggggtacggggttaaacgggtaccggggtaaacgggtaaccgggtttaaagggttacgggttaaacgggttttaacggggtttcgggggttacccgggggtaaccgggttaacccgggg

SEQ ID NO: 268914 - DNA, 820 bp, Homo sapiens
  misc_feature: GYAE6OF02HAA4H.28.57.F02.1.454.CMB.1.raw
  modified_base (112)..(112): a, c, t, g, unknown or other
  misc_feature (112)..(112): n is a, c, g, or t
tcagagtacgctatcacgaccggtgctcgatttagctcgatatagttgggtctgggagaggagccccgccctgggtttcccaggtgttctcatttggtgatcagcactgcanacagtaagagtcatgacggagtttgggctgtagctgggttttctgttgcgtattttaaaggtgtcagtgtgaggtgcagctggtggagtcgtgggggaggcttggtccagtccgtggggggtccctgacgactctccgtagtgccagccgttacgtcggtattacctacctttcgagttaactttacgtgtacttagtcgactaccggttcgggtacccgtccgacgggttccgtaccggaaggggaacgggtacgtggaacgttacttcggtacgttacgtaacgggttagttaacggtaaagtagtacgtaacggtaaacttaacgtaacggttaattaagtttagttaaccgaacgtttaaacccgttacgttaacgggtttaacgggaacgggttaaccgtagtttaaacggttccaaacccggttaacttcccgttaaccggtaacggaacgttaaacggtacctaaagggaaaccttacccggtagtacttaacgggttccttaaagggtaactttcgggggacctaaggtaccgtaacgggtacgtacgtaccgggttacgtaacccgggacgtaaccgggctttaaggttacgttacgttttacgggaacgggttagggagggtaacgttacgggaccgggtaaggttttacgggaaccggtttaggggttttccggtaacggggggttacctaacgggg

SEQ ID NO: 268915 - DNA, 756 bp, Homo sapiens
  misc_feature: GYAE6OF02I6340.28.57.F02.1.454.CMB.1.raw
  modified_base (176)..(176): a, c, t, g, unknown or other
  misc_feature (176)..(176): n is a, c, g, or t
  modified_base (292)..(292): a, c, t, g, unknown or other
  misc_feature (292)..(292): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtntccagtgtgaggtgcagctgggtggagtgtgggggagcttggtccaggccgtgggggtccctgagactctccgtgtcgcagcctgtggtacttcctaccttcgtacgttattttangtcttatcggacctacggttcgggtcccgtccgacggtaccttaccggaaggggaacggtaccgtaggtaacgtaacgttcgtacgtacgtaaggttaagttaaacgtaaaggttaatacggtaacgtaaacgtaactaagttaataacttaagtacgacttaaacgtcgtagtacgggaaggtactacggtacttaccaacgtacgtacctaccgtaacggaactaacgttacgaaacgtaactacgtacttacggttactacgtaactaagtccgacgtacgtacgtagtagcgtacgtaggtaaccggccgtaacggttcttaaccgttagttaaccgggtttcggtaacggggtaaggtaaacggggtaaacggtttaacccggggtaaggttaaccgggttaacgggtttaaccggggttaggggtaccggggtttaaccggcggggttaaacccgggg

SEQ ID NO: 268916 - DNA, 721 bp, Homo sapiens
  misc_feature: GYAE6OF02HZV5L.28.57.F02.1.454.CMB.1.raw
  modified_base (323)..(323): a, c, t, g, unknown or other
  misc_feature (323)..(323): n is a, c, g, or t
  modified_base (529)..(529): a, c, t, g, unknown or other
  misc_feature (529)..(529): n is a, c, g, or t
  modified_base (562)..(562): a, c, t, g, unknown or other
  misc_feature (562)..(562): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttagttttaaaggtgtccagtgtgaggtgcagctggtggagtcgtgggggaggtcgttggtccgaggccggttgggggggtcccctggacgtacctcgtcctggtgcgagtcctcgtggtacttcccgtaccttcgtaagttatttaactcgtacttancgtcctacggtccgggtcccgacccgtggtccgtaccggaaggggaacggtaccgtaaggtaagttaacgttcgtactcgtaaggttaagtttaagaagttaacgtacgaaccgtaaataacgtattaattattacgtacaacgtaaacttgtagtaggaacggtcagtactcgactacgtccacgaagtactaactaccggaaanaacgtcgtacttacgacttacgtaaacgtacgnggtactaccggtaccgtaggaacgtgaacgttggaaccgtacgtaccggtagtttacgtacgtacgtttaccgggagggtaccggggtaagacggttaacggtacggttaacggacggttacgggttaaggggtttcgggaccgggtacgggtaccggg

SEQ ID NO: 268917 - DNA, 781 bp, Homo sapiens
  misc_feature: GYAE6OF02H5QPR.28.57.F02.1.454.CMB.1.raw
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagttttgggctgagcgttgggtttttccttgttgcttaagttttttaaaggtgtccagtgtgaggtgcagctggtggacgttcgtggggggaggtcgttgggtccaggtccgtggggggtccctggacgactcttccgtgtgccagtcctcgtaggtactttccgtaccttanagttacttttagtcgtacctagtcgcctacggttcggggtcccgacccgacgccgttccggaaggggaacgggtaccgtaggaacttacgttcgtaccgtacgtaaggtttaagttaaggtaaacgttaagtcgaaaccgtaaaattaaactaattaatttaagttaagttaccgaactaaaacgttacgtacggtaacgggaacgggtactaaggtaactttaccaaccgtacttcccgtaacggtaaccgggaactaaccgtaaccgaaacgaaccctacgtacgttacgttacttaccgttacgaaacggtcgggacgtacggaccgtggacgacgtacgacggaacggtaccgtaacgtacgttaagttacgttaacgtttacggtggtaacgggtaacgggaggtacggttacgggtaacggttacggtaacgggtttacggggttacgggttaccggggagtacccggggg

SEQ ID NO: 268918 - DNA, 870 bp, Homo sapiens
  misc_feature: GYAE6OF02HI3XU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtgggggtccctgagactctcctgtcgcacgcctcgttggactttccgaccctttcgaagttatttactgacttatgacgtaccggtcgggtcccgaccgacgggtcctacccggaaggggaacgggtaccgttagggtaaacttacgttcgtaccgttaccggtaagggttaacctttaaagggtaaacgttaaagtacggaacgtaaaacgttaaaccgtaagtttaaatttaacgttaaagttccggtaaacttaaaaccgtttcggttaaggttaaccggggaaacggggtacgttaaacggttaaccgtttacccaaacccgttaacgttaccccggttaacccggaaacggggttaaacctaaaccgttaacccgaaaacgtaaaccgtaccgtacgttacgttaacttaccttaacgaacggtcggaccgtaggtacccgttaggaacggttacggtaccgtaacgggtaacgggaacccggtaacggtacgttaacggttacgtttaacgtttaccgggttaaggggtacggggtaaacggtaacggggtaaccgggttaagggttaaccggtttacgggggtaaaccggtttacgggggtttacggggttaccggggtaccgggtaacccggggg

SEQ ID NO: 268919 - DNA, 750 bp, Homo sapiens
  misc_feature: GYAE6OF02I8T2V.28.57.F02.1.454.CMB.1.raw
  modified_base (215)..(215): a, c, t, g, unknown or other
  misc_feature (215)..(215): n is a, c, g, or t
  modified_base (276)..(276): a, c, t, g, unknown or other
  misc_feature (276)..(276): n is a, c, g, or t
  modified_base (413)..(413): a, c, t, g, unknown or other
  misc_feature (413)..(413): n is a, c, g, or t
  modified_base (440)..(440): a, c, t, g, unknown or other
  misc_feature (440)..(440): n is a, c, g, or t
  modified_base (466)..(466): a, c, t, g, unknown or other
  misc_feature (466)..(466): n is a, c, g, or t
  modified_base (601)..(601): a, c, t, g, unknown or other
  misc_feature (601)..(601): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatggacggagtttgggctgagtcgttgggttttccttgttgtctttaagtttttaaaggtcgtcctaggttggtggtagggtcgcgtagngtgggtggtaggtcggtgggggaggtcgttcggtccgaggcccgggttcggggggttcccngacgtcttcctccgtgtcgcacgtcctcgtacgtcttcctaccttagtaagttatttatcgtaccttagtcgcggtacggtccgggttcccgacgtacggtcccgtaccgggaagggaacggctaaggtaatacgtntccgtagtaagttagtaagaagttaancgtaagaaactaagtattaattaatntaacgtaactaagtacgtaggtaacggacgacgtagtaccttacacttaacgtcccgtagaaaccggtaagtaaccctaaccgaaagaccctaacgttccgtaaattacgtaacctacgtaaggtaccggtaacncggtaccgtaggtaccgtctaccgggttacggaaccgtacggtacgtaacgtttgtaacgtttaggttagggtgggaaacggttgggaaagtaggtaacggttaggttaaccggtaagggtacggggtttcggcggtaaaggtcccggg

SEQ ID NO: 268920 - DNA, 669 bp, Homo sapiens
  misc_feature: GYAE6OF02JE08L.28.57.F02.1.454.CMB.1.raw
  modified_base (529)..(529): a, c, t, g, unknown or other
  misc_feature (529)..(529): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcacgcctctggacttccaccttcagttatttatgtctatgctacgtcgggtccgccgaggcctccggaaggggtaacgggactagggaatagtgtctgaggttaagttagtaagtagtgacgtaataactattatattatacgactaaacttcgtagtaggaacgggactagtacgttacacctattcccgtacggacgggtaactaacttaccaaacgaccgtacgtcttaggttaacttacttaacgaaaggtcggactacgtccgtagaacgngtacgtagggaaacggaccgtaagggtccttagttacgttacttacgggttgggtaaggggaacgtaggggtaacgtaacgggttaagggttacggaaccgggtttagggggttcggggtacgggccccgggttaagggg

SEQ ID NO: 268921 - DNA, 688 bp, Homo sapiens
  misc_feature: GYAE6OF02ILYQJ.28.57.F02.1.454.CMB.1.raw
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (407)..(407): a, c, t, g, unknown or other
  misc_feature (407)..(407): n is a, c, g, or t
  modified_base (562)..(562): a, c, t, g, unknown or other
  misc_feature (562)..(562): n is a, c, g, or t
tcagagtacgctatcacgaccggtgctcgatttagctcgatatagttggggtctgggagaggagcccccgccctgggtttccccaggtggttctcatttcggtgatcagcactgcacacagaagagtcgatcgacgggagtttgggctagagctagggttttccttgttgctatttttaaaggtgtccagtgtcgaggtgtcagctgggtaggagtcgtgggggagcttggtccagcctcgggggtcctgagactctcctgtgcagcctctggattcgaccttnagttatttangtctatgcctaccgtcgggttcccgccgaggtccttaccggaggggaacgggtaccgtaggaatagtgtcgtacgaggttatagtaagtatgaacgtaataacatattattanagtactaaatctaggtagaaggctaagtacttacaccgtattcccgtagaaggtactaaacgtcgaaacgaacctagtacgttagtaacttcgtaacgtaaagtgggaaccacggtctaggacgacgtacgtaggaacgggtacctaaacgggtntttaacgtacgttaacgtttccgggtaaggggttaccgggtaaggtaacggggtaggtaaccggggttagttaaccgggggtaacggtttaggggggtacgggttaccggggaccccggtaagggg

SEQ ID NO: 268922 - DNA, 684 bp, Homo sapiens
  misc_feature: GYAE6OF02F7AVI.28.57.F02.1.454.CMB.1.raw
  modified_base (118)..(118): a, c, t, g, unknown or other
  misc_feature (118)..(118): n is a, c, g, or t
  modified_base (182)..(182): a, c, t, g, unknown or other
  misc_feature (182)..(182): n is a, c, g, or t
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
  modified_base (343)..(343): a, c, t, g, unknown or other
  misc_feature (343)..(343): n is a, c, g, or t
  modified_base (483)..(483): a, c, t, g, unknown or other
  misc_feature (483)..(483): n is a, c, g, or t
  modified_base (503)..(503): a, c, t, g, unknown or other
  misc_feature (503)..(503): n is a, c, g, or t
  modified_base (551)..(551): a, c, t, g, unknown or other
  misc_feature (551)..(551): n is a, c, g, or t
tcagagtacgctatcacgaccggtgctcgatttagctcgatatagttgggtctgggagaggagcccccgccctgggtttccccaggtgttctcatttggtgatcagcactgcacacanaagagtcatgacggagtttgggctgagcgttgggtttttccttgttgcttaattttttaaaggntcagtgtgaggtgcagtctagggtggcgttcgngggggacgtcttacggtccnggccggttggggggccctgaggtacctctccgtngcacnccctgacggtnttaccacctttacagtttatttatggtcctaggttcacgtccgtcggttacccaccgngtacccgtacggaagggaacggtaccgtaagggtaatttagccgttagttaccggtagtttaagttaacggaaaagtacgttagaacgtaagtaactagttattaactagtacgaactaataccgtggtaaacgcgaacngtactaccgtcacgttaccnccggaaagttactacgtaaccactacgtacctatgtttaccacgttanaaccggtcgtaacgtcgtagagcgtcggcgtaacgacggactacgtagtaccgttagtagttacggtagggttacgaaggggtcagggttacgtaggttggttacggtgggtacccggaggttccgaaccggg

SEQ ID NO: 268923 - DNA, 708 bp, Homo sapiens
  misc_feature: GYAE6OF02HR9HB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgcttatttttaaaggtgtccagtgtgaggtgcagctggtggagtcgtgggggaggcttggtccagccgtggggggtccctgacgacctctcctgtgcagtcctcgtggtattcctaccttctagttagtttatgtcttagtgctacgtcggggtcccgaccgaggcctaccggaagggaacgggtacctaggaattaacgttggttacttacgtaaggttaagttaagaaagttaagtagaacgtaaattaacgtaattaagttatacgaataacgttgtaggtaacggaggacgtaacgtaatttaccaaccgtacttccgtaaccgaacgggtaaccttaaagtaccgaaaagaacctacgtcgttaacttataaccttacgaaagtcggactacgtacgagttacgagtacgtacggaacgaaccgtcggtactagttaattacgtttaacggtgggtaacgggaacggttggaacgggttacggttaggttaacgggaacggtttagggtaccggggtacggggaccggtagggtaccccggg

SEQ ID NO: 268924 - DNA, 795 bp, Homo sapiens
  misc_feature: GYAE6OF02I6FFE.28.57.F02.1.454.CMB.1.raw
  modified_base (422)..(422): a, c, t, g, unknown or other
  misc_feature (422)..(422): n is a, c, g, or t
  modified_base (456)..(456): a, c, t, g, unknown or other
  misc_feature (456)..(456): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagctgggttttccttgttgcttagttttttaaaggtgtccagtgtgaggtgcagtcgtggtcgaggttcgtggggggacgcgttcgggttccacggtccggttcgggggggtccctaggagaccttctccgtagtcgcctaggtccttctacggtacttaccgtaccttacgtagtttactttagtcgtacttacgtcgtccgtacggttcgggtaccgtcccgacgggtccgtaccggaagggggtacggtaaccgtagggtaacttaggttaccgtntaccggtaagtttagttaaacggtaaacgtttanacggtacgtaaacttaacgtactttaattacgttaagttacgtaacttaacttacgttaggtaacggtacggtatacgttaaccgttaccgaacctaacgttacccgtaccggaacggttaaacctaaccgttaaaccgaacgtaacccgacgttaccgttacgttaccgtttaacgtacccgttaaggtcggacctagtacggacgtacgtacggtcaggtaaccggaccgtacgtcgtagttacttacgttggaagggtaggagggtagggttaaccggtaagggttccgttaagggtacggtttagggggtcggtacgggggttcgtaacccgggg

SEQ ID NO: 268925 - DNA, 851 bp, Homo sapiens
  misc_feature: GYAE6OF02GX64A.28.57.F02.1.454.CMB.1.raw
  modified_base (296)..(296): a, c, t, g, unknown or other
  misc_feature (296)..(296): n is a, c, g, or t
  modified_base (580)..(580): a, c, t, g, unknown or other
  misc_feature (580)..(580): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgcttattttaaaggtgtccagtgtgaggtgcagctggtggagtcggtgggggagtcttcggtccacggccgtggggggtcccctggagaccgtcctacctggtcgcacgccttcgtaggtacttcctacccttnaacgttacgtttaagtcgtaccttatcgtcacggttcggggtacccgccgacgggtcctaccggaagggggaacgggtacgtaacggtaattagttcggtccgtacggtaagggttaattaaaggtaaacggttaagtacggaactaaaacgtaactaacgttattaaattacgtacgtaaactaaacctcgtaggtagggtaacgagtaacggtaattacccgactacgtaccgtaccgggtaaacggtaactaaccgttaaccgaacgaaccgtaaccggtnttaacggttacttaccggtaaacgtaacggttacgggacgtacggttaccggacggtacgggtaccggacggttaaccgggaacggtaacccggtaaccgggacgtttacggttaaacgttttcggtttaaaccgggtaaggggtttaaacgggggacgggggttaaacgggtacgggtttaaaccggggtttaaagggttcgggggtttaaaacggggttcggggggtttaacggggttacccgggggggtaacggttaaaccggggggg

SEQ ID NO: 268926 - DNA, 796 bp, Homo sapiens
  misc_feature: GYAE6OF02IMIRP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaagttttttaaaggtcgtccagtgtgaggtgcagctggtggagtcgtgggggagtcgttggtcccaggtccggttcggggggtccctaggacgtaccttcctcccgttgtcgccgacgtcctacgtcggtactttcctaacccttcgtaacgtttagtttatgttactattcgaccgtacggttccggggttcccaccggtacggttacccgtaccgggtaagggggaaccgggttacgtaacgggttaaacttagtttccggttaacgttacggtaaaggtttaagttaaacggtaaaagtaacgttacggtaaactaaaacgttaaactaaacgtttaattaaacgtttaataaccgttaaacctaaaacgtttccgttaacgggaacgggtaacgggtaacctaaggttaccttaaccccgtaactaccttacccggtaccgaacggtaaacctaacgtaaccgaaacgtaacccgtacgtactaacgttaccttaactaacgtaacgtacggactacgtacgtgacgtagagtacgagtaaccgtcgtagttatacttacggtgtacgggagaggtagacggtacgtaacgttaggggtaacgttgggtacggtacgggagtacggg

SEQ ID NO: 268927 - DNA, 693 bp, Homo sapiens
  misc_feature: GYAE6OF02FWZC6.28.57.F02.1.454.CMB.1.raw
  modified_base (555)..(555): a, c, t, g, unknown or other
  misc_feature (555)..(555): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtctgggggaggcttggtccagccgtggggggtccctgagactctcctgtgcagcctcgtgattcaccctttcagttatttatgcttatgcacgtgggtcccgccgaggtcctaccggaggggaacgggaccgttgggaaattgtacgttcgtacgtagggttaattaaggtaaagttaatacggacgtaaactaactaagttaatttaagtttaatacggtaacctaaaacgttcttaggtaggtaaacgggctaaggtaatttccgaacctaacgttccgtaccgtaagggaacctaacgttaaccaaacgtaaccacgtctagttacttaccttaagaacgtcgggaacngccgttagacgaatcggtagaacggaccgacgggtactaggttacttaacggttacgttgggaaggggaggaagggtaacggaacgggtaaggtttacgggaaggttacggggttgggtacccggggtcgtaacgggg

SEQ ID NO: 268928 - DNA, 913 bp, Homo sapiens
  misc_feature: GYAE6OF02J1J15.28.57.F02.1.454.CMB.1.raw
  modified_base (177)..(177): a, c, t, g, unknown or other
  misc_feature (177)..(177): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaaggtntccagtgtgaggtgcagcgtggtggagttcggtggggggacggtcgtttgggacccaggcccggttcgggggggtccctaggacgtaccttccgtccgtggtacgcgcgtccgttcgttcggtaacctttccgaacctttctaaggtttaactttacgtcgtaccttagtcgtaccgtacggtccgggtcccgtacccggacggtaccgtaccgggaagggtaaacggggtacgtagggtaacgtaacggttcgtaccgtaaccggtaaaggtttaagttaaagtaaacgttaacggtacgtaaacggtaaaactaacttaattaataacggtttataaccggaactttaaacgtacgttaacgggtaggtaaccgggtaatacggtaacttaaccccgagttaaccgttccggaaacccgggtaacggtaaaccttaaacccgttaggaaaacccgaaccgttaaccgttacgttaacggttactttaaccgacgtttaacgggacgtaacggtaacgtacccggtagaaccgtttacggacgttaaaacgggacccggttaaaaccggtccggttaacgtttaaactacggggtttaaacttaccggggtaggggtaaggggtaacccggggtaaaccgggttaaggtaccggggggtttaaaacgttccggggggaaagggttttttaaccggggggacggggttaccccgggggtagggttaacccgggggg

SEQ ID NO: 268929 - DNA, 758 bp, Homo sapiens
  misc_feature: GYAE6OF02IED1B.28.57.F02.1.454.CMB.1.raw
  modified_base (176)..(176): a, c, t, g, unknown or other
  misc_feature (176)..(176): n is a, c, g, or t
  modified_base (199)..(199): a, c, t, g, unknown or other
  misc_feature (199)..(199): n is a, c, g, or t
  modified_base (611)..(611): a, c, t, g, unknown or other
  misc_feature (611)..(611): n is a, c, g, or t
  modified_base (672)..(672): a, c, t, g, unknown or other
  misc_feature (672)..(672): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgtgggttttccttgttgctatttttaaggngtccagtgtgaggtgcagctggngagtcgtgggggagcttggtccaggccgtgggggtccctaggacgactctcctggtcgacctagtcctcgtggtacttccacctttcgagtttatttatcgtacttagtcgactcgttcggggtcccacgtacggtacctccggaaggggaacgggtactagggaacttacgttcggtacctacgtaagggttaactttaaggaacgttaagtacggtaaccgttaaattaacctaattaatttaacttaagttacgtaacctaaaacgttcgttacgggttaacgggaaagggtccgtaagttaactttccggaaaccttcgttaaccgtaccgaagggtaaccttaacgttacccaaaaggtacctaaccggtctttaacggtacttaccgttaacgaaggttccggganaccggtctaggacgtacggacgtaggaccggtaacgcggtacttaggtacttacgtttcgnggggttaacggaggaacggttcggaaccggtttaaggtccgggttaaacggttcggggttttagggccgggtaccccggtaagggg

SEQ ID NO: 268930 - DNA, 924 bp, Homo sapiens
  misc_feature: GYAE6OF02ICIM2.28.57.F02.1.454.CMB.1.raw
tcagagtacgctatcacgaccggtgctcgatttagctcgatatagttgggtctgggagaggacgcccccgccctgggtttcccaggtgttctctagtttggtgatcagcactgcacacagaagagtcatgacgggtagtttgggctgacggtcgttcgggtttttccctttggtttcgtctttaaagtttttttaaaagggtgtccgtagttggtggaggttgcaggtcttggtgggagttcggtaggggggtacggtcgtttcgggtccgacggcccggttccggggggggttcccctggagtaccgttcctccgtggtcgcgacgtccctcggttaggtaaccttcctaccctttacgtagtttaacttttaatcggtccttaatcgacctacgggttcggggttcccggcccgacgggtccgttaccgggaaggggtaaccggggtacgtaggggtaaatttcggttacgttccgtacggttaaaggttaacgttaaaggtaaagttaaggtacggtaaacgtaaaacttaaactacgtttaactttaacgtttaagttaccggaaacctaaaaccgtttcgtagggtaaacgggtaacgggactaaacggtttaccgtttaaccgaacccctttacggttaccccgaacccggggtaaaccgggttaacttaaccccgtttaaaacccggaaactaaaccgggtcccttaccgtttaaacttacggttacccttaaggtaaaccgggtttcgggaacctcggttaaccgaggaacgtacggtaccgtaagggacccgggtaagtacccggtagtttagtaccgtttagttacgggtcggggaagggagggtaacggtacgtagggttaaggtaccgggttaacggggttgggtaccggggtacgggacgggttaaccggg

SEQ ID NO: 268931 - DNA, 753 bp, Homo sapiens
  misc_feature: GYAE6OF02H8EKM.28.57.F02.1.454.CMB.1.raw
  modified_base (230)..(230): a, c, t, g, unknown or other
  misc_feature (230)..(230): n is a, c, g, or t
  modified_base (309)..(309): a, c, t, g, unknown or other
  misc_feature (309)..(309): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttccttgttgcttaagtttttaaaggtgtccagtgtgaggtgcagctggtggagtcggtgggggagtcgttggtaccgnggccggtgggggggtccctgaacgtctctccgtggtgcagtccctgtcggtacttcctaccctttagagttaattttancgtcttaagtcgacttaccggcgggttcccaccgacggttcctaccgggtaagggaacgggtactggtaaacgttagtcgtaccgtagtaaacgggttattaaggaaagttaacgtgtaaaccgtaaagtaacctaattaagtaactttagtaacgtactaaaccttgtagtaaggaaccgggtacatagtacctaacctaacgttacccaacggtacggtaaccgttaaaccaaccgaactaaacgtacgtaccgtttaagttaaccttacgttaaccgaaaggtccggaacgtaccgtacgtacgaaacgggtctacgggtaaagaccggtaagtcccgtagttaacttagttaccgttacgtaagggtacgggacggtaagacgggaacggtttacggtaagggttacgtacgggggtttaggccgggtaaggaaccgggg

SEQ ID NO: 268932 - DNA, 705 bp, Homo sapiens
  misc_feature: GYAE6OF02HAUQJ.28.57.F02.1.454.CMB.1.raw
  modified_base (176)..(176): a, c, t, g, unknown or other
  misc_feature (176)..(176): n is a, c, g, or t
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (386)..(386): a, c, t, g, unknown or other
  misc_feature (386)..(386): n is a, c, g, or t
  modified_base (464)..(464): a, c, t, g, unknown or other
  misc_feature (464)..(464): n is a, c, g, or t
  modified_base (511)..(511): a, c, t, g, unknown or other
  misc_feature (511)..(511): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtntccagtgtgaggtgcagctggtggagtcgtgggggaggcgttggtccaggccgtcggggggtccctgagactctcctgngcagcctctggtacttcaccttnaagttatttatgcttatcgcacgtcgggtccgccggacggcctccggaaggggaagggtacgtaggtaactagtcgtcctacgtaaggttaattaaggtaagtaaagnggtaactaaaacgttaaactaatttaacgttaattaacgtacgtaacctaaacgttcgttaggtacgggaacgggtanaagtcttaccaacgtctaccgaccggtaaggaccttaataaccgaanacccgacgttcgtaacgtacttacgttaacaaacggtgggacctacggtaccgaggtacggtaagtcggtaacgggaccggtaacacccggttatcgttatttaacgttacggtcggggtaggttaacggggaacggacggttacggtaagttacggggtaccgttagggggttacggcggggtaacgtcgggg

SEQ ID NO: 268933 - DNA, 849 bp, Homo sapiens
  misc_feature: GYAE6OF02JEW3K.28.57.F02.1.454.CMB.1.raw
tcagagtacgctatcacgaccggtgctcgatttagctcgatatagttgggttcgtgggagaggagcccccgccctgggtttcccaggtgttctcatttggtgactcagcactgcacacagaagagtcatgacggagtttgggctgagtcgtgggttttccttgttgcttaatttttaaaggtcgtccagtcgtgtaggttcgcgagcgtgggtacgggaggtcggtgggggaggtcgttcggtcccaggccgttcgggggggttcccctaggacgtaacgttccgttccgttggttgaccgtacggtccttacgtgggttactttccaaccctttcgtagttaattttaacgcgtaccgttaatcggtacctacggttacgggttcccgaccgtaacggtccttacccggaaggggtaaccgggaacgttgggtaactacgttaggttcctacgttaagggttagttaagtaaaggtagttacgaacgttaaataacgaatttaggtattaacgtacgtaactaacgttcgtaggtacggtaaacgtcaaggttaactccgtacgtacttaccggacctaaggtaactaaaccgtaccggtaaactaacgaccttagttcgtaacttgttaacgtaaagccggggtactacggtacccgtaagacgggtaacgacgggtttaacggaaggtaaccggtaaccgggttctaaaggtttttacccgaaaggttttacccggtaggggttaacgggtacggggtaaaccggggtaggttaacgggtttacggttaacggggtaaccgggttacgggggtttacggggtacccggggtaggtaaccccggggg

SEQ ID NO: 268934 - DNA, 822 bp, Homo sapiens
  misc_feature: GYAE6OF02H6ES7.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgaggtcgttgggtttttccttgttgcttaatttttaaaggtgtccagtgtgaggtgcagctgggtggagtcggtggggggaggtcgttgggtccaggtccggttcgggggggttccctggaacgtaccgtccgttccgtggtcgtccgacggtcccttcgtaggtacttcctaaccttttctaaggttattttacgtctcttactgaccgtacggttccgggtccgcccgaggtcctaccggaaggggaacgggtactaggaattgtacgtactacggtaggttaagttaaggtaaagtaagtacggaacgttaaaactaacttaagttaaatttaactttaagtaacgaaaccctttaaaacgttcggttaggaacggggaaacgggtaacgtaacgggttaacttacccaacccttaccgttaccgtaacccgggtaaacggaaacttaaaccttaaacccgaaacgtaaccgtaacgtacgtttacgtaactttacgtaaacgtaacgggtacggcgtaaccgtcgtagtacggacgtacggtacgggaacgacggacggttacgttacgtacgttacttacggtaaggggtaacgggagggaacggtacgggtaacgggttaggtaacgggttaacgggtttaggggttcgggttaccggggacggtaaccgggg

SEQ ID NO: 268935 - DNA, 782 bp, Homo sapiens
  misc_feature: GYAE6OF02FPCNY.28.57.F02.1.454.CMB.1.raw
  modified_base (498)..(498): a, c, t, g, unknown or other
  misc_feature (498)..(498): n is a, c, g, or t
  modified_base (534)..(534): a, c, t, g, unknown or other
  misc_feature (534)..(534): n is a, c, g, or t
  modified_base (618)..(618): a, c, t, g, unknown or other
  misc_feature (618)..(618): n is a, c, g, or t
tcagagtacgctatcacgaccggtgctcgatttagctcgatatagttgggtctgggagaggagccccccgccctgggtttccccaggtgttctcactttggtgatcagcactgcacacagaagagtcatgacggagtttgggctgagcttgggtttttccttgttgtcttaagtttttaaaggtcgtccagtgtaggaggtgcagtcgtggtgggtagtcggtggggggagtcgttcggtccgacggcccgggttcggggggttacccctggacgtaccttcctcctggtagccaacgtcccttacgtggacctttaccacctttgtaagtttaatttactcgtaccttagtcgtaacgtccggttccgggtcccggtccgtaacggtccgttaccggaaggggtaacggtacgtaggtaactcggttcgtaccgtaggtaaggtttaacgtaagtaaaggtactacggaacgtaaactaactaagttattaacttanaaccgtactaacgttaggtacggtaagggaccgganagttacctacctaaccgtaccttccgtaaccggaaggttaacctaaacacgaaacccggactaccgtagtccttattaccgtanaaccgtagggtaccacgtacgttaggaaccgtaaggtcgtaaccggggacctacgggtagtatttaccgttataccggtggtaagggtacgggaagggtaccggtaaggttaaggttaccggtaaagggttcgggttacgggtacggggtgacccgggtaccgg

SEQ ID NO: 268936 - DNA, 663 bp, Homo sapiens
  misc_feature: GYAE6OF02FO3J8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgtgctattttaaaggtgtccagtgtgaggtgcagctggtggagtcgtgggggagcttggtccagccgtgggggtccctgagactctcctgtgcagcctctggattcaccttcagttatttatgacttatgcacgttcgggtccgaccgaggcctaccggaaggggagggtaccgtagggaacttacgtggttactcgaacggttattaagaagttaagtcgacgtaaataaaccgatttaagttaattaagtcgaactaaaacttcgtaggtaggaacgggtacaaggtattaccaacgtactcgttacgaacgggtaactaacgttaaccaaacggaactacgacgttagtacttacgttacaacggttaggacgtacgtaccgtagaacgtgtacctagggaacgacgtacggtactaggttataacgtaccggtggtaagggacggtaaggtaggacgggttaactgggaacggttaggggtacggtcgggtacggtacgggg

SEQ ID NO: 268937 - DNA, 676 bp, Homo sapiens
  misc_feature: GYAE6OF02GIKQC.28.57.F02.1.454.CMB.1.raw
  modified_base (192)..(192): a, c, t, g, unknown or other
  misc_feature (192)..(192): n is a, c, g, or t
  modified_base (545)..(545): a, c, t, g, unknown or other
  misc_feature (545)..(545): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttcctgttgctattttaaaggtgtccagtgtgaggtgcagntgggtggagtcgtgggggaggtctttggtccaggccgtggggggtccctagagacctctccgtgtcgcagcctcgtggtacttcaccctttcagttattttatgtctatgctagtcgggtcccgctaggcctaccggaggggaacgggacgttgggaaacttagtgtccgtacggaggttattaaaggaattaagtgacgtaaataacgtattatttaattgtatactaaaacttgtaggttaggaagggactgacttcacctatcgtacccgaagggtaacctaaacttaccaacggaaccgccgtagttaacgttactacttaaacgaacggtacggaccgacgttaccgngagtacgcggtaacgacggccgtacgtcgtaagtttacgttacggtttacgtggggtaagggagggaaggtaccggtagggttacggtacggttaacgggttggggtaccgggtacgggtaccggacgggg

SEQ ID NO: 268938 - DNA, 986 bp, Homo sapiens
  misc_feature: GYAE6OF02H9KC0.28.57.F02.1.454.CMB.1.raw
  modified_base (125)..(125): a, c, t, g, unknown or other
  misc_feature (125)..(125): n is a, c, g, or t
  modified_base (201)..(201): a, c, t, g, unknown or other
  misc_feature (201)..(201): n is a, c, g, or t
tcagagtacgctatcacgaccggtgctcgatttagctcgatatagttgggtctggagaggagccccccgccctgggtttcccaggtgttctctatttggtgatcagcactgcacacagaagagtnatgacggagtttgggctgagcttgggttttccttgttgtcttaatttttaaagggtgttccgtagtggtggaggtnccgagctgggtggaggttcggtgggggaggtccgttggtccgaggtccggtcggggggtccctaggagacctctccgtgtcgcgacgtccctgtacggtattccctaccgttagtagttactttagtcgtactacgtacgtaccgtaccggttaccggggtcccgaacccggtaccggttacccggttaaccggggaaacggggggtaaacgggttaaccgttaaggggttaaaacttacgtttaccgggttaccgttaacgggtttaaagggtttaactttaaaaagggaaaaaggttttaacggtaaccggtaaaacgttaaaaacttaaacgtaaagttttaaaatttaaagttttaaaaccggtaaaacgtttaaccctaagttaacggggtaaagggttaaccgggaacttacgtaaacccgttaacccgtaaacccgttacctttaacccggttaacccggaaacgggttaaaacccttaaaaccgtaaaccccggaaaaacgttaaacccggttaaaccggttaccgtttaacgttttaaaccctttaaccgtaaacggtttaaacgggtacccgggaaccttaaccgggtaaccggtaggaacggtacggtaccgtaaccgggtaaccgggtaccgtaaacggtacgtttagttaaacgttacggtttaacggtaggggttacgggaaaggtacggggaaggttaacgtaaggggttaacgggtaaccggggttggtttacccggggaacgggttaccgggaccgggttacccgggg

SEQ ID NO: 268939 - DNA, 786 bp, Homo sapiens
  misc_feature: GYAE6OF02IE2D9.28.57.F02.1.454.CMB.1.raw
  modified_base (181)..(181): a, c, t, g, unknown or other
  misc_feature (181)..(181): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctagttttaaaggtgtccngtgtgaggtgcagctggtgggagtcgtgggggaggtcgttgggtccgagccggtcggggggtcccttggagactccgtcctgtcgccacgcctcgtggtacttctacctttcagttatttatgtctagtgacctacgtacgggtccgtacccgtacggcccgttaccggaagggggtaaacggggtaacgtacgggtaaattaagttacgttcgttacgtaagggttaactttaaggtaaagttaagtggtaacggtaaataaactaagttaattacgttatacggtactaactcgtgtaggaacggtacgagtctacctacctagtccctacgaggaacgtacgtaacaagaaaccgcgtaacgttagttaattaacccttagtaaacggtcgggaacctacggtaccggttacggaacgttacgggtaccgtagggttaccggacgggtaacgggtaccgtttagggttaactttaacggtttaacggggttgggtaacgggaacggggtaacgggttaaccggggtaacgggtttaaacggttccggggttaaaacgggttaaggggggtttcgggttaccgggggggtacgtaacgggggg

SEQ ID NO: 268940 - DNA, 747 bp, Homo sapiens
  misc_feature: GYAE6OF02HXTUI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagcgtggtggagtcggtggggggaggtcgttcgggtccaggtcccggttggggggggttcccctggacggacctcttcccgtggtcgcgacgtccctcgtggtactttcctacccttactagttaattttagtgtacttatcgcgtacgttcggggtacccgcccgacggcccgttaccggaaggggaacggggaccgtaggaattaagttcgtaccgttacgtaaggttaagttaaggaaagttaagtagacgtaaataactaattaataattagtagaactaaactcgtaggtaaggagggactagtataccacctacgtccgtaccgaaggtaacctaacgtaaccaaacgaaccacgttacgtagttactaccgttaacaaggtcggacgtacgtaccgaggacgtagtcggtaacggaacggacgacggtacgttagttacgttaagttaccgggtaggtacggggaagggtaggtacggtaaccggttaagggttacgggttaaacgggttacggggttacggggttacggggtacccgggtaacgggg

SEQ ID NO: 268941 - DNA, 849 bp, Homo sapiens
  misc_feature: GYAE6OF02JIY5G.28.57.F02.1.454.CMB.1.raw
  modified_base (776)..(776): a, c, t, g, unknown or other
  misc_feature (776)..(776): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctcggagtcttcgggtttttccttgttcgtctttaagtttttaaaggtcgtcctaggtgttaggtaggtgcaggtcgtgggtggtacggttcgggtgggggtacgttccgttcgggttacccacgggtccgggttcgggggtccctggtaacgtccgttccgtcgtggtcgaccgtacgtcccttaggtacggtaaccttcccgtaccgttacgtacggtttaactttcgtacgtacttgtaccggtcccgtaaccgggttccgggtacccgccggttaacggcccgttaaccgggaaccggggtaacggtaccgttaggtaacgttccgttacggttaaccgttagtaacggtttaagttaaacggtaacgtaacgtacgaaacgttaacgtaaatagtttaacttacgtacgtaccgtaacgtacgtttacggtaggtaaccggtacgtaacgttaacgtacctacccgaaccgttctaacgggtaccgtaaacggtactaaaccgtaccgtaaacgtaccgtacgttacgttaaccgttacttaacccgtaaggtacccgtcgaacgttaccgagttacgaaccgtagtaacgaccgggtagtaccgttagttacgtaccgttaggttacgngggaaggttaacggacggtaacggaggttaacgtggttaaccggtcggttacggtcgggtaccgtaacgggcg

SEQ ID NO: 268942 - DNA, 860 bp, Homo sapiens
  misc_feature: GYAE6OF02G59GM.28.57.F02.1.454.CMB.1.raw
  modified_base (143)..(143): a, c, t, g, unknown or other
  misc_feature (143)..(143): n is a, c, g, or t
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
  modified_base (676)..(676): a, c, t, g, unknown or other
  misc_feature (676)..(676): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggctgancttggttttccttgttgcttaattttaaaggtgtcagtgtgaggtgcagntggtggagtcgngggggtgtcgttggtaccgagtccggtcgggggtccctgacgtactctccgtgtgcacgtcctcgtcggtattcctaccttcgtagtttatttatgacgttagtcgacgtcggtcgggtacccgacgtacggtccgtaccggaacgggggtaacggggtacgttaagggaaagtttacgttacggttacccgttacggttaaagggtttaagtttaaaaggttaaaaggttaaacgtacggtaaaccgtaaaaacgtttaaactaaagtttaaattttaaagtttaaacggttacgtaaacccgttaaaacgtttacggtaccgggttaaaggggaacgggttaacggtaaagttaccctttaccccaaacccttaacgggtccccttaaaccgggaacgggtaaaccctttaaccgtaaaccggaaaccgtaacccgtaacgttccgtttacgtaacgttaaccgttaanaaaccgggttcggaaccctcggtaccgtaaggaaccctggtaaccgtacggaaacgtaccggtacggtaagttattaacggttacctttagggggtaccggaagggaggtaaccggttaagggtacggtttaagggttaggttaacggggttcggggttacggaacccgggggtgtaaccgggg

SEQ ID NO: 268943 - DNA, 763 bp, Homo sapiens
  misc_feature: GYAE6OF02FLR3X.28.57.F02.1.454.CMB.1.raw
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgttggggggtccctgagtacctctccgtgtagcagtccgtcgtggtacttccgtaccttcagttatttatgacctagtgactacgttcgggtacccgaccgaggcctaccggaaggggaacggtacgtggtaattacgtgtctacgtaggttaattaagaagtaatgacgtaataacataatattagtagactaaacgtcgtaggtacgaagggcaacgtcttaccacctagtaccctaccggaagggtacctaacgttaccgaaaacgaccgtaaccggttcttaggttaacttaccttaagaaacggtacgggtaccaaccggtacccgtagggtaacgtacggtccggtaacgggtaaccggtaacggaaccgggttacgttaaggtttacttaacggttacccgggttttagggaagggggtaacggaaacgggggttaccggtaaacgggtttacgggtttaacgggtaaacccggggttttaacgggggttacgggggtacccgggggtaacccggttaacccgggggg

SEQ ID NO: 268944 - DNA, 811 bp, Homo sapiens
  misc_feature: GYAE6OF02I29NB.28.57.F02.1.454.CMB.1.raw
  modified_base (363)..(363): a, c, t, g, unknown or other
  misc_feature (363)..(363): n is a, c, g, or t
  modified_base (525)..(525): a, c, t, g, unknown or other
  misc_feature (525)..(525): n is a, c, g, or t
  modified_base (678)..(678): a, c, t, g, unknown or other
  misc_feature (678)..(678): n is a, c, g, or t
  modified_base (706)..(706): a, c, t, g, unknown or other
  misc_feature (706)..(706): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttggggctgagtcgttgggtttttccttgttgtcttaagttttttaaaagggtgtcccagttgtgagggtgacgagtcgtgggtgggtagtcggtgggggggaggtcgtttggtcccaggtcccgggttggggggggtccccttggaggtaccttcctcccgttggtcgccacgtcccgttcgtaggtcttaccgtaccttttccaaggtttattttagtgacttacngttccgtacggttccgggtcccacccggcggtccgttaccgggaagggggggtaaacgggtaccggtaagggtaattagttacggttcctacggtaaggttaagttaaacggtaaagtaagttagaaaccggtaaattaaactattaacgtatttaacggtntaaacctaacgttcgttaaggtaacggaaggtacgttaagacttaccaacctaccgtacgtaccggaacgtaactaaccgttaaacgaaaccgtactaacgtacgttaacgtttctaacgtttaaagtaacggtccgggaaactccggttaangggactaggacgtaaggtacggtaccgnggtacctttagtatttacggtttaggacgggttagggaagtgggaacggtttaggttagggttaacgggtagggttaaggggttgggccgggtacgggtaccggg

SEQ ID NO: 268945 - DNA, 693 bp, Homo sapiens
  misc_feature: GYAE6OF02FZT86.28.57.F02.1.454.CMB.1.raw
  modified_base (147)..(147): a, c, t, g, unknown or other
  misc_feature (147)..(147): n is a, c, g, or t
  modified_base (210)..(210): a, c, t, g, unknown or other
  misc_feature (210)..(210): n is a, c, g, or t
  modified_base (269)..(269): a, c, t, g, unknown or other
  misc_feature (269)..(269): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagtntgggttttccttggttgcttaatttttaaaggtgtccagtgtggaggtgcagcgtggtacggngtcgtgggggagcttggtaccaggccggtcggggggtccctaggacgtactctccttgngcgagcctcgtgattccaaccttcaagttatttctgcgtatggtactacggtcgggttccgaccgtagggcccttaccggaagggtaaacgggcgtaacggaagttaacgtcggtccgtaataaggggttattaggtaaattacgtacgacgtaaataacatactttatactaggacaagtcgtattacggaggtacgatcgtttacaacgtacgacttacaagggactaacgttaccgaaaataccggaactacgtacgtaattcctaacgttaacgnggaacncgtaacgtgaactcggacgttagaccgtagacggttacgttacgtgttaacttacggttggtaacgggtaagtagggaacggtaagtacgggttaggttaaacggtttacggggttaggttccgggaaggtaaccgggg

SEQ ID NO: 268946 - DNA, 808 bp, Homo sapiens
  misc_feature: GYAE6OF02I0OLU.28.57.F02.1.454.CMB.1.raw
  modified_base (708)..(708): a, c, t, g, unknown or other
  misc_feature (708)..(708): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagtcgttgggtttttccttgttgacttaagtttttaaaggtcgtccagtgtgaggtgcagtcgtggtgggagttcggtgggggaggtcgttacgggtcccgaggtccgggtttcgggggggtcccctggaacggtaccttccttccgttggtacgtaccgacggtccccttcggttaggtaaccgtttcctacccgttttacgaacggttttattttacgcgtacgttaacgttcggaccgtaccggtcgggggttccccaccggtaacggtacccgttacccggggaaagggggtaaacggtaccgttaagggtaaattacggttcgtaccgttcggtaacggtttagttaaacgtaaagttaagtccggaacgtaaaacttaaactaagttaatttaatagtaccgtaaactaacgttcgtaagggtacggtaagacgtaacgtcttaaccgacttaacgtccgtaacgtaggtaacctaactaagaaaccgtacacgtgttacgtcttactaagaacggtcgactacgtacaggagccgtacgagaaccgtcgtaacggtnttaacgtattaacggttacggttgggaaccggtggaaacggacgttaggttaacgggttaacggttagggtacgggtttagggccgggtaacggtacggg

SEQ ID NO: 268947 - DNA, 788 bp, Homo sapiens
  misc_feature: GYAE6OF02I7QJF.28.57.F02.1.454.CMB.1.raw
  modified_base (716)..(716): a, c, t, g, unknown or other
  misc_feature (716)..(716): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagcgtgggttttccttgttgctattttaaaggtgtccagtgtgaggtgcagctggtggagtcgtgggggaggcttgggtccagccgtggggggtcccttgacgactcctccgtgtgcacgtcctcgtggattcaccttcgagttatttactgctagtcgctacgttcgggtccgtaccgacggtccttaccggaaggggtaacggggaccttagggaactttacgtgttacctacggtagggtttaacgttaaggtaaacggttaagtacggaacgtaaacttaaactatttaatttaacttaacgtcgtaaacctaaagttcgttagggaacggtaagggctaacggtacttacccgaaacccgtacttacccggttaccggaaacgggtaaccttaaacgttacccgaaaacggtacctaaccgggtactttaccggttaaatttcccttaaacggttaaacggtcgggaaaccctacggaccggttaggaacggttcgaacgggttcggaacgggaaccgttacggtaacgtttacgttatttaccggttaacggtgggtaacgggacgngggtaacgaacgggtttacgtttacgggaaccggtttagggggttacggttccgggggacgttacccggggg

SEQ ID NO: 268948 - DNA, 657 bp, Homo sapiens
  misc_feature: GYAE6OF02F4YNI.28.57.F02.1.454.CMB.1.raw
  modified_base (379)..(380): a, c, t, g, unknown or other
  misc_feature (379)..(380): n is a, c, g, or t
  modified_base (388)..(388): a, c, t, g, unknown or other
  misc_feature (388)..(388): n is a, c, g, or t
  modified_base (575)..(575): a, c, t, g, unknown or other
  misc_feature (575)..(575): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttgggtccagcccgtggggggtccctgagactctcctgtgcacgcctctggacttccacctttcagttatttatgtctatgcacgtcgggtcccgcagggcctccgaggggaacggctaggatatgtctcgagtacttagaagtatgagaataacatataattannactaactntaggaggaagggcagtacttaccgactacgtcctacgacgggtaactaacgttaccgaaacgaaactcgtagttacgttacttacgtacgaaagtcggggacaggtccgtaggaacgttacggcgtagggaccgaaccggacgtcgttacgttaacttagttacggtcgggttaaggggaaacgggngggtaaaccggtaaccgggtttaagttaacgggttaaccgggttaggggtttcggggttaccgggggacggtaacccggggg

SEQ ID NO: 268949 - DNA, 827 bp, Homo sapiens
  misc_feature: GYAE6OF02FNYY3.28.57.F02.1.454.CMB.1.raw
  modified_base (300)..(300): a, c, t, g, unknown or other
  misc_feature (300)..(300): n is a, c, g, or t
tcagagtacgctatcacgaccggtgctcgatttagctcgatatagttgggtctgggagaggagccccccgccctgggtttccccaggtgttctcatttggtgatcagcactgcacacagaagagtcatgacggagtttgggctgagctgggttttccttgttgctatttttaaaggtgtccagtgtgaggtgcagcgtggtggagtcgtggggggaggtcttggtccaggccggttggggggtcccctggacgacctccgtccgtggtcgcgacgtccctcgtggtacttcctacccttnagtttaattttagtcgtacttagtcgtaccgtaccgttcggggtccccgaccgacggggtccctccgggaacgggggaacgggacgttaaggggaaatttacgttggttacccgtacggttaaggttaagtttaaaggtaaacggttaaagttcggaaacggttaaaactttaaaaccgtaatttaacgttttaaattaacggtactaaacccgttaaaacgtttccgttagggtaacggggtaacggactaagtaccgttaacctaccctacgttaccctaaccggaacgggtaaacctaaacgttacccaaacgtaaaccgaccgttacttagttaacgtttaccttaccgtaaaaggtccgggaactacggcgtaacgacggtacggtcgttaggaacggtacgaccggtcgttaacgttagttagttaaccggttggggaacgggtaagggtaacgggtaaccgggtaggtttaacggtacggttaagggttacggggttgggttacgggacgggtaacgggg

SEQ ID NO: 268950 - DNA, 947 bp, Homo sapiens
  misc_feature: GYAE6OF02I68BW.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgtgggttttccttgttgcttaagtttttaaaggtgtccagtgtgaggtgcagcgtggtggagtcgtgggggagtcttggtccaggtccggtcggggggtccctggacgacctccgtcctgtgcacgcctcgtggtacttctaccttacgtagttactttagtcttacgttacgtgtaccgtaccgttcgggtacccggaccgtaccgggtacccttaccgggaagggggtaaccgggtaacgttagggtaaatttacggttagttacccgttacggtaacgggtttaagtttaaacggtaaagttaacgtaggtaacgtaaaacgtttaaacgtaactttaagtttaaattaacggttacgtaaaccttaaacggtttacgtagggtaaacgggaacgggtacgaacggtttaaccttacccgaaaccgttacgttcccggttaaccggaaaccgggaacctttaaaacccggttaaccgaaaacccggtaacccgtaaccgggttctttaaaccgttacgtttttaaccccgtaaaaggtaaacgggttcggggtaaacccgtaccgttaaccggttaacgggtaacgaaacgggttccgaaacggggtttaacccgggaaccggttaaccggttaacgttttgggttaaaacctttacgggtttaacggtacgggggtaaacgggttaggggtaaaccgggttaccgggtaaaacggggttttacggttaaaccggggggttaggttttaacccgggggggttcggggttaaccggggtaacccggtaacccggggggg

SEQ ID NO: 268951 - DNA, 803 bp, Homo sapiens
  misc_feature: GYAE6OF02HHEQX.28.57.F02.1.454.CMB.1.raw
  modified_base (581)..(581): a, c, t, g, unknown or other
  misc_feature (581)..(581): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagcgtggtggagtcgtgggggagtcttcggtccagccggtcggggggtccctgagtactcctcctgtgcacgtcctgtggtctttccgaccctttctaagttttatttagtcgtccttaatcgacctaccgttcggggtcccgaccgtacgggtccttcccgggaaggggggtaacgggtaccgttagggtaactttagttacggtccttaacggtaagggtttaagttaaaggaaaaggtttacggtacgtaacgtaaaattaacgtaatttattaaacgttttagacgtaactaaacggttcgtagggtagggtaacgggtacgtaatacctttaccgaactacgttcccctacggacggaaacttaacggtaacccaaggtaaccnccgttactagtacccttagtaactaaggtgggactaaccggtacgtcggtaagccgggtttaacgacggggtacgaccggttaacgtacgtttactaggtttaacgtttaggttcgggaaggggggtaacggtgggtaaacccggtggtttaaacgggtttaccgggtaaacggggtttacgggggtttggggggtaaccccggggtgggtaaacccggggg

SEQ ID NO: 268952 - DNA, 612 bp, Homo sapiens
  misc_feature: GYAE6OF02HL1DW.28.57.F02.1.454.CMB.1.raw
  modified_base (495)..(495): a, c, t, g, unknown or other
  misc_feature (495)..(495): n is a, c, g, or t
  modified_base (564)..(564): a, c, t, g, unknown or other
  misc_feature (564)..(564): n is a, c, g, or t
  modified_base (573)..(573): a, c, t, g, unknown or other
  misc_feature (573)..(573): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctgggggggtaccctgagactctcctgtgcagcctctggacttcgaccttcagttatttagtgctatgctactgggtccgcaggccttccgaggggaagggacctgggaatagttgtctcgaggttattaaggaacgttatggacgtaaataaacctatagtaacttatagtacaaacttctgtagaagggtcaaggtatttacccgaacttacgtcccgtacgaagggactaaacttccgaaaagtaccgacgtacttagtacttccttanaaacgttcggggacacgtacccgtgaacgggtcacgttggaacgtacgacgactgtaatgttacgtggnggtagaggngtagggtactggaacgttggggttgtcgggacctagggg

SEQ ID NO: 268953 - DNA, 844 bp, Homo sapiens
  misc_feature: GYAE6OF02GHXT5.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggtttttccttgttgtcttaagtttttaaaggtgtcctagtgtgaggtgcagctggtggagtcgtgggggagcgttggtccagccgtgggggtccctggacgctctccgtgtcgcacgcctcgtggacttccaccttcgaagttatttagtgtactagtcgaccgtacggtcgggtcccgccgacggccgtaccggaaggggtaacggacgtaggtaaattaggttcgtaccgttacggtaaggttaattaaggtaaacggttaatacggaaccggtaaaattaaactaagtttaaatttaactttaacgtacgtaaaccttaaaaccgttcgttaagggtaacggtaacggggtaacgtaacggttaacctttacccaaacccgtatttaccccggtaaacccggaaacgggtaaacccttaaaacgttaaccccggaaaacgtaaaccgtacccgtacgtttacgttaaccttaccttaaacgaaacggttccgggtaacctaacccggtagttaaccggaacggttaccgtacggtacggtaaccggaaaccggttccggacgttttaagtactttaaacgggtttcggtggggttaaggaacggggtaacggtaccggttaaagggttaacggttaaggggttaaccggtttagggggtaccgggttacgggggacccgttaaccgggggg

SEQ ID NO: 268954 - DNA, 602 bp, Homo sapiens
  misc_feature: GYAE6OF02IYW5D.28.57.F02.1.454.CMB.1.raw
  modified_base (184)..(184): a, c, t, g, unknown or other
  misc_feature (184)..(184): n is a, c, g, or t
  modified_base (191)..(191): a, c, t, g, unknown or other
  misc_feature (191)..(191): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (441)..(441): a, c, t, g, unknown or other
  misc_feature (441)..(441): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggttttcttgttgctattttaagtgtcagtgtgagtgnagctggnggagtctgggggagcgtgtccgagtccgtggggggtccctgacgactctcctggtgcagcctcgtgtacttcactcgagtatttangctatgnactggccnccaggctcgagggacgtacgngaactagtcgtctgaggttacagtaagtactgacgtaaataacnttaatacgttaatcggtacaaaactcgtagngaaggnaacggtnttaccgaactatactagaggtaacacgtacaacgtaaacncgtactacgtacgtacttacgtaagtagggactaagtacctaggtacgaacgtacgtaagggtaccgtaaacgaggttaccgtagtacgttaataccgtaggtacggaaggtacgaggtacgtagttacgtaaccggtaggttacggtacggagtaacggg

SEQ ID NO: 268955 - DNA, 721 bp, Homo sapiens
  misc_feature: GYAE6OF02H1KW8.28.57.F02.1.454.CMB.1.raw
  modified_base (360)..(360): a, c, t, g, unknown or other
  misc_feature (360)..(360): n is a, c, g, or t
  modified_base (431)..(431): a, c, t, g, unknown or other
  misc_feature (431)..(431): n is a, c, g, or t
  modified_base (664)..(664): a, c, t, g, unknown or other
  misc_feature (664)..(664): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggttttccttgttgtcttaagtttttaaaggtgtccagtgtgtaggtgcagtcgtggtggagtcgtggggggagtcttcggtccacggtccggtcggggggttacccctggacgtacttcctaccgtggtcgctacgtccctattggtactttacccaccgtttacgtagtttatttagtcgtcttaagtcgcgtaccggttcgggtccnccgtacggccgtaccggaaggggtacgtactaggtaattagttcgtactgttaagtagtaaggaaagttancggtaactaaataactagttaattaagtagtacaacttaacgtctacggtaggaacgggtactagtactaacccacttccgtaccgccggaaacgtacctaaacgttaccaaacggttaccaccggttacttacgtttaacgttacctaaggtaacgttcggaactaaccggccgttaaggacgttagacgtacggacgtaccgaggtacgtagttactacgttcggtaaggnggtaacgggagtacgtaggtagtacgggtagttagggtcggttccgggataaccggg

SEQ ID NO: 268956 - DNA, 836 bp, Homo sapiens
  misc_feature: GYAE6OF02GGB5S.28.57.F02.1.454.CMB.1.raw
tcagagtacgctatcacgaccggtgctcgatttagctcgatatagttggggtctgggagaggagcccccgccctgggtttcccaggtgttctcatttggtgatcagcactgcacacagaagagtcatgacggagtttgggctgagcgttgggttttccgtgttgcttattttaaagggcgtcctagtgtggaggtgcaggtcgtggtcggagttcggtgggggtacgtcgttggtccaggtcccgggtcgggggtaccctgacggtacttccgtaccgtgtacgcgtaacgccttgaggtacttacctaccgttacgaagtttactttagtcgtacttagtcgtacgtaccggttcgggtaccccgccgtaagggtaccccttaaccggggaacggggttaacgggtacgtaagtaacgtttaggtcgttaccgtaacgttaagggttaacttaaggaaacgggttaactaggtaaaccgtaaaacgtaacgttaactaaagttttataaagtaccgtaaactaaacgtcggttaggaaacggtaacggtactaacgggtacttacccgtaactaccgtccggttaaaccggaaggttaaccgtaaacgttaaccggaaacgaacccgttagaacctaggtttaaccaacttaacgaaacggtcgtacgtactaacggtagacgtaacgtcgtaagggtaacggacgtaccggagttaccgtacgttaaccggttaggtaacggttaccgggtaaagggtacggtaacggttaacggttaacggtaccgggttaaagggttcggggtttaacggggaccgggtaccggtaacgggg

SEQ ID NO: 268957 - DNA, 728 bp, Homo sapiens
  misc_feature: GYAE6OF02FRHV5.28.57.F02.1.454.CMB.1.raw
tcagagtacgctatcacgaccggtgctcgatttagctcgatatagttgggtctgggagaggagcccccgcccctgggtttccccaggtgttctcatttggtgatcagcactgcacacagaagagtcatgacgggagtttggggctgagctgggttttccttgttgctatttttaaggtgtccagtgtgaggtgcagctggtggagtcgtgggggaggcttggtccagccgtggggggtccctgagactctcctgtgcagcctctggacttcaccttcagttaatttatgtctatggctacgtcgggtcccgccgacggcctccgagggggaacgggacgtaggaatagtgttctcgaggttaattaagaagtaagtggacgaaataacattaataagttatagaacgtaaactcgttaggtaggaacgggactaggtactttaccgaaccctcttacccggtacccggaacgggtaacctaaacgttacccgaaaacgtaaccaaccggttaccttaggttaaccttccgttaaaccgtaaacggtccgggtacgaccggtaccgtaggaaccgtacggaccgtagggtaaccggaaccgtacggggtccgttagttaagttacgtttacggttagggtaccggggagggtaacggggtagggtacggtaaagggttacggtaaacggggttacgggttggggttaccggggtacgggtaaccggggg

SEQ ID NO: 268958 - DNA, 681 bp, Homo sapiens
  misc_feature: GYAE6OF02GH1GL.28.57.F02.1.454.CMB.1.raw
  modified_base (606)..(606): a, c, t, g, unknown or other
  misc_feature (606)..(606): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagttgggctgagcgtggttttccttgttgctattttaaaggtgtcagtgtgagtgcagcgtggtggagtcgtgggggtaggcttggtccagccgtgggggtccctgagactcgtcctgtgcacgcctcgtggtattcctaccttacagttaattttagtcgtactacgtgtacgaaccggttcgggtacccggacccgtacggtacctacccggtaaggggaacggtacgttaggaagttacgtcgttacgtaccgtaaggttaagttaacggtaaacgttaagtacggaaccgtaaattaaacgattaagttattatacgtactaaactcgtagtaggacggtatagttactacgacctagtcccacgaaggaactactacgaaacgacgacgtctagttactacttacgaagtcggacacggtacgtagagtctacggtagacgaacgtcgtaacttgtactttagttacggnggtaccgggaagaagggttaacggaggttagttacgggtaaacggtttgggtaacgggtcgggaccggtaacggg

SEQ ID NO: 268959 - DNA, 844 bp, Homo sapiens
  misc_feature: GYAE6OF02GWRLP.28.57.F02.1.454.CMB.1.raw
  modified_base (737)..(737): a, c, t, g, unknown or other
  misc_feature (737)..(737): n is a, c, g, or t
  modified_base (758)..(758): a, c, t, g, unknown or other
  misc_feature (758)..(758): n is a, c, g, or t
  modified_base (836)..(836): a, c, t, g, unknown or other
  misc_feature (836)..(836): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgtgggttttccttgttgcttatttttaaaggtgtccagtgtgaggtgcagcgtggtggagtcggtagggggaggtcgttacgggtccgaggtccggtgggggggttccccttggaacggtaccttccgtccgttcggtacggccgtacgtcccgttacgttcgggtaacttccgtacccgtttacgtaacgtttaaattttacgtcggtacttacgtcgtaccgtccggttccgggtacccgacccgggtaacggtcccgtccgggaaacggggtaacggggtaccgttaagggtaattacgttacggttaccggttacggtaagggttaaccgtttaaagggtaacgttaaaggtacgtaaacgtaaacgttaaactaagttaagtttaaactttaggtaaacgtaacccgtaaacgtttacggtagggttaaacgggacgggtacgtaaacgttacgtttaccgaaacccgtaccgttaacgtaacccgggtaaacggtaaacctaaaccgttaaccaaaccgggtaacctaccggtacgttaccgttatttaacccgtagtaacggaccggtactaccgtacgtaagngacgtaccgagtaccgtacgngttaccgtatacgttataggtcggaaggtaggaacggtggtaaggtagtacggttacggttaacgggtgggaccgggnggtaccgg

SEQ ID NO: 268960 - DNA, 815 bp, Homo sapiens
  misc_feature: GYAE6OF02IAAXL.28.57.F02.1.454.CMB.1.raw
  modified_base (723)..(723): a, c, t, g, unknown or other
  misc_feature (723)..(723): n is a, c, g, or t
tcagagtacgctatcacgaccggtgctcgatttagctcgatatagttgggtctgggagaggagcccccgccctgggtttcccaggtgttctcatttggtgatcagcactgcacacagaagtagtcatggacggtaggttttgggctggagtcgttgggtttttccttgttgtcttaagttttttaaaggtcgttccaggttgttggagggttgacaggtcttgggtagggtacgttcggtggggggaggtcgttcggtaccgaggtcccggtcgggggggttaccctggacgtacctccgttccgttaggtcgctacggcccttcgtacggtattaccgtaccctttagacgtttaattttacgtcggtacttagtcgtacgtaaccggttcggttaccgcccgtaacggtccgttaccgggaaggggtaaccggtacgtaaggaaacttacggtacgttactacgtaaagggttactaaagggtaagttaaactacggtaaaccgtaaagttaacaacttaagttaattcgtagaacccttaacgtacggtaggaacggtcgaactacgttaaccacgtaccttactacggaacgtaactaccgtaaacgacggtaaccaacgttcgtactaacttctagttaacgtacggcctacgttagaacgtacggtacgtacgtacggtacgccggtaaacggtcgtagttaaacttcgttaacggnggttaagggtaccggtagtaacccggggtaagttaggtacggttaaacggtttcgggggttaaccggtggggttaacccgggtgtaaccggg

SEQ ID NO: 268961 - DNA, 665 bp, Homo sapiens
  misc_feature: GYAE6OF02I8YE5.28.57.F02.1.454.CMB.1.raw
  modified_base (480)..(480): a, c, t, g, unknown or other
  misc_feature (480)..(480): n is a, c, g, or t
  modified_base (600)..(600): a, c, t, g, unknown or other
  misc_feature (600)..(600): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttgggtccaggcctggggggtccctgagactcgtcctgtgcagcctcgtcggattccaccttcagttatttatggtacttatgcctacgtcggggtcccgaccacgggccttaccggaggggaacggggtctacggtaagttatgttacgtcgaagggtttaagttaaggaaaggttaattcggaacgtaaacgtaaactaagtttaattaatttactaggtacctaaagttctaggtaggaacgggctagtactttcgaacctntccgtacgaggtaactaaccgtacgaaacggaacctacgtacttgtaacttaccgttacaaacgtgggactaaccgtcgtacggagcgtacgtgaacggtcgaacggttatgttacgttntaagggtgtaacggaggtaggacgtaaggttagtgggaaacgttggggtggtacgggtgaacggg

SEQ ID NO: 268962 - DNA, 753 bp, Homo sapiens
  misc_feature: GYAE6OF02F831V.28.57.F02.1.454.CMB.1.raw
  modified_base (176)..(176): a, c, t, g, unknown or other
  misc_feature (176)..(176): n is a, c, g, or t
  modified_base (479)..(479): a, c, t, g, unknown or other
  misc_feature (479)..(479): n is a, c, g, or t
  modified_base (555)..(555): a, c, t, g, unknown or other
  misc_feature (555)..(555): n is a, c, g, or t
  modified_base (570)..(570): a, c, t, g, unknown or other
  misc_feature (570)..(570): n is a, c, g, or t
  modified_base (590)..(590): a, c, t, g, unknown or other
  misc_feature (590)..(590): n is a, c, g, or t
  modified_base (602)..(602): a, c, t, g, unknown or other
  misc_feature (602)..(602): n is a, c, g, or t
  modified_base (612)..(612): a, c, t, g, unknown or other
  misc_feature (612)..(612): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgcttatttttaaggngtcagtgtgaggtgcagcgtgggtggtagtcggtagggggaggtcgttggtccgaggtcccggtcgggggggttccctggaacgtaccttccgtccgtggttcgcacggtcccttcgtacggtactttccgaccctttagaacggtttatttacgtcgtaccttagtcgcgtaccgtcggggttccccgacgtacgggtcctaccgggaaaggggaacggtacgtaaggtaacgtacgttgtcctaaggtacgtttaagttaagaaattagcgtaacgtaaataacgtataattaactggtanaactaaacgtgtaggtaaggagtccgtaatacgtaccactcgtactaccggagaaacctcgtaaccgaaacaccgntaccgtagttacctntaacgtaagtcgagtaccgnacggtacacggngtaaaccggngaaacccggtaagtaccgtaagtttacgttaaacggttcggtgggtaaacggggtacggtaaaggtcggggtttaaaaccgtacggttaaccggggttaaagggttacggggtcggtaacgggggacccggttaaccgggg

SEQ ID NO: 268963 - DNA, 768 bp, Homo sapiens
  misc_feature: GYAE6OF02FUQUL.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtcgcagcctcgtggtattccaccttcagttatttatgtctagtgctacgtcgggtccgccagggtcctaccggaggggaacgggtacctagggtaacttagtgttcttacgtaagggttaagttaacggaaagttaaacgtcggaaccgtaaactttaaaccgtaattatttaagtttaacgtacggtaacctaaaaccgttcgtaggtaagggaacgggtcagtaacttaccaaccgtataccgtacccgaaggggaaccctaaacgttacccaaaggtaacccgtacggtacttacgttacttacccgttaacgtaaacgtcgggacctaggccgttaggacgtaaccgtcggtaacgggaaccggtacgaaccgggtactttacgggttacttaacgtttacggttcggggtacggggtaacggtaacggggtaacgttacggggtaaacggtttcggggaaaccggggttttaacggggggtacggttaccggggggtaccgtaaccggggggg

SEQ ID NO: 268964 - DNA, 759 bp, Homo sapiens
  misc_feature: GYAE6OF02IE7G1.28.57.F02.1.454.CMB.1.raw
  modified_base (367)..(367): a, c, t, g, unknown or other
  misc_feature (367)..(367): n is a, c, g, or t
  modified_base (647)..(647): a, c, t, g, unknown or other
  misc_feature (647)..(647): n is a, c, g, or t
  modified_base (698)..(698): a, c, t, g, unknown or other
  misc_feature (698)..(698): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctggagcgttgggttttccttgttgctttaattttttaaaggtcgtcctagttgtgagggtgcagcgtgggtaggagttcggtgggggagtcgttcggtccacggtccggttcgggggggtccccttaggacgtaccttccttccgtggtcgcacgtccctcgtgtacttcctaccttacgtagtttaattatcgacttatcgcgtacggttacggtccgacccggnggtccaccgggtaaggggaacgggtacgtggaaattagttcgtacgtacgtaaggttaacgttaaggtaaaggttaactaggaaacgttaaaactaacgttaaagttaacgttaaatttaccgaaacgtaactaaccttacgggtgggtaacgggtaaaacggtcgtaaacgttaccgttaccaaaccgtacttacccggtaacggtaacggtaaactaaccgtaaccgaaactaacccgacgttacgtacttacttaccgtaacgtacgtagggtaccncgtacgacgagacggtacgaggacgacgtacgtcgtattacgtcgttaggnggtagggaggaggtacgtagtaacggttagtacggttaggggtcggtacgggcggtacggg

SEQ ID NO: 268965 - DNA, 713 bp, Homo sapiens
  misc_feature: GYAE6OF02JCGTD.28.57.F02.1.454.CMB.1.raw
  modified_base (335)..(335): a, c, t, g, unknown or other
  misc_feature (335)..(335): n is a, c, g, or t
  modified_base (445)..(445): a, c, t, g, unknown or other
  misc_feature (445)..(445): n is a, c, g, or t
  modified_base (645)..(645): a, c, t, g, unknown or other
  misc_feature (645)..(645): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgcttatttttaaaggtgtccagtgtgaggtgcagcgtggtggagtcgtggggagtcttggtccgagtccggtcgggggtccctggacgtacctcgtcctggtcgactacgccgtcgtggtacttccgtacctttcgagttatttagctctagtcgacctacgtcggtcccnccgacggtccgtaccggaaggggaacggtactaggtaactagtcgtacgtacgtaggttaagtaacgtaagttaacgtagaacgtaaagtaactagttaacttaagttanacgtaactaaacttgtacggtaggacggtacagttactaccaccgtaagtccctaacgaaaggtactaacgttaccaagaactcgtctaagttctaaacgttcgaaaggtcggactacggtaccgttaggtacacgtcgtaagggtcgaacccggtgtacgttacgtagtttaaccgtttggaacgggttaacgggtaanaggggtaaccggttaggttaacggtaacggttacgggttacgggtggtacccggggattaacccgggg

SEQ ID NO: 268966 - DNA, 936 bp, Homo sapiens
  misc_feature: GYAE6OF02HP40I.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatggacggtaggtttgggctgacgcgttggggttttccttggttgactttaagtttttttaaaagggtcgttacccgagttggtgtagggtgccagtcgtgggtggtacggttcggtggggggaggtcggttcggtcccgaacggtccgggttcgggggggtcccctaggaacgtaccgttccgttccgttcggtcgaccgacgtccccgttcggtacggtaccttccgtaaccttaccgtagtttaacgttttagtaccggtacttaacggtccggtaccgttaaccggttccggggttacccacccggtaacggtccgtaccgggaaggggtaaccgggtactaggaaacgttagttcgtaccgtagtaacggttaagtttaaaggtaacgttaagtccggtaaagtaaacgttaaactaagtttaacttaatttaacggaacgtaaccgttaaaacgttcggttacgggttaacgggaacgggtaccggtaactaacgtttaccgtaaacctaccgtttaccgtaaccggtaacgggttaaactaaaccggttaccgaaaaccgtaaccgtaacgggttaccgttaacgttacttaaccgttaacgtaacggtaccgggaacgtaccgaccggtaggtaaacgtccgtaacgtacgggtaaccgtaacggtaccgggttaacttaacggttacggtttacgttagggtaacggggttaagggaaaggtacggggttaaacggttaccgggtaaaggttacgggtaaccgggttttagggggtccggggttacgggaccgggtaaccggg

SEQ ID NO: 268967 - DNA, 850 bp, Homo sapiens
  misc_feature: GYAE6OF02HCOJR.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgcttatttttaaaggtgtccagtgtgaggtgcagctgggtggagtcgtgggggagtcgttggtccaggccggtggggggtccctgacgacctctccgtgtgcacgcctcgtaggatttcctacctttcgaagtttaattttacgtcgtacttagtcgcctaaccggtgggttccccgacccgacgggtccctccggaaggggtacgggacgtaggaatagtcgttactacgtaaggttacttaaggaagttaatcggaacgaaataaactattaagttattaatacgaactaaacgtcgtaggtacggtaacgggactagtaacttacccgaaccgtacttacccgtaaccgggtaagggtaaacctaaaccgttaacccgaaaacgtaacccggtaaccgtccggttttaaacgttaaccgtttaccgttaaaaccgtaacgggtttacgggaacccgtaacgggttacccgtaaggtaaacggaccggttaaccggtaaggaaaccggggtacgttaaccggggtaccgttttaaggttaccgtttaaggtttaccgggttaaagggtacgggggttaacggggtaaagggttacggggtaaaccgggttaacgggtttaacgggaaaccggggtttttacgggggtttaacggggttacccgggggaccggggttaaccccggggg

SEQ ID NO: 268968 - DNA, 839 bp, Homo sapiens
  misc_feature: GYAE6OF02HKH6O.28.57.F02.1.454.CMB.1.raw
  modified_base (64)..(64): a, c, t, g, unknown or other
  misc_feature (64)..(64): n is a, c, g, or t
  modified_base (183)..(183): a, c, t, g, unknown or other
  misc_feature (183)..(183): n is a, c, g, or t
  modified_base (274)..(274): a, c, t, g, unknown or other
  misc_feature (274)..(274): n is a, c, g, or t
  modified_base (720)..(720): a, c, t, g, unknown or other
  misc_feature (720)..(720): n is a, c, g, or t
tcagagtacgctatcacgaccggtgctcgatttagctcgatatagttgggtcctgggagaggancccccgccctgggtttcccaggtgttctcatttggtgatcagcactgcacacagaagagtcatcgtacggagtttgggctggacgccgttgggttttccttgttgtcttattttaaggngtccagtgtgaggtgcgtagctaggtggacgtcggtgggggagtcttggtccgagtccggtgggggtaccctgacgtacctcgtccgtgtnccgtacgtccgttccgtaggtaccttccgacctttaccgtaagttttcttatcgtacctagtacgacccgtacggttcggtcccgtaccgaaccggtccgttaccgggaacggggtaacggtacgtaacggtaaattacgtcgttaccgtaagtccggttaaataccggtaaagtaagtacggtactaagttaaacctagttattaacgttaagtcgaaccgttaaaaccgtcgttacggttaacgggaacggtaccgaagttaccgttaccgacctaacgttaccccggtaacgaacggtacctaaaccgttaacgaaaacgtacctaacggtaccgtttaccgtaacgtttaccttaaaccgaagttaaccgggccgtaaacccggttagaccgggttaagtaccggaacgtacggaaccgggtacgtacccggttaaacgttnttaaccgttaggtttacccgggtaaggggtacgtaaacggggtaagttaacggggtagttaacccgggttagggtaacgggtttacggggttacgggtacgggttacccgggaacgggg

SEQ ID NO: 268969 - DNA, 796 bp, Homo sapiens
  misc_feature: GYAE6OF02FYM43.28.57.F02.1.454.CMB.1.raw
  modified_base (269)..(269): a, c, t, g, unknown or other
  misc_feature (269)..(269): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgcttattttaaaggtgtccagtgtgaggtgcagctggtggagtcgtgggggagcgttggtccgagcccgtggggggtccctggagactctcctgtgcagcctcgtggnttcgacccttcaagttatttatcgtctagttgctaccgtcgggtaccgccgtacggccgtcccggaggggtaaggaccgtaggaactagtcgtcgtacgaggttaactagtaagtaagtgaacgtaaactaaacgtattaataagttactacgtaactaaccgttcgttagggttaggaacgggacctaaggtacctttaccacgtccttaccgtaccgggtaaaccgggttaactaaaaccgtttacccgaaaacgaaccggtaaccgtaccgtttacgttaacttaccgtttaaacccgtaaaaggtcccgggttaacaacccgggttcttacggggaaacgtcgggaaccgtttaacgggtaaccggaacccggttaaacgggtcctttaacggggtttaccttaagttccgggttttaagggggaggtaacgggggtaacggtaaggggtaaccggttaaggtttacggggtaaacgggttacggggttttcggggacgggggtacccgggtaacccgggggg

SEQ ID NO: 268970 - DNA, 648 bp, Homo sapiens
  misc_feature: GYAE6OF02F3038.28.57.F02.1.454.CMB.1.raw
  modified_base (177)..(177): a, c, t, g, unknown or other
  misc_feature (177)..(177): n is a, c, g, or t
  modified_base (511)..(511): a, c, t, g, unknown or other
  misc_feature (511)..(511): n is a, c, g, or t
  modified_base (613)..(613): a, c, t, g, unknown or other
  misc_feature (613)..(613): n is a, c, g, or t
  modified_base (626)..(626): a, c, t, g, unknown or other
  misc_feature (626)..(626): n is a, c, g, or t
tcagagtacgctatcacgaccggtgctcgatttagctcgatatagttggggtctgggagaggagcccccgccctgggtttcccaggtgttctcatttggtgatcagcactgcacacagaagagtcatgacggagtttgggctgagctgggttttccttgttgcttatttttaaaggngtccagtgtgaggtgcagctgggtgagtcgtgggggagcttggtccagccgtgggggtccctggagtactctcgtgtcgcacgcctcgtggacttccgaccttcgagttatttactgtcttagtcgactacgttcgggtcccaccgacggtccgtccggtaaggggacggtacgtaggaattacgtcggtctacgtaggttacttaggaaacgtacgtcgtaacgtaaacgtaactagttaactatttagacgtacctaaacgttcgtacggtaggtacggacaggttacctacgaactctcgacgtaggaacctaagtaccaaggctacggtntaggttactacctaagaggtcggacacgtcgtagagtaccgcgtagacggacctcgggatagttacctaggtttacgcgggtaaggagtaggccgtaaggtntacgggttacggnggtacgggtcggaacggtcggg

SEQ ID NO: 268971 - DNA, 828 bp, Homo sapiens
  misc_feature: GYAE6OF02JEB7I.28.57.F02.1.454.CMB.1.raw
tcagagtacgctatcacgaccggtgctcgatttagctcgatatagttgggtctgggagaggagcccccgccctgggtttcccaggtgttctcattggtgatcagcactgacacacagaagagtcatgacggagtttgggctgagctgggttttcctgttgcttattttaaaggtgtccagtgtgaggtgcagcgtgggtggaggtcgtgggggaggtcttggtccagtccgtcggggggtccctgacgtcctcgtcctagtcgcacgtcctcgtggacttcctacccttgagttaatttacgtcgtactactggacctaccggttcgggtacccgaccgtacgggcccttacggggaaacggggtaacggggtaccttaaggggtaacttaaccggttgttaccgttacgtaacgggtttaagttaaggtaaaccggttaagtcggtaaacgtaaactaaacgttaaacttaacgtttaattaacgtacggtaaaccttaacgtagtaccggtaagggacgtaacctaggtacttaaccgaccgtacttaccgtaaccgaagggtaacctaacttaaccggaaacgtaacccgacgttacgtttacgtactttaccgtacgtaaacggtcggtaaccgtacgtaccgtagggtaccgaaggttaccgacgggtagtaaccccggtggtaaccgtttacgtttaacgttacggttaacggttggggttaaacgggacggtaacgggttacgggttaaacggtttaacgggggtacgggttaacggggttacggggttacggggtaacccggggtacggtaacccggggg

SEQ ID NO: 268972 - DNA, 809 bp, Homo sapiens
  misc_feature: GYAE6OF02JER34.28.57.F02.1.454.CMB.1.raw
  modified_base (599)..(599): a, c, t, g, unknown or other
  misc_feature (599)..(599): n is a, c, g, or t
  modified_base (654)..(654): a, c, t, g, unknown or other
  misc_feature (654)..(654): n is a, c, g, or t
tcagagtacgctatcacgaccggtgctcgatttagctcgatatagttgggtctgggagaggagcccccgccctgggtttcccaggtgttcctcatttggtgatcagcactgcacacagaagagtcatgacggtagtttgggctgagtcgttgggtttttaccttgttgcttatttttaaaggtgtccagtgtgaggtgcagctggtggagtcgtgggggagtcgttggtccaggtccggttcggggggtccctggacgtaccttccgtacgttcgttcgcgacggtccttacgtggtactttccgtacccttacgtaacgtttatttacgtcgtaccttaacgtgtacctaacggttcccgggtccgaccgtacggtccgttaccgggaggggtaacggtaccgtaaggtaacttagtttccgttacgtaccgtaaggtttaactaaggtaacgttacgtacgtaacggtaaacttaaactacgttaatttaagttaacgtacgtaaaccgttaacgttcgtaaggtaacggtaacggacttaggtacctaaccctacgtcgtcccgtaacggtaacggaactacctaacccgggaaanaccgtaccgtctacggttaattccgtaacgtaacgtggacctacggtcctaacgngtaacgccggtaaggaaccgtaccggacggtttactaacccggttatttcggtacggtcgggttaaggtccgggtaaacgtaaccggggtttaatacgggtttaacggggtacggtttaacggggtcgggttaacccgggtcggtaaacccgggg

SEQ ID NO: 268973 - DNA, 832 bp, Homo sapiens
  misc_feature: GYAE6OF02GCQOB.28.57.F02.1.454.CMB.1.raw
  modified_base (146)..(146): a, c, t, g, unknown or other
  misc_feature (146)..(146): n is a, c, g, or t
  modified_base (722)..(722): a, c, t, g, unknown or other
  misc_feature (722)..(722): n is a, c, g, or t
tcagagtacgctatcacgaccggtgctcgatttagctcgatatagttgggtctgggagaggagcccccgccctgggtttcccaggtgttcctcatttggtgatcagcactgcacacagaagagtcatgacggtagtttggctgagngttgggtttttccttgttgcttaatttttaaggtgtcagtgtgaggtgcagtcgtggtggagttcggtggggggagtcgtttcgggtccgagggtcccgggttcggggggggtcccctaggtacggtacctccgttcccgttggttcgccgacggtccttacgttcggtactttcccgtaccgtttacgtacgttttatttaagttcgtcttaacttcggtacgtaaccggttcggggtcccgtacccggtacgggccttaccgggaacggggggtaacggtaccggtaaggttaaactaggttccgttgtaccgtaagggttaagttaagtaaacgtacgtacggaacgttaaacgtaaattaacgttaagtttaactagtactaaaccgtaaacgtttcgtaggggtacggaacgggtaccgtacgttacgtacctaacgtactacccgtaccggaacggtaacctactaaccggtaaccaaccgtaccgttaacgttacttacgttaccttaacgtaagtcggtacacggtaccgtacgtagcggtacgtacggaacggtacgtaaccggttnttaccggttattacgtacggttacgggtacgggtaagggaaccgggtacggtaagggttaacgttacgggttaacgggtttacgggtacgggttgggacgggttacgggg

SEQ ID NO: 268974 - DNA, 740 bp, Homo sapiens
  misc_feature: GYAE6OF02JJTMS.28.57.F02.1.454.CMB.1.raw
  modified_base (306)..(306): a, c, t, g, unknown or other
  misc_feature (306)..(306): n is a, c, g, or t
tcagagtacgctatcacgaccggtgctcgatttagctcgatatagttgggtctgggagaggagcccccgccctgggtttcccaggtgttcctcatttggtgatcagcactgcacacagaagagtcatcgacggagtttggactgagcgtggtttcctgttgctattttaaggtgtccagtgtgaggtgcgagctggtggagtcgtgggggagtcttcggtccgaggccgtggggggtccctaggagtactccgtcctgtgccaggcctcgtaggtacttccgtaccgttagtacgttaattttacncgtctaagtcgacgtccgtcgggtcccgccgacggccgtaccggaagggtaacggtcggttacggaattagtcggtactaccggtaggttaagttaaaggaaacgttacgtaggtaaccgtaaaacgttaaactaacggttaatttaacgttaacgtaggtaacctaaaccgtacgttaaggtcggtaaacgggtcgtaacgtacttacccgtaacgtaacctcccgtaaccgtaagggtaaccgtaaacgtacccgaaagtaaacccacggtctaacgttacgttactacgtaaacgtcggtacaccgtacgtacggaagccggaacgtcgccggtaacgaccggtcttacgtagtaccgttggacgggtaagtagaacggttagacggttaaggtaacggtaggtacgggtacgggtacggtccggtaaggg

SEQ ID NO: 268975 - DNA, 629 bp, Homo sapiens
  misc_feature: GYAE6OF02INZFQ.28.57.F02.1.454.CMB.1.raw
  modified_base (174)..(174): a, c, t, g, unknown or other
  misc_feature (174)..(174): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
  modified_base (418)..(418): a, c, t, g, unknown or other
  misc_feature (418)..(418): n is a, c, g, or t
  modified_base (506)..(506): a, c, t, g, unknown or other
  misc_feature (506)..(506): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaggngtccagtgtgaggtgcagctggtggagtcgtgggggagcttggtccagccgtggggggtccctgagactctcctgtgcagcctcgtggattccaccttnagttatttangctntgctacgtgggtccncgaggctccggagggaggctaggaatgtgtcgtacgtaggtataggaagtagtcgacgtaaattacattaatatagtgactaactgtaggacgagggtacagtagttcccaacgtntccgtaccgagggtaacctacgttaccaacgaccgtacgtgttacgtacttactacggaaagtccgggactcgtaccgtagacgtacncgtaggaaccggacgacggtcttaaggtcttaacggttaggcgggttaagggacggtacgggtaacggtacggtaacggttagggtaaccggttggggtacggttacgggggacgtaacgggg

SEQ ID NO: 268976 - DNA, 870 bp, Homo sapiens
  misc_feature: GYAE6OF02IWXBH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagtcttgggttttccttggttgcttaagtttttaaaggtgtaccgtagtgtggtaggtcgcgagtcgtgggtggagttcgggtgggggaggtcgttcggtccgaacggtccggttcggggggtcccctaggacgtactccttccgtggtacgcgtcgtccttgtcggtacttcctaccgtttctagtttatttagtgtaccttagtcgaccgtacggttcgggtccctccggtaacgtccggtaccggaaacgggggtaacgggtaccgtagggtaaaggttcttacggtaccttacggttaagggtttaagtttaaacgggtaaaagttaacgttacggtaaacgtaaaaacttaaacgttaatttaacgtttaagtttaaacgtaaccgtaaactttaacgtacgttaacggtaacggtacgggtacaacgttaccttacaaccgttctaccgtaaccggaagttaacccgtaaacgttaaccgaaacggtaacctaacggtacgtttacgtaaccctttaccgttaaacgaaaggtcgggtaaccgtacgttaccgtagggactaaccgtcgggtaagaaaccgggacggttcgtaccggtttagtttaccgttagttacggggtagggtaagggtaacgggtaggtaacgggttaagggttcggttaaacggggttagggtttacggggggtttacggaccggggggtacggtaacccgggg

SEQ ID NO: 268977 - DNA, 761 bp, Homo sapiens
  misc_feature: GYAE6OF02HL1XL.28.57.F02.1.454.CMB.1.raw
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
tcagagtacgctatcacgaccggtgctcgatttagctcgatatagttgggtctgggagaggagcccccgccctcgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtcccagccgtggggggtccctgacgactctcctgtgcagcctcgtggacttcaccgttcagttattttangtcttatgctacgtcgggtcccnccgaggtcctcccggaagggggaacgggtaccgtagggtaactagttcgttacctacgtaggtttaacttaagggtaaacgttaagttacggaaccgtaaaattaaaccgtaatttaactttaaagtttaacgtacggtaaacctaaaaccgtttcgttaaggttacgggaaacggggtaccaagggtttaccttaccctaaccttaacgttcccgtaacccgtaaagggaacccttaaacgttaacccgaaaagggaaccctaccggtacttaacggtttacctttaaccgttaacctaaaaggtcgggaacccagtacccgtgaacggacgtcgaggaacggccagggtaccttgttacttatttcggtagggtagggagtaacgggcgaacggttacgttaccggggtaagttacgggggtttgggtccggggaccgtaacggggg

SEQ ID NO: 268978 - DNA, 688 bp, Homo sapiens
  misc_feature: GYAE6OF02IY3XD.28.57.F02.1.454.CMB.1.raw
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
  modified_base (492)..(492): a, c, t, g, unknown or other
  misc_feature (492)..(492): n is a, c, g, or t
  modified_base (525)..(525): a, c, t, g, unknown or other
  misc_feature (525)..(525): n is a, c, g, or t
  modified_base (563)..(563): a, c, t, g, unknown or other
  misc_feature (563)..(563): n is a, c, g, or t
  modified_base (616)..(616): a, c, t, g, unknown or other
  misc_feature (616)..(616): n is a, c, g, or t
  modified_base (669)..(669): a, c, t, g, unknown or other
  misc_feature (669)..(669): n is a, c, g, or t
tcagagtacgctatcacgaccggtgctcgatttagctcgatatagttgggtctgggagaggagcccccgccctggtttcccaggtgttctcatttggtgatcagcactgcacacagaagagtcatgacggagtttgggctgagcttgggttttccttgttgcttagtttttaaaggtgtccgtagtgtgaggtgcgagctggtggagtcgtgggggagcttggtccaggccgtggggggtccctgacgacttctccgtgtcgcacgcctcgtggtattccaccttgacgttatttacgtgtccttaagttcgaccgttacggttaccggggttcccgccgtaacggtcccgttaacccggaaaggggggtaacggaaccggttacgggtaaattagtacggttacctacgtaaggttaacgtaaggtaacgtaagtacgactaaactactatagttatatcgaactacgtncgtagacggntaagtgtcacngtccacgaagtaacctacgtaagaacacctagntagtccttagaactaacggtcggctaagtccgtaaggntacggtgacggtaacggacccgtgcttacgttattaggtacgtgggttacggnggtaaaccggtcggtaagtttaggtacggttaccggttagggggtttacccgnggggtaaccgttaccgggg

SEQ ID NO: 268979 - DNA, 852 bp, Homo sapiens
  misc_feature: GYAE6OF02HNA5V.28.57.F02.1.454.CMB.1.raw
tcagagtacgctatcacgaccggtgctcgatttagctcgatatagttgggtctgggagaggagcccccgccctgggtttcccaggtgttctcgatttggtgatcagcactgcacacagagagtcatcgacggagtttgggctgagcgttgggttttccttgttgacttaagtttttaaaggtcgtaccagtgtgaggtgcagcgtggtcgagtcgtgggggagtcttcggtccgaggccggtggggggtccctaggacgtacgtctccgtgtcgccgacgtccttcgtggtacttaccgtacctttacgtatttagttttacgtggtacttaggtcgtaccgtaccggtccgggtccgacccggacggtaccctaccggggaacgggggaaccggtacgtacgggtaaacttcggtttacgacccgtaaggttaggttaaacccggtttaaagggtaaaacgtttagggtaaccgtaaacgtaaaactaaaccgtttaaagttaacttttaaaactacggttaaacgtaaacccttaaggtacccggtttaaagggaaccggggaaactccggtaagtttaacccgtaccctaaaccgtacgttaacccgtaacccgtaaagggtaacccttaaaccggtaacgaaacctaccggtacctagttaacttaccggttaactacgtacggtacgacgtccggtaacgtaggtagacccgtaggtaccgaaggttccgacgttttcgaacgttagttaccggttaggtaacggtgggaaacggtacgggacgggtttacggtaacgttagggtaaccgggttagggtaccggttacggggtaccggtaaccgggg

SEQ ID NO: 268980 - DNA, 791 bp, Homo sapiens
  misc_feature: GYAE6OF02JYGFR.28.57.F02.1.454.CMB.1.raw
  modified_base (275)..(275): a, c, t, g, unknown or other
  misc_feature (275)..(275): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaacggtgtccaggttgtgaggtgctagcgtggtggagtcggtgggggagtcgttcggtccgagtccggtggggggtccctggacgtcctctccgtgtcgacncgtcctgtcggtacttccgtaccgttagtaacgtttatttacgtcgtactacgttacgcgtacggtcggttcccgccggaacggtcccttacgggaaggtacggggtaacgtagtagttgtacgtcgttaacgtagggtttaagtaaggtaaaggtaacgtaggaaccgtaaaataataagtttataacgttagtcgtaaaccgtaaacgttcggttaacggtaccgggaagacgtagttacccgttaccctaagtactttccccggaaacggtaccggtaaattaaaccggttaacccaaacggtaaacccgtcgtactttacggttaaactcccggttaagaacggtccgtaacgtacgtaccgtaggacggttagaccgtaggggtaaccaaccggtcggtttataccggttagtaacgttcggggtgggtaacgggaaggtaacgggttacggtagggtaaacggtttccgggaaaggggttccggtttaacgggcgggtaaccggaccggg

SEQ ID NO: 268981 - DNA, 847 bp, Homo sapiens
  misc_feature: GYAE6OF02HR88F.28.57.F02.1.454.CMB.1.raw
tcagagtacgctatcacgaccggtgctcgatttagctcgatatagttggggtctgggagaggagcccccgccctgggtttccccaggtgttctcatttggtgatcagcactgcacacagaagagtcatgacggagtttgggctgagcgtgggttttccttgttgtcttatttttaaaggtgtccagtgtgaggtgcagcgtggtggagtcgtgggggagcgttggtccaggtccggtggggggtccctaggacgtactctccgtgtcgctacgtccttcgtaggtacttacctaccttcgtaaggtttatttaacgtcggtacttaagtcgaccgtaccggttccgggggttcccgacccggtaacgggtcccgtaccggggaaacgggggtaaacgggtaccgtaagggtaaacgttacgttcggttaccgtacggtaagggttaagtttaaaggtaaacgggttaaagtacggaacggttaaaactaaacgttaagttaaatttaacgtttaacgtacggtaaacctaaacgttcgttaacgggtacggaaacggggtctaacggtaacttccgaaaccgtcgtacctaccggaacggtaacttaacgtaccgaaagactaccggttacgtagttacttactaacgtaagtacgggtactacggtaccgtaggtacgaccggtagtacgggtaaaccggtaacggtacggtacgttaacgttacgtttaacggttacggtaagggtaggggtaaacggtaacggggtaccgggttaaagttaacgggtttaaggggacccgggtttaagggggtttacggggaccgggtaaccggtaaccggggg

SEQ ID NO: 268982 - DNA, 614 bp, Homo sapiens
  misc_feature: GYAE6OF02H0FAG.28.57.F02.1.454.CMB.1.raw
  modified_base (170)..(170): a, c, t, g, unknown or other
  misc_feature (170)..(170): n is a, c, g, or t
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (406)..(406): a, c, t, g, unknown or other
  misc_feature (406)..(406): n is a, c, g, or t
  modified_base (449)..(449): a, c, t, g, unknown or other
  misc_feature (449)..(449): n is a, c, g, or t
  modified_base (597)..(597): a, c, t, g, unknown or other
  misc_feature (597)..(597): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggtttcctgtgcttagttttaagngtcagtgtgaggtgcagctggtggngtcgtggggngcttggcacgcgtgggggtcctggatctcgcctgtcgcagcctagnggtacttcncttacgtagtatttangctagtcgactagtcggccgcctaggacctaccggaaggggaacgtaccttaggaatacgtcggttacaccgtaaaggttaagttagaaaggttaacctaggaaccgtaataaactattaagttactaancggtaacaaacgtttcgaggacgagggtacagtatacaccgtncctaacggagtactacttaacgacgaaatacgactttgacttacgttaacaaggcgtacagcctaaggatccgagtacgacttacggaactgtacgtatcgttacggtgagggtagacggaagtacgtacggaggtaccggttagggnggtaccggaggtaccgg

SEQ ID NO: 268983 - DNA, 331 bp, Homo sapiens
  misc_feature: GYAE6OF02G53AG.28.57.F02.1.454.CMB.1.raw
  modified_base (246)..(246): a, c, t, g, unknown or other
  misc_feature (246)..(246): n is a, c, g, or t
  modified_base (294)..(331): a, c, t, g, unknown or other
  misc_feature (294)..(331): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggatctgggggagcttggtccagcctggggggtccctgagactctccngtgcagccctgtggattcacctttcaggttatttagtgcctaagtgannnnnnnnnnnnnnnnnnnnnnnnnnnnnnnnnnnnnn

SEQ ID NO: 268984 - DNA, 868 bp, Homo sapiens
  misc_feature: GYAE6OF02GE36J.28.57.F02.1.454.CMB.1.raw
  modified_base (115)..(115): a, c, t, g, unknown or other
  misc_feature (115)..(115): n is a, c, g, or t
tcagagtacgctatcacgaccggtgctcgatttagctcgatatagttgggtctgggagaggagcccccgccctgggtttcccaggtgttctcatttggtgatcagcactgcacanagaagagtcatgacggtagtttgggctgagtcgttgggtttttccttggttgtactttaaagtttttttaaaagggtcgttaccgaggttgttaggagggtcgcaggtcgttgggtggagttcggtggggggacgtcgtttcggtccaggtccgggttcggggggttccctggacgtaccttcctccgtggttcgacgtacgtcctcgttaggtacttaccgtacctttcgtaaggtttaattttaatcgtacttacgtacgaccgttacggtcggggttaccccgaccgtacggtaccgtaccggaaagggggtaacggtacggtaaggtaacttacgtacgttcgtaacgttaacggttaagttaaacggtaaagtaacgtacggaaacgttaaaacgttaaacctaatttaagtttaaattaacgtaccgtaaaccgttaaaaccgttcggttaagggtaaacgggaaccgggtaacgtaacggtttaaaccttaacccaaacctttaccgtaaccggtaaccgtaaacgggttaaactaaaaccgttaaccgaaaacgtaaaccctacggttacgtaagtttaacctaacgttaaacgtaacggtacggaacgtacgaccgtacgtaagacgtacgtagaacggaacgtacgtacgttagtacttacgtacggtgggtaacggtaacggaggtacggtaacggtaaggttacggacggttacggggtaggtacccgggtagtaacgggg

SEQ ID NO: 268985 - DNA, 724 bp, Homo sapiens
  misc_feature: GYAE6OF02JR5WS.28.57.F02.1.454.CMB.1.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (316)..(316): a, c, t, g, unknown or other
  misc_feature (316)..(316): n is a, c, g, or t
  modified_base (479)..(479): a, c, t, g, unknown or other
  misc_feature (479)..(479): n is a, c, g, or t
  modified_base (567)..(567): a, c, t, g, unknown or other
  misc_feature (567)..(567): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtgtttgggctgagcgttgggttttccttgttgcttagttttaaggtgtcagtgtgaggtncagcgtggtggtagtcggtagggggngtcgttaggtccgaggccggttcgggggtccctaggaacgtcctcgtccgtgtcgacgtacgccgtcgaggtacttccgaccttgtaagttatttttancggtactaagtcggaccttaacggtcgggtcccacgtggcccttacggaagggacggtactaggaattatcgtacgtacgtaggttattacggaaagtatacggaactaaactacgtattacgttaaattcgaacgtacgtaaactgtagggagtaaacggtntagtaactcgaaccgtatccggtaacgaaggttacctacgtaacgaaaccgtacacggtaactagtactactaacgtaacgtcggacngtaccgagacgacgttccggaagccgtaaacggtcgtacgtacgttaacggtcgtttaaacggccgggttaggaaaggtccggttaacggtaacccggttaagggttaggtaacccggggttaaggttcggggtaacccggtagggtaaccccgggg

SEQ ID NO: 268986 - DNA, 833 bp, Homo sapiens
  misc_feature: GYAE6OF02JATWU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgtcttaatttttaaggtgtccagtgtgaggtgcgagtcgtgggtggtacgtcggtgggggtacggtcgttcggtccgaggtccggttcggggggtccctggacgtaccgtctccgtgtacgctacggtccctcgtacggtacttccgtaaccgttctaagttatttatcgtacttaatcgtaccgtaccggtccggtcccgaccgtacggtccgtaaccgggtaagggggaacgggtacgtaagggtaacttaggttacgttaccgttacgtaaaggtttaacgttaaggaaaggttaagacggtaaacgtaaaacttaaacgtatttaattaagttacgtacgtaaaccttaacgttcgttagggtaacggacgggtactaacgtacttaaccgtaaccgtacctaccgtacggtaacggtaacgtaacttaacctaaaccgaagtacccccccccccccgttagttacttaacttaccgtaacgtaacggtacggtaacgtacgacgtacggacgaccggtggtaacggaacggtaaccgtaacgtacgttacgttagttaacgttacggtagggtaacgggtaacgggtaaggtacgggttaacggttaagggttacgggttaaccgggtttaggggttacggggttacggggtacgggtaaccgggg

SEQ ID NO: 268987 - DNA, 738 bp, Homo sapiens
  misc_feature: GYAE6OF02HZ869.28.57.F02.1.454.CMB.1.raw
  modified_base (284)..(284): a, c, t, g, unknown or other
  misc_feature (284)..(284): n is a, c, g, or t
  modified_base (317)..(317): a, c, t, g, unknown or other
  misc_feature (317)..(317): n is a, c, g, or t
  modified_base (636)..(636): a, c, t, g, unknown or other
  misc_feature (636)..(636): n is a, c, g, or t
tcagagtacgctatcacgaccggtgctcgatttagctcgatatagttgggtctgggagaggacgccccccgccctgggtttccccaggtgttctcatttggtgatcagcactgcacacagaagagtcatgacggtagtttgggctgagtcgttgggttttccttgttgtcttaagttttaaggtcgtcctagtgtggaggtgcagctgggtaggaggtcggtgggggagtcgttcggtccgtggtcccggtggggggtccctgacgtcctctccgtgtcgaccncgcctgtggtacttccgacttctagttatttgnacgttatcggctacggtcgggtccgcgtaaccggccgtacggaggggtaacggtacgtagtaacgttgtttacggtaccgttaggttaacggttaagttaaccggttaaagtaaacgtcggtaaacgtaaataactaattagtttaaatacggttacaactttaagttcgtaaggtacggaacgtataacgttacgtactacctaccggtacctacggtaaacgtaacgtaactaccgaaacgtactaacgtacgtttctaacgttactaacgaacgtaccgtacgtactacggagtccgagcgtacgggagtacggtnttacgtagttattaccggtaggtaaggtagggtaacggacgggtaagtcgggttaaacggtaggtaacggttcggggggtagttaccggggccgtaccgggg

SEQ ID NO: 268988 - DNA, 832 bp, Homo sapiens
  misc_feature: GYAE6OF02FNW37.28.57.F02.1.454.CMB.1.raw
tcagagtacgctatcacgaccggtgctcgatttagctcgatatagttgggtctgggagaggagcccccgccctgggtttccccaggtgttctcatttggtgatcagcactgcaccacagaagagtcatgacggtagttgggctgagtcgtgggttttccttgtgcttaatttttaaaggtgtcctagtgtgaggtgcagcgtgggtggagtcggtgggggagtcgttggtccaggtcccggtggggggtccctggacgtacctccgtaccgtgtcgcgacgtccgttcgtcggtacttccgtacccttagtagttatttagtcgtacgttagtcgacgtacggttccgggtcccggaccacgggtccttaccgggaaggggtaacgggtaccgtaagggtaatacggttcgttaccggtagtaaggtttaagtaacggtaagtaaagtcgtaaacgtaaagttaaccgtaatttaagtatttaacgtacgaaccgttaaaccgtcgttagggtaaggtaacggtagtaaccggttaccttaccgaaccgtaccgtaccgtacccgaacggtaacgtaaccgttaaccgaaccgtaaccgacgttacgtacgttaacgttaccgttaacgtaacggtccgtaaccgtccggtaacgacggtaacgaaccggtacggtaccggtaaaccgggacccgttaacggtacccgttaagtaccgttaacggttaccggttaagggtacgggaaagggttacgggtaacggtaagggttaacggtttaaggggtaaaccggttacgggggtagggtacccggggtacgggtaacccggg

SEQ ID NO: 268989 - DNA, 739 bp, Homo sapiens
  misc_feature: GYAE6OF02GK11V.28.57.F02.1.454.CMB.1.raw
  modified_base (284)..(284): a, c, t, g, unknown or other
  misc_feature (284)..(284): n is a, c, g, or t
  modified_base (537)..(537): a, c, t, g, unknown or other
  misc_feature (537)..(537): n is a, c, g, or t
  modified_base (618)..(618): a, c, t, g, unknown or other
  misc_feature (618)..(618): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagcgttgggttttccttgttgcttaagtttttaaggcgtccagtgtggtaggtgcagtcgtgggtaggtgtcggtggggggagtccgttcggtccgtacgtccgggttacgggggtccctggacgtcctctcgtagtcgnaccgtcgtcgtggtacttccgaccttacgagtttacttagtcgtaccttaggtcgccgtacggttaccgggacccgacggttacggcccgttaacggggaaccgggtaacggttacgtaggtaactttcggtcgttacgtaacgggtttaaaggttacgttaaaggtaaacgtaacggttacgaaccggtaaaatttaactatttaaacttaggttactacggaaccttaacgttcgttaggtaaggacgtanaccgtactactactcgtaccgtacgagtaactacgtaactagaccgtgtactagtcttaacgtcgaatcggactacgtacncgtacgtacgacgtacgaccgacgtcgtacgtattacgtagttccgggtaagggttacggacgggtaagtacggtagtacggtacggttacggtagggttcgggaccggtaggtacccggg

SEQ ID NO: 268990 - DNA, 762 bp, Homo sapiens
  misc_feature: GYAE6OF02G4U5U.28.57.F02.1.454.CMB.1.raw
  modified_base (676)..(676): a, c, t, g, unknown or other
  misc_feature (676)..(676): n is a, c, g, or t
  modified_base (710)..(710): a, c, t, g, unknown or other
  misc_feature (710)..(710): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggctgagctggttttccttgttgctatttttaaaggtgtccagtgtgaggtgcagctgggtggagttcggtggggaggtcgttacggtccgagtccggttcggggggttccctggtacgtaccgtccgttcctggtacgccgacgtcccgttcgtaggtactttcctaaccgtttcgtaacgtttattttactggtcttaacgtcgactaccggtccgggtacccgccgaacgggtccccgtaccggaacgggaacggggtacgtaacgggtaattacggtcgttacgtacggtaacggtttaagttaaacggttaaagttaaaggttacggaaacgtaaaactaaacttaagtttaaattagtttacgtacgtaacgttaaacgttcgttaagggtaaggtaacgggcttaacgtaccttccgaaacctcgttacccgaccgttacgggaacctttaaacggacccgtaaacgaaccggtacgtcgttacgtactttacgtaagacgtgactgccgtagacgtgtacgaggcgtaccgnggtacgtagttcttaagtcggtaggaggtaaggngtaaggacggttaggtacggttaaggttgggtacgggtacggaggttccggg

SEQ ID NO: 268991 - DNA, 732 bp, Homo sapiens
  misc_feature: GYAE6OF02IOA8C.28.57.F02.1.454.CMB.1.raw
  modified_base (172)..(172): a, c, t, g, unknown or other
  misc_feature (172)..(172): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgtgctattttaaaggntccagtgtgaggtgcagctggtggagtcgtggggggagcgttggtccagccgtggggggtcccctaggagtacctactccgtgtcgacagccctcgtggtacttacctaccttcgtaagttactttaagtgtaccttatcgacctacgtcggggtacccgaccgtacggccttacccggagggggtaaacggtcctagggaaattacgtcgtacgtactaaggttaactaaggtaaagtaagtcgaacgtaaataactaatacgttaattacgtacgaactaaactcgtaggtaggaacgggtctaaggtactaccgtaacctagttacccgtaccggtaaacgggtaactaaaccgttaaccgaaaaccgtaccgtaacggtaccttaaacggtactttaaccccgtaagttaaacggaccgggtactaacgtacccggtaggaactacggtcgtacgaacggtacaccggtcgtaatacgtacgtaggtaggacgggtacgaaggtaccgtagggtacttacgggtaacggtagggttagggacgggtaccgaacggg

SEQ ID NO: 268992 - DNA, 721 bp, Homo sapiens
  misc_feature: GYAE6OF02GVPWL.28.57.F02.1.454.CMB.1.raw
  modified_base (191)..(191): a, c, t, g, unknown or other
  misc_feature (191)..(191): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (378)..(378): a, c, t, g, unknown or other
  misc_feature (378)..(378): n is a, c, g, or t
tcagagtacgctatcacgaccggtgctcgatttagctcgatatagttgggtctgggagaggagcccccgccctgagtttcccaggtgttctcatttggtgatcagcactgcacacagaagagtcatgacggagtttgggctgagctgggttttccttgttgcttatttttaaaggtgtccagtgtgaggtncagctggtggagtcgtgggggaggcttggtccagccgtggggggtccctgagctctcctgtgcagcctntggtattcaccttnagttatttatgacttatcncacgttcgggtcccgccgaggcctaccggaggggtaacgggactagggaattagtcgtctacgtaggttaattaagaacgttaanggaacaaagttaacagtttaaactaatttatacgaactaaacttgtacggtaggaacggggctaagtacgttaccctaaaccgtattcccgtaaccgaacgggtaaacctaacgttaacccgaaacgaactaccggtacttagttaacctaccttaacgtaaaggtcgggtacaccggtccgtaggaacggtacggtgtaacgggaacggtaaccgtcggtacgtttagttactttaacggttacggttaggggtacggggaacggtagggtaaccgggtaaggttaaccggttaggggtaaacccggtttaggggggttacgggtccgggggtaaacccggg

SEQ ID NO: 268993 - DNA, 652 bp, Homo sapiens
  misc_feature: GYAE6OF02F24AX.28.57.F02.1.454.CMB.1.raw
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagtcttggtccagccgtggggggtccctgagctctcctgtgcacgcctctggacttccacctttcagttatttatgctatgctacgtgggtcccncgnggcctcggaggggacggctaggatagtgtcncgtagttatagaagtatgaacaataacatattatatcgactaacttcgtaggtacggaaggtacagttactaccacctactaccgtaccggaacggtaacctaaacgttaaccgaaagtaaaccgacgttaccgttagttacttacttaacgtaacgttccgggacaacgtacgtaggacgtacgtcgtaagaacgacgtacggtccgttagtagtttacgttacgtagggtacgggtaaggacgggtaagtacgggttaacggttaacgggaaccggtttgggggttgggttacggggccgggtaacggg

SEQ ID NO: 268994 - DNA, 743 bp, Homo sapiens
  misc_feature: GYAE6OF02HPK1X.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagcgttttttgggggaggcgttggtccagccgtgggggtccctgagactctcctgtgcagcctctggtattcctaccttcagtattttatgtactatgctacgtcggtcccgccgacggctccgagggaagggacgtggaatagtcgtctacgtaggtattaaggtaattaagtagacgaagtaacaagttaataattatagtacaaacgttctagtaggaagggtacgtacgtaattcctaacctagtaccctaccgaaggggtaacctaaacgttaccgaaaacgaaccgaacggttctacgttacttaccttacgtaaaagttcgggactacggtaccgtaggacggtacgtacgtacggaaccgggtaacccgtagggtacgttttacgtaacgttttacgtttttaaccggtgggggttaaccgggtaaggggtaacgggtaacggggtaaaccggggttaaggtttaaccggggttaaaccgggttttaggggggtttaccgggggttacggggggtaacccggtaaccggggggg

SEQ ID NO: 268995 - DNA, 797 bp, Homo sapiens
  misc_feature: GYAE6OF02HWIQF.28.57.F02.1.454.CMB.1.raw
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcgttggtccagccgtggggggtcccctaggagacctctccgtgtgcagcctntggnttcaccttcagttattancgtactagtgaccacgttcgggtcccgccgacggtcctccggaaggggagggactaggaatagtctacgtcgtaggttaattaagaacgtatacggacgtaaattaaacagttaataagtttagtacgtacaaacgttgtacgtaaggaacgggtcgtaaagtactttacccgaacttaacgttcccgtaaccgaacggggttaaacctaaaacgtttccccggaaaagtaaaacccgcccggttaactttacggttaaaccgttccttaaacggtaaaacggttcggggacctaaccggtacccgtagggtaaaccggaccggtacgttaaccgggtaaaccgggtaacccggtaacgggttaccctttaagggttaaacctttacggtttaacgggtacgggttaaggggggaaccctaaaggggttaggtacccgggttaaacgtttagggtaacccgggtttaaggggggttttaccgggacggggtaacccggtaaccgggggg

SEQ ID NO: 268996 - DNA, 848 bp, Homo sapiens
  misc_feature: GYAE6OF02JEJ6H.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagtcgtggtggagtcggtgggggaggtcgttcggtccagtccggtggggggtccctaggagtacctccgtcccggtgccgacgcccgtcgttaggactttaccgtaccttcgtaagttaatttagtcgtacttatcgtacgtaaccgttcggggtacccgtccgaacggtcccgtaccggaacgggggaacggtaccggtagggtaacgttaagttcggttactacggtaacggtttaacgttaaaggtaaacgttaagtacggtaaccgtaaagttaaactaagttaattaagtttaacgtagtaaccgtaaaccgttcgttaaggttacgggaacggtacgtaacgtacttacccgtaacctacgttccgtaacccggtaaggtaaccttaaaccgttaaccgaaacgtaaaccgaccgttacgtacgtttaacgttaccgttaaaaccggtaacgtaccggtaccggttaaccgtacggttaacgtaacggaggtaaccggtacggaaccggtaaaccgtaaccggtagttacgttaacgttaacggtttacggtaggttaacggggtaacgaagggttaggtaacgggttaaagttacgggttaacgggtttaagggttacgggtacggggtaaccggcgggtaacccgg

SEQ ID NO: 268997 - DNA, 904 bp, Homo sapiens
  misc_feature: GYAE6OF02G94JU.28.57.F02.1.454.CMB.1.raw
  modified_base (271)..(271): a, c, t, g, unknown or other
  misc_feature (271)..(271): n is a, c, g, or t
  modified_base (637)..(637): a, c, t, g, unknown or other
  misc_feature (637)..(637): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtcctagtgttgaggtgcagtcgtgggtggaggtcggtggggggagtcgttcggtccagccggtcggggggtccctggagtactccgtacgtntcgcacgaccttcgtggtattcctacttcgtagttattacgtgtacgtatcgccgtacggtcgggttacccgaccgtacggtccgttcccgggtaagggggtaaacgggaccgttaggggtaaatacggttcggttaccgttacggtaaagggtttaactttaaggtaaaagttaacgtacggtaaacgtaaaactttaactaaatttaagtttaacttaacgttactaaaccgttaacccttgtaacgggtaggaaacggggacctaggttaacctaccctaaaccgtaacgttcccccgtaaacggttaaccgggaaaccttaaacccggtaaaccgaaaacggtaaacccgtaacccggtttntaaccggtttaacttttaaccggttaacgtaaaccgggttcgggttaaccgaaccgggttaccggtacgtaggggaaccgttacggggaacgttaaaccgggaacccggtaccggttaagtttacggttaaccgtttaggttttaacgggcggttaaggggtaaacgggtacggggttaaaccggttagggtttaaacggggttaacggggttaaaccggggttttagggggttcccggggttaacgggggccgggttaacccgggg

SEQ ID NO: 268998 - DNA, 677 bp, Homo sapiens
  misc_feature: GYAE6OF02H90VJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagcgtggtggagtcgtgggggaggcttggtccagccgtgggggtccctggagactctccgtgtgcagcctgtgattccaccttcgagttatttatgcttagtgctacgttcgggtcccgccgaggcctaccggaaggggaaggcctagggaattagtgtctcgtaaggttattaagaaggttatggaacgtaaataacgattattaattagacgtactaaactctaggtaggaagggtacctagtactttcccgaaacctgttacccgtaccgaagggtaacctacgttaacccaaaggtaaacctccgttcttaagtacttacctttaacgaagttccgggactaccggtacccgagtaccgtgtacggaacgaccgacggtcttagttaactagtttaccggagggttagggaacgaagggtcgtaaacggtagttaggggtaaccgtggggtttacgggacggggacccggtgggtaccccgg

SEQ ID NO: 268999 - DNA, 789 bp, Homo sapiens
  misc_feature: GYAE6OF02HJPBW.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggttttccttgttgtcttagtttttaaaggtcgtccagtgtgaggtgcagctggtggagtcggtgggggagtcttggtccacggtccggtggggggtccctaggagtaccgttcctccgtgtcgccgtacgtccgttcgtggtacctttcctaccttacgtaagtttaattttactcgtcttaagtcgtaccgtacggttccgggtcccgacccgcggtccgtaccgggaaggggtaacgggtacgtaaggtaacttagtcgttcgtacggttaaggttaacgttaaggtaaacgttaacgtacgaacgtaaaacttaactaaagtttattaacttaagttacgaaaccttaaacgttcgtaggtaaccggtaacggggtactaacgttacgtaccgtacctaccgttaccgaacggtacggaaacttaacgtaaaccgaaacgaaccgtacgtacttccgttaacttaccgtaacgaacggttcggctacccgtagtacgaggtaccgtgtaacggacggtacgtaccggtattaacgtgttaacgttcggtacgggtagggaacgggtaagggtcggtaacgggttaggttaaacgggtaggtttcggggtaacggggtacgggtacggtaacgggg

SEQ ID NO: 269000 - DNA, 880 bp, Homo sapiens
  misc_feature: GYAE6OF02F49LY.28.57.F02.1.454.CMB.1.raw
  modified_base (215)..(215): a, c, t, g, unknown or other
  misc_feature (215)..(215): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttcttgttgctatttttaaaggtgtccagtgtgaggtgctagcgttggtggagtcgtagggggngtcgttggtccagtccggtggggggtccctgagtactctccgtgtgactacgcctcgtggtacttcctaccttacgtagttacttttaattcgtacttaattggcctacggttcggggtaccccgtccggtacgggccgttaccggagggggaacggtaaccggtagggtaaaagttcgtggttacctacggtaagggtttaacgttaaggtaaagttaaccgtcggtaacggtaaaacttaaaccgtaagtttaaatttaagtttaaacgttacgtaaacccgttaaaaacgttccgtttaggggttaacggaacgggggttaaccttaacggttaacgttaaccctaaaccgttaacgttccccgttaaccggtaaaccggggtaacctttaaaccgttaacccgtaaaaccgggtaaacccgttaaccggttaaccgtttaccgtttacgtttaaaccgttacgttaaacgggtaccgggtacgtaccgggttaaacggcggttacggtaacggtccggttaaggaccgggtaaccgttacgggtaccttacggttaagttaccggtttaggttacggggtaagggtaggggtaacggtacgggtaagggttacggtttaggtacgggttaagggggttcgggtacggggcgtaaccggggg

SEQ ID NO: 269001 - DNA, 771 bp, Homo sapiens
  misc_feature: GYAE6OF02G1L70.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaggtgtccagtgtgaggtgcagctggtggagtcgtagggggaggcgttggtccaggccgtggggggtccctggagacctctcctgtgcagcctctggacttccaccgttcaagttatttatacgtctatcgtactacgtcgggtacccgccgacggtcctaccggaggggtaaacgggaccgtagggtaattaacgttcgtaccgtacggtaaggttaaacgtttaaggtaaagttaacgttacggaactaaacgtaacctaagttaatttaacgttaagtacgtaaactaaaccgttcgtagggtaacgggaacgggacccgtaaagggttaccttacctaaacccggtacgttaccctaccgggtaaacgggtaacccttaaacggtttaaccccgaaaacgtaacccgtaccggtaacgtttaccgtaactttaaccgttaacgtaaacggttaccgggacacggtacccgttagaaccgagtacgtacggacggtacgtaaccgagttagttagttagttaccggtggtacgggaacggaggtacgtaaggtaacgttcgggtaacgttagggggtacgttacggggacgtacggg

SEQ ID NO: 269002 - DNA, 814 bp, Homo sapiens
  misc_feature: GYAE6OF02ILWS6.28.57.F02.1.454.CMB.1.raw
  modified_base (725)..(725): a, c, t, g, unknown or other
  misc_feature (725)..(725): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgctatttttaaaggtgtccagtgtgaggtgcagctggtggagtcgtgggggacgtcttggtccaggccggtcgggggtcctgacgactctcctgtcgcacgtcctcgtggtacttcctaccttcagttactttagtgtccttaagtcgtaccgtacgttccggggttcccgtacccgacgggtcctaccggggaacgggggaacggggtaccgtacgggtaaagttacgttccggttccgttaaccggttaagggtttaaacgttaaggtaaaaccggtttaacgtcggtaaccgtaaaatttaaacctatttaaacggtttaatttaacggtacgtaacctaaaacgttcgttaacggtacgggaagggtacctaagttacttacctaacctacgttaccgtaccggtaaggtaaacctaaacgttaaccgaaacgtaaccgtaccgttacgttacgttaacttaccgttaacgtaaggtacgggaccgtacgtaaccgtcggaagtacggtacgtacgggaacgtaccggacgttacgttaagttacttaaggttttacggngggttacgggtaaggtacggaaggttaaccgggttaacgttaacggggtacggtttacggggttcggggtacgggtaccggtaccgggg

SEQ ID NO: 269003 - DNA, 704 bp, Homo sapiens
  misc_feature: GYAE6OF02F07X0.28.57.F02.1.454.CMB.1.raw
  modified_base (253)..(253): a, c, t, g, unknown or other
  misc_feature (253)..(253): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgtgctattttaaaggtgtccagtgtgaggtgcagctggtggagtcgtgggggagtcgttggtccaggccgtgggggtccctgacgtactcgtccngttgcacgtcctctggacttccaccttctagttattatcgtcgtatcgctacggtcgggtccgccgtaggcctcggaaggggaacggtacgtaggaatagtgtctacgtaggtatagaagtatgacgtaaatacataattattacacgaactaaacttcgtaggttaacggagggtaccaaggtaccttacgaacctacgtaccgtaccggacgtaacgtaacttaaccgaaacgtaacccacgtaccttagttaaaccgtccgttaaacgttaacgggaccgggaacgttcggacgttacggaacgttacggtacgttacggggaacgaccggtaacgtaccgttaagttattacggttacgttgggaggggtaagtaacgggtaagacgggttaacggttacgggtaaacgggttggggtacggggtacggggtaccggtaaccggggg

SEQ ID NO: 269004 - DNA, 898 bp, Homo sapiens
  misc_feature: GYAE6OF02FH4GQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagagagtcatgacggagtttgggctgagctgggttttccttgttgctatttttaaaggtgtccagtgtgaggtgcagctggtggagtctggagggagcttggtccacgccgtcggggggtccctgacgcctctcctgtgcgcgtcctcgtggtactttccacctttcgtaagttaatttttacgtcgtaccttaagtcgtacccgtaaccgttccggggggttaccccgaccccgtacggggtacccgttacccgggaaaggggggtaaaccggggtacggttaagggtaaaccgttaagttccggttaccgttaccggtaagggtttaaagtttaaacgggtaaaaggtttaacgttacggtaaccgtaaaacgtttaaaccgtaaagtttaaatttaaacgtttaacgtaaccggtaaacccttaaaacgttttaccggttaggttaacggggaacgggggtactaacgtttaaaccgtaccctaaaccccttaaggttcccctaaccgggtaaacgggttaaaacccttaaacgtttaaaccccggaaaacgtaaacccggtaacccgtaccgttttaagttaacccggttaaccgttttaaacggaaacgggttccgggggtaacctaccggtacccggttaggaacggtacgtaacgttacggaaacggttaccgacgggttattacgttatttaacggttacggtggtacgggtaaggaggtaacgggacggttaagttacgggtaacgggttacgggtacggggtccgggtaacgg

SEQ ID NO: 269005 - DNA, 790 bp, Homo sapiens
  misc_feature: GYAE6OF02GCP7P.28.57.F02.1.454.CMB.1.raw
  modified_base (639)..(639): a, c, t, g, unknown or other
  misc_feature (639)..(639): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctggagtcgttgggtttttccttggttgtctttaagtttttaaaggtgtccagttgtggaggtgcagcgtgggtggtaggtcggtaggggggacggtcgttcgggtccaggtccggtcggggggtccctaggacgccttctccgtgtacgcacgtcctacgtggtacttcctaccttacgtactttaatttagtcgtactagtcgtacgtaccgggtccgggtacccgccgtaccggtccgtaccgggaagggggtaaccggaggtagtaagtagttcgtactacgtaagggttaataacgtaaagtacgtagtaacgtaaataacttataacgttatagtacgtaaactaacgtcgtagggtaacggacggtaacgtagtaaccttccgaactacgttcccgtaaccggtaacgtaaactaaccttaaccgaaacgaactcgttactacgtttacttacgtaaacgttcggtaccggagtaacgtaccgtgtaccgngtacggtagaaccggtaccgtagttgttaaccgtacgttaaggtaccgggtaggggtacggtaacgggagggttaacccggttaaggtaacggggttaaccggttagggggtttaggggtaccgggggttacgggaacccggggttacggg

SEQ ID NO: 269006 - DNA, 726 bp, Homo sapiens
  misc_feature: GYAE6OF02F4DFF.28.57.F02.1.454.CMB.1.raw
  modified_base (145)..(145): a, c, t, g, unknown or other
  misc_feature (145)..(145): n is a, c, g, or t
  modified_base (623)..(623): a, c, t, g, unknown or other
  misc_feature (623)..(623): n is a, c, g, or t
  modified_base (629)..(629): a, c, t, g, unknown or other
  misc_feature (629)..(629): n is a, c, g, or t
  modified_base (635)..(635): a, c, t, g, unknown or other
  misc_feature (635)..(635): n is a, c, g, or t
  modified_base (644)..(644): a, c, t, g, unknown or other
  misc_feature (644)..(644): n is a, c, g, or t
  modified_base (650)..(650): a, c, t, g, unknown or other
  misc_feature (650)..(650): n is a, c, g, or t
  modified_base (657)..(657): a, c, t, g, unknown or other
  misc_feature (657)..(657): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagnttgggttttccttgttgcttatttttaaaggtgtcctagtgtgaggtgctagtctgggtggagtcgtgggggtggtcgtttggtccgaggtccgttcggggggggtcccctagacggtacgtccttccgtggtcggcacggtcccgttcgtggtaacttctaaccttcgtacgttaattttagttcgtacttagtcgtcctcgttgggggtcccgtaccggtacggccgttacccggaacgggggtaaacgggacgtaggttaaacgtaacgttcggttacggttactaacggggtttaagtttaaggaaacgtttaaggttacgggtacgttaaaaacgtttaactaagttaaactttaagtttaacgttacgtaaccgtaaaatccgtagtacgggtaacggcgtagtaaccttacgactacgtactccggtaagtactaacgtaactaacgatacgtactcgtatcctaagagcngtacgntgacgncgtagacgngtacgntacgttntacgtacgtggtaggtagtacgagttaggacggtttggaacgttagggtagggtacgggacgtacgggg

SEQ ID NO: 269007 - DNA, 730 bp, Homo sapiens
  misc_feature: GYAE6OF02HKGRP.28.57.F02.1.454.CMB.1.raw
  modified_base (225)..(225): a, c, t, g, unknown or other
  misc_feature (225)..(225): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
  modified_base (349)..(349): a, c, t, g, unknown or other
  misc_feature (349)..(349): n is a, c, g, or t
  modified_base (434)..(434): a, c, t, g, unknown or other
  misc_feature (434)..(434): n is a, c, g, or t
  modified_base (607)..(607): a, c, t, g, unknown or other
  misc_feature (607)..(607): n is a, c, g, or t
  modified_base (641)..(641): a, c, t, g, unknown or other
  misc_feature (641)..(641): n is a, c, g, or t
tcagagtacgctatcacgaccggtgctcgatttagctcgatatagttggggtctgggagaggagcccccgccctgggtttcccaggtgttctcatttggtgatcagcactgcacacagaagagtcatcgacggagtttgggctgagcgttgggtttttcctgttgtcttagtttttaaaggcgttccagtgtcgaggtgcagtctggtggagttcggtagggggngtcgttcggtccaggtccggtcgggggggtaccctggcgtacttcctccgtgtcgcacgtccctgtgacttccgtaccctttnacgtttatttancgtctagtcgcctacggttcggggtcccnccggaggtcccgttaccgggaagggggaacgggtactagggtaattcgtacgtactcggtaaggttaagttaaagtaacgttaanacggtaaccgtaaattaactaagttaattaagtttcgaactaactaacgttcgttaagggacggtaacggtacacgttactaacccgctaacgtccgtaacgacggtaataaccgtaccaaacgtaccgtacgtcgtagtcttaacgtaacgtagtcggactacggtaccgtnaacggtcgtaccgaggtaaccgcgttaaccggtnttaaggtacttagtaccggtggacggaaggacggtacggtacgtacgttacggggtaacgttggggtacgggcggtacccgtaacgggg

SEQ ID NO: 269008 - DNA, 754 bp, Homo sapiens
  misc_feature: GYAE6OF02GW5NN.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgttggagtcgtgggggagcttggtccaggccgtggggggtccctgagtactctcctgtcgcacgcctcgtggacttccaccctttgaagttatttatgtcttatgacctacgtcgggtcccgaccgacgggtcctaccggaaggggaacggggtacgtagggtaaattagttcggttactacgtaaggttaagttaaggtaaagttaacgtacggaacgtaaaataaacgtaatttaagtttaattacgtacgtaaaccttaaacgttcggtaagggtaggaacgggtacgtaaggttaccttacccgtaacctaccgttacccgtaaccgggaaacgggtaaaccttaaaccgttaacccgaaaacggtaaacccgttaccgtacgtttaccggttaacttaccgttaaaccgaaggtacgggactacggtaccgtaaggaccgtacgtacgtagggaaccgacggacgttgttaagtacgttagttacggtgggtacggaaggagggtacgtaggtagttacgggtacggttagggtcggtacggggtcgtaacggg

SEQ ID NO: 269009 - DNA, 742 bp, Homo sapiens
  misc_feature: GYAE6OF02G2414.28.57.F02.1.454.CMB.1.raw
  modified_base (488)..(488): a, c, t, g, unknown or other
  misc_feature (488)..(488): n is a, c, g, or t
  modified_base (663)..(663): a, c, t, g, unknown or other
  misc_feature (663)..(663): n is a, c, g, or t
tcagagtacgctatcacgaccggtgctcgatttagctcgatatagttggtcgtggagaggagcccccgccctgggtttcccgaggtgttctcatttggtgatcagcactgcacacagaagagtcatgacggtagtttgggctgaagtcgttgggtttttccttgttcgcttaagttttttaaaggtgtcctagtgtcgtagggtgcagcgtgggtggagttcggtagggggaggtcgttggttccgagtccgggttggggggtccctaggacgtactctaccgtgtgcacggtccctatcggtacttccttaccgttactagttatttatcgtcctagtcgactccgttcgggtccccgccgtacggccgtaaccgggacggggtaaggaccggtaggtaaacgttgttcggtccgttacgtaggttaatttaaggaagttaaagtccggaattaaaagtaactaattgtaattactacgacttaacngttaggtagaacgtagtagtactaccgacactccgtacgacggaactactaaccgaaagtaccacggtacttacgtactttacgaacgtttaaacgtcggagtaccgtacgtagaaacggagaccgttggaacggacgttacgggtactagtttacgttaagtcgggttaacggnggggtaacgtagggaacggtaaggtacggtttaacggtaaggggttaggggttttcggaacgggcccggtaaacggggg

SEQ ID NO: 269010 - DNA, 821 bp, Homo sapiens
  misc_feature: GYAE6OF02JAFYD.28.57.F02.1.454.CMB.1.raw
tcagagtacgctatcacgaccggtgctcgatttagctcgatatagttgggtctgggataggagcccccgccctgggtttcccaggtgttctcatttggtgatcagcactgcacacagaagagtcatgacgggtagtttgggctggagcgttgggttttccttgttgacttaagtttttaaaggtcgtccagtgtgaggtgcgtagcgtggtgggagtcggtggggggacggtcgttcgggtccacgggccggttcgggggggttccctggacgtacctcctccgtgtcgcacgcctacgtggtacttccgtaccttcgtaagtttatttatcgtactacgtcggacctacggtccggggtcccgaccggtacgggtaccgtaccggggaaggggtaacgggtaacggtagggtaaatacgttcggtacgtacggttaaggttaacgttaaaggtaaacgttaactacggtaaacgtaaattaaacgtattaaacgtttagttaacgtaacgtaaaccgtaaaccgtttgtaacggttaacgggaagggtactagttaccctaacgtaccgttacgtaccgtaaccggaagtaaccgtaacttaccggaaacttacgaccgttatacgttaattcccgtaacgtacggtgaccgtcgtaacgttaggaacggttcgaccgtacgggaaccgtacggtaacgtacgttaagttaccgttagtacccggggtagggtaacgggaacgggttaggtaaccggtaaggttacgggttaacgggtacgggttacgggttcggggtaacgggtcccggttaaccgggg

SEQ ID NO: 269011 - DNA, 792 bp, Homo sapiens
  misc_feature: GYAE6OF02FN5Q4.28.57.F02.1.454.CMB.1.raw
  modified_base (190)..(190): a, c, t, g, unknown or other
  misc_feature (190)..(190): n is a, c, g, or t
  modified_base (288)..(288): a, c, t, g, unknown or other
  misc_feature (288)..(288): n is a, c, g, or t
  modified_base (327)..(327): a, c, t, g, unknown or other
  misc_feature (327)..(327): n is a, c, g, or t
tcagagtacgctatcacgaccggtgctcgatttagctcgatatagttgggtctgggagaggagccccccgccctgggtttccccaggtgttctcatttggtgatcagcactgcacacagaagagtcatgacggatttgggctgagctgggttttcctgttgcttattttaaggtgtccagtgtgaggtcncagctggtggagtccgtgggggagcttggccaggccgtgggggtccctgagtacctcctccttggtcgacacgcctcgtaggtactttccaccctttnagtttactttaagtcgctatcgactacgttcgggtcccncgaggtccctaccggaaggggtaacggaccgtaggtaaagttacgttggtaccttacggtacggttacgtttaagaaagttaacggtcgtaaacggtaaacttaaacgtatttaaggttaattagtaccggtaacttaaaccgttcttagggaacggtaacggtaccgagttaaaccttaccgacccctaagttaccccgtaacccggtaaccgggtaaacttaacccgttaacccggaaaaggtaaccccttacgggacctttaagggtttaacctcccgttaaacggaaaggtttacccggacggttccgaccgtttagggaacccgtgtacccggtaaggaaccgtacgtacggtacctttgtaacgtccgttttaagggcgggagggtacggaaaccgggtttggtaaccggtaaggtttccggaaaggtttggggttaacggccggggtacgtaaccggg

SEQ ID NO: 269012 - DNA, 700 bp, Homo sapiens
  misc_feature: GYAE6OF02HBWKB.28.57.F02.1.454.CMB.1.raw
  modified_base (390)..(390): a, c, t, g, unknown or other
  misc_feature (390)..(390): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaggtgtccagtgtgaggtgcagcgtggtcggagtcgtgggggagcgttggtccgagccggtgggggtccctaggagtactctcctgtgcacgctgtgacttcctaccttactagttatttatgtctatacgtctacgtcggtccgccgacggccgtcgagggaaggctaggatagtgtctagtagtacgtagaagtataggataatatatataattanagtactaaacgtcgtaggaggaaggctaaggtacttacccactaacgttccgtaccggaaaggtaacctaacgttaaccgaaacgtaacctaccgttgttacgttactacgttaaacgtaacgtcgggtacgacgtacgtacggtacgtaggtaccgtacggtaaacgggccgtaacggtacgttacgtagtttaccgttaacgggttaggtacggggtaacgtaacggggagggtaaacggtttaacggtttacgggggtaaggtttacgggggtttaccggggtacgggtacccggggtaaccggggg

SEQ ID NO: 269013 - DNA, 734 bp, Homo sapiens
  misc_feature: GYAE6OF02HF1TV.28.57.F02.1.454.CMB.1.raw
  modified_base (294)..(294): a, c, t, g, unknown or other
  misc_feature (294)..(294): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagcgtggtggagtcgtgggggaggcgttggtccgaggccgtggggggtccctggagactctcctgtgcagcctcgtggtacttccaccttcgagttattttangtctatgctacgtcgggtccgaccgacggtccgtccgaaggggaacgggtacgtacgggaattagtcgtcttacgtaagggttaacgttaaggtaaaggttaaagtacggtaacgtaaaactaaacgtaatttaacgtttaaatttaacgtacgtaactaaaaccgttacgttacggtaagggtaacgggactaagtaacttcccgaacccgtaacgttccctaccgggaagggtaaaccttacgttaacccaaaacggaactaccggtacgttacgttaactaccgttaaacgaaagtcgggaccaggcccgttagacgtagcgtaagaacggacgtacggtattgtaacttagttacgggggtaacgggagtaacgggaagtacggtaaggtttacggtaacgggtttaggggttcggtaccggggacgtaaccgggg

SEQ ID NO: 269014 - DNA, 741 bp, Homo sapiens
  misc_feature: GYAE6OF02ISZXR.28.57.F02.1.454.CMB.1.raw
  modified_base (309)..(309): a, c, t, g, unknown or other
  misc_feature (309)..(309): n is a, c, g, or t
  modified_base (565)..(565): a, c, t, g, unknown or other
  misc_feature (565)..(565): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctatttttaaagtgtccagtgtgaggtgcagctggtggagtcgtgggggagcttggtccagccgtggggggtccctgagactctcgtgtgcacgcctctggacttcaccttcagttatttacgtgtctatcgctacgtccgggtacccnccgaggtcctccggaaggggaacgggtacgtagggaacttagtcgtcctacgaaggttataaggtaacgtaacgtcgaacgtaaacttaaacgagttaacttaagttagtcggaactaaacttgttacggtaggaacgggtactaaggtacctttaccgaacctagttacccgtaccggaagggtaacctaaacttacccgaaacggaaacccgtcggttcttaggtaaccttaccgttaacgaaaggttccgganaaccgttcgaaggacgaggtcgtacggaacggacgtacggtcgtttagttaacgttactttaccggggtaggttaacccgggggaaggtaacgggtacggttaacggggttaacggtttaacgggggtaaacggtttggggggttaccgggtacggggggttacccggaacggggg

SEQ ID NO: 269015 - DNA, 841 bp, Homo sapiens
  misc_feature: GYAE6OF02H338Z.28.57.F02.1.454.CMB.1.raw
tcagagtacgctatcacgaccggtgctcgatttagctcgatatagttgggtctgggagaggagcccccgccctgggtttccccaggtgttctcatttggtgatcagcactgcacacagaagagtcatgaacggagtttgggctgagcttgggttttccttgttgtcttatttttaaaggtgtccagtgtgaggtgcagctggtggagtcgtgggggagcttggtccaggccgtggggggtccctgagctctccgtgtgcagcctacgtggtattcctaccgtttctagttatttatgtactatcgctacggtcggtcccgaccgtacggtccgtaccgaagggaacggtacgtacggtaatacgtgtacgtacgtaaggttaacgtaaggtaaacggttaagtacggaaccggttaaaacttaaactaagtttaaacgtttaaaatttacgttaacggtaaaccgtaaaacctttcggttaacgggtaacgggtaacggggtaaccgtaaaggtttaacctttacccaaaccccgttacgttaaccccgtaaccggtaaacgggtaaaccttaaaccgttaaacccgaaaaggtaaaccccgtaaccgttaccgttaacgttaaccgtttaaccgttaaacgtaaacggtaccgggtaacgtaccgtaaccgtacggtaacgtacggtaaccgtgggtaaccggaaccggtaaccggttactaacggttacttaacggtttaccggtgggttacggggtaacggaagggtacggacgggttaagtttacggggtaacggtttacgggggttgggttacgggggaacccggttaaccggggg

SEQ ID NO: 269016 - DNA, 871 bp, Homo sapiens
  misc_feature: GYAE6OF02JUODQ.28.57.F02.1.454.CMB.1.raw
  modified_base (221)..(221): a, c, t, g, unknown or other
  misc_feature (221)..(221): n is a, c, g, or t
tcagagtacgctatcacgaccggtgctcgatttagctcgatatagttgggtctgggagaggagcccccgcccctcgggtttccctaggtgttctcatttggtgatcagcactgcacacagaagagtcatgacggtagttgggctgagcttgggttttcctttgttgtctatttttaaaggtgtccagtgtgaggtgcagctggtaggagtcgtgggggagngttcggtccagccggttgggggtccctgacgctctcgtgtcgacagtcctgtaggtattcctaccttcagttactttatgactgtcgactcggtacggttcccgccgtaggtcctaccggaaggggtaaggggacttaagggtaacttcgttgttaccggtacggttaacggttaagttaaaggtaacgtaaagtcggtaaaccgtaaacttaaacgttaagttaaatttaaagtttacgtaacgaacgttaaaacccgtttgggttaccgggtaaaagggtaacgggtaccgttaaggtaaccctttacccaaacggtaccgtttaccccggtaacccgggtaaaccggaaaccccgtttaaagtaaaccccggaaaccggtaaaacccgttaccggttacttttaacggttaccgtttaaaccgttaaccgtaaacgggttacgggaaccgtacccggtaacccggttacggaaccgtaacggtaccggtaaacggggtaccgggtacccgtaacggttaccgtaagggtttaactttccgtttaaacgggtgggtaacggggtaaggagggtttaaccggaaggtaaacgggttttacgggaaaccggttttgggggttacggttacccggggtacccgggtaacgg

SEQ ID NO: 269017 - DNA, 731 bp, Homo sapiens
  misc_feature: GYAE6OF02JNYA9.28.57.F02.1.454.CMB.1.raw
  modified_base (266)..(266): a, c, t, g, unknown or other
  misc_feature (266)..(266): n is a, c, g, or t
  modified_base (313)..(313): a, c, t, g, unknown or other
  misc_feature (313)..(313): n is a, c, g, or t
  modified_base (452)..(452): a, c, t, g, unknown or other
  misc_feature (452)..(452): n is a, c, g, or t
  modified_base (499)..(499): a, c, t, g, unknown or other
  misc_feature (499)..(499): n is a, c, g, or t
  modified_base (632)..(632): a, c, t, g, unknown or other
  misc_feature (632)..(632): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcgttgggttttccttgttgcttaagtttttaaaggtgtccagtgtggaggtgcagcgtggtggagtcgtgggggagtcttgggtccagtccggtggggggtccctgagtaccgtcttccgngtcgctacggccttagcggtacttacgtaccttcgtaggttaatttncgtccgtaatcgaccgtcggtcggggttccacccggtaggtcccagggtaacggggtacggtacctagggtaatcgtcggtcacgtaagggtttattaaggaaagttacgacgtagaaaactgtaactagttacgttanaacgtctaaacgttctaggacggtaaggactacgttacgtactactnttaccgtacggtaacggacctttaacggaaccaaacggtaccgaacgttaccgtagtaccttacgtaaccgtaaagcgtaccgtacgtaccgtgaacggtcgtaacggtagaccgggttacaaacccgggttnttacgtagttacggttacgggtagggtaggacggtaggtaaccggtaggttaacgggtacggtacggggttaacgggtcgggacgggtacgtaccgggg

SEQ ID NO: 269018 - DNA, 558 bp, Homo sapiens
  misc_feature: GYAE6OF02INLBW.28.57.F02.1.454.CMB.1.raw
  modified_base (206)..(206): a, c, t, g, unknown or other
  misc_feature (206)..(206): n is a, c, g, or t
  modified_base (403)..(403): a, c, t, g, unknown or other
  misc_feature (403)..(403): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (460)..(461): a, c, t, g, unknown or other
  misc_feature (460)..(461): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
  modified_base (500)..(500): a, c, t, g, unknown or other
  misc_feature (500)..(500): n is a, c, g, or t
  modified_base (557)..(557): a, c, t, g, unknown or other
  misc_feature (557)..(557): n is a, c, g, or t
tcagagtacgctatcacgaccggtgctcgatttagctcgatatagttgggtttggggggtccctgagactctcctgtgcagcctctggattcaccttcagttatttatgctatgcacgtgggtcccgccaggctccgagggaagggctggaatatgtctcaggtattaagaagtaatcgacgaataacatattatagtgacaactntgtggaaggcagattcactactctacgaggaactaactaccaaagtaccacgtctagtactaccgttacaaggtacggcaagtcctaggagacgcgtaggacgacgtcggtcttaggtaattcgtacgtggacggagtaggacggagtaagtgtaacggttgggttgacgggcgaacgtcgccgtaggtcacgtccntccgcgccgtacacggcgctcgtcgtcctccgcgctcgtcncngcgcgcgacgcgcnncgcncgcgccgngcncgtcgtacgacgacgactccgtanacgtacgtcgtaccgtgtcgcggtcgacggtcggacgtacgcgtacgatcgcgtgcng

SEQ ID NO: 269019 - DNA, 804 bp, Homo sapiens
  misc_feature: GYAE6OF02F8UZP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttatttttaaaggtgtccagtgtgaggtgcagctggtggagtcgtgggggaggtcgttggtccaggccggttcggggggtccctggacgacctcctccgtgtcgacacgtccttcgtggtacttcctacccttacgtagtttattttagtgtacttatcggacctaccggttcggggtcccccgacccgtacgggtaccctacccggggtaaggggggaaacggggtaccgttagggtaaaacgttagttaccggttaccttacgtaagggtttaagtttaaacggtaaaagttaacgtacggtaaaccgtaaattaaacctaatttaattaatttaacgtacgtaaccttaaacttccggttagggtaaggtaacgggactaacggtacttacccaacctacttcccgtaaccggaacgggtaaacctaacgttaacccgaaacgtaacacgggtacttacgttaacttaccgtaacgtaaggtcgggtaccacggtccgtaggtacgagtacgaggtaaccgaacgtcgtacgttagttactacgtttaggacggggtacgagggtaaccggtaggtaacggtaaggttaacgggtaacgggttcgggggttacgggtaccggggtaacgtaccgggg

SEQ ID NO: 269020 - DNA, 759 bp, Homo sapiens
  misc_feature: GYAE6OF02G9URF.28.57.F02.1.454.CMB.1.raw
  modified_base (481)..(481): a, c, t, g, unknown or other
  misc_feature (481)..(481): n is a, c, g, or t
tcagagtacgctatcacgaccggtgctcgatttagctcgatatagttgggtctgggagaggagcccccgccctgggtttcccaggtgttctcgatttggtgatcagcactgcacacagaagagtcatgacggtagtttgggctgagtcgttgggttttccttgttgcttagtttttaaaggtgtcctagtgtggaggtgcagctgggtggagtcggtgggggtaggtcgttcgggtcccagggtcccgggttcgggggggttccccctaggtacggtaccttcccgttaccgttggtacggccgtaacgtccccgttggttacggtaacctttccctacccttttacgtaaggtttattttacgtaggtaccttagtcgtaccgtaccggttcgggtcccgaccgacggtccgtacggaaggggtacggactggtaatgtcgtactacgtagtaagttaagtaagtacgacgtacaataanacttaagtactatacgtactaacgttcgtaggtacggacggtacgtaacggttaacttacccgtaaccgtacttaccggtaccgaacggtaactaaagttaccaaaccggtaacacgtacttcgttaacttacgtaacgaacggtggacctacgcgtagacgacgcgtaagacggacgtacgtaacttgttacgtagttagggtagggacggaaggtggacggtaagtaggttaacgggttcgttaagggggttcgggtacgggtccggtaaccgggg

SEQ ID NO: 269021 - DNA, 809 bp, Homo sapiens
  misc_feature: GYAE6OF02HNIHF.28.57.F02.1.454.CMB.1.raw
  modified_base (687)..(687): a, c, t, g, unknown or other
  misc_feature (687)..(687): n is a, c, g, or t
  modified_base (695)..(695): a, c, t, g, unknown or other
  misc_feature (695)..(695): n is a, c, g, or t
  modified_base (736)..(736): a, c, t, g, unknown or other
  misc_feature (736)..(736): n is a, c, g, or t
  modified_base (762)..(762): a, c, t, g, unknown or other
  misc_feature (762)..(762): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggctgagtcgttgggttttccttgttgtcttaagtttttaaacggtgtaccgtagtgtggaggtgcgagtcgtggtggagttcggtaggggacgtcgttacggtccgaggtccggtcggggggtccctaggacgtccttccgtccgtggtagccgtacggtcccgttcgtacggtacctttacccgtaccgtttacgtaacgtttagttttacgtacggtaccttaagtcggtacccggttaccgggttcccggggttaccccgtacccggtaacgggttaccccggttaaccgggggtaacgggggtaaaccgggttaccggtaagggttaaaacggttaccggtttacggtaccgtttaacgggttaaacggtttaagttaacggttaaaggttaacgtacggtaacgttaaaacgttaagttaattaggtttaacttagtaccgtaacgtaacgttacgtagggtaacggaaggtaccgtaagtacccttcgaaccttgttaccccgaaggttagaaccttaacgacgtaaacgactacgtagtctanacgttaanacgtcgatccgacgttgactagcgagaccggtaatcgttanagttacgtagtgacgggtaggaacgngtacggtagtacggtaacggtaggttgggtacgccgggtagtaccgg

SEQ ID NO: 269022 - DNA, 682 bp, Homo sapiens
  misc_feature: GYAE6OF02GTIF4.28.57.F02.1.454.CMB.1.raw
  modified_base (280)..(280): a, c, t, g, unknown or other
  misc_feature (280)..(280): n is a, c, g, or t
  modified_base (589)..(589): a, c, t, g, unknown or other
  misc_feature (589)..(589): n is a, c, g, or t
  modified_base (606)..(606): a, c, t, g, unknown or other
  misc_feature (606)..(606): n is a, c, g, or t
  modified_base (635)..(635): a, c, t, g, unknown or other
  misc_feature (635)..(635): n is a, c, g, or t
  modified_base (672)..(672): a, c, t, g, unknown or other
  misc_feature (672)..(672): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacgggagtttgggctggagcgttgggtttttccttgttgcttaatttttaaaggtgtccagtgtgaggtgcagcttggtggagtcgtggggggaggtgttcggccaggccgtggggggtccctgacgactctccgtgtcgcagcctgtggtnttccaccttcagttatttatgctagttgctacgtcgggtcccgaccgacggtcctaccggaaggggtaacgggactagggtaactagtgtacctacgtaggtaagttaaggaaagttatacgtacgtaaataactaattaactttattaagacgtaactaaaccgttgttagggtaacggaacggggtactaaacggctttaacccaaccgatttaccccacccgggaaaggtaactaaacttaaccggaaacaaccgaccgtagtacttacttactaagaaacgtgggtaccacggtacctaggaacngtccaggacgactacgnttaagttcaggttacgtgggtaaggacgnggaacgaggttaacggtggtaacggttggtaccgggngggactgggg

SEQ ID NO: 269023 - DNA, 688 bp, Homo sapiens
  misc_feature: GYAE6OF02I8V0J.28.57.F02.1.454.CMB.1.raw
  modified_base (290)..(290): a, c, t, g, unknown or other
  misc_feature (290)..(290): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggagcttggtccagtccgtggggggtccctgacgactctcctgtcgcagcctcgtggtacttccaccttcagttatttangtctatgctacgtcggtccgccgaggccgtaccggtagggaacggtctaggaatagtgtacgtcgaggttatagtaagtaatcgaacgaataacattaagtaatttatacgaactaacgttcgtaggttaggaacgggtactagtaccgttaccaaccgttagtcccgtaccggaaagggttaacctaaacgttaccgaaagtaacccgcgtatttacgtacttacctaaacgtaaacggtgggtaaaccgtccgtaccgtagaacgttagcgttaagggaaccgtaaccgcgttatagttacttacgttacggtgggtagggaaggtacgggaaccgttaggttaacggttacgggtaacggtttaggggtccgggttacgggaccggtaaccgggg

SEQ ID NO: 269024 - DNA, 718 bp, Homo sapiens
  misc_feature: GYAE6OF02JBPXI.28.57.F02.1.454.CMB.1.raw
  modified_base (662)..(662): a, c, t, g, unknown or other
  misc_feature (662)..(662): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggttttccttgttgcttaattttttaaaggtgtccagtgtggaggtgcagtcgtggtggagtcgtgggggagtcgttggtccagccggtgggggtccctgagtactcctcgtggtcgcacgcctcgtgacttccgaccttcagtttaactttatcgtacttatccgactacggttcggtccccggccgtaacggtcccgttaccggaacgggggaacgggtaccgttaggaacttagtcgttccgtacgtagggttaaacgttaaggaaagtacgtggtaacgtaaataacgtatttaatttaacttaacgtcgtaaacctaaccgttcgtagggtacggtaacggataacgtacttacaaccgtcttaccgtaccggtaaacggaccttaacgttaccgaaaccgtaacgtaccgtaacgttcgttactaccgttaacgtaaacgtcggacgtaccgtacgtaggacgtgtacgtagaccggtaatccggtattagttactaggttaccgnggttaggaggtaggtacggagttacgtggtaacggttggtgggacgtcgggtacgg

SEQ ID NO: 269025 - DNA, 791 bp, Homo sapiens
  misc_feature: GYAE6OF02GQRLY.28.57.F02.1.454.CMB.1.raw
  modified_base (126)..(126): a, c, t, g, unknown or other
  misc_feature (126)..(126): n is a, c, g, or t
  modified_base (152)..(152): a, c, t, g, unknown or other
  misc_feature (152)..(152): n is a, c, g, or t
  modified_base (158)..(158): a, c, t, g, unknown or other
  misc_feature (158)..(158): n is a, c, g, or t
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (787)..(787): a, c, t, g, unknown or other
  misc_feature (787)..(787): n is a, c, g, or t
tcagagtacgctatcacgaccggtgctcgatttagctcgatatagttgggtttggggggtccctgagactctcctgtgcagcctctggattcaccttcagtatttatgctatgctacgtgggtccnccaggctccgagggaggactggaatntgtctntaggtattagtaagtatgacgaaataacatataattatgacaacttcngaggaggntagatcacatctacgaggactatacaagaacncgntagtacttcttaacgtaaacgtcggactacgtccgtagagtaacgcgtaggaacggaccgacggcttaggtaatacgttacggtaggtagggacgaggtacggacgtaagtagggtaacgttgggggttacggcggggtaccggaagggtaccgtaccggttcggtaccgtacccgttccgtaccgtccgtaaccgcccgtaaccccggaacggaacccgggtccccgtacggttaccccgtcccgtttcccccggtcggtcccccgtcccgtccgttacccgtcccgggtaacggtccggtacccgtacccggttacccggaaaccggtaccggtccccgaacggacccgggtccccggtaccgggttccgggtaccggtcccggtaccgggtaccggttaacccggtaaaccgttacccgtttaacccggtaccctaaacggtccgggtacccttacggttccggacgggtacgggtacccgggtcccggaacggtacccggtagggtacccgaccggttacggtagccgtacggnaagg

SEQ ID NO: 269026 - DNA, 201 bp, Homo sapiens
  misc_feature: GYAE6OF02IH59U.28.57.F02.1.454.CMB.1.raw
  modified_base (114)..(114): a, c, t, g, unknown or other
  misc_feature (114)..(114): n is a, c, g, or t
  modified_base (146)..(201): a, c, t, g, unknown or other
  misc_feature (146)..(201): n is a, c, g, or t
tcagagtacgctatcacgaccggtgctcgatttagctcgatatagttgggtctgggagaggagccccccgccctgggtttcccaggtgttctcatttggtgatcagcactgcanacagaagagtcatgagggagttttggggctannnnnnnnnnnnnnnnnnnnnnnnnnnnnnnnnnnnnnnnnnnnnnnnnnnnnnnn

SEQ ID NO: 269027 - DNA, 917 bp, Homo sapiens
  misc_feature: GYAE6OF02JA509.28.57.F02.1.454.CMB.1.raw
  modified_base (121)..(121): a, c, t, g, unknown or other
  misc_feature (121)..(121): n is a, c, g, or t
tcagagtacgctatcacgaccggtgctcgatttagctcgatatagttgggtctgggagaggagcccccgccctgggtttcccaggtgttctcatttggtgatcagcactgcacacagaagngtcatgacggagtttgggctgagcgttgggttttccttgttgcttaagtttttaaaggtcgtccagtgtgaggtgcagtcgtgggtggtacggtcgggtaggggacgtcgttacggtccgacggtccggggtcgggggtcctaggacgtaccttccgttccgtaggtcgtccgacgtcctacggtacgtaccttaccttaccgttacgtagtttaagtttacgtcgtaccgttaagtcgaccgtcgggttcccgggtaccccgtacggtaccggtacccggtaaccggggtaacggggtaacggggtaacgtaaggttaaacgttcgttacgttaccggtaaggttaacgggttaaattaaagggtaaagttaacggtaaccggtaaacgtaaaacgttaaacttaaagtttaaatttaacgtttaacggaaaccgttaacgtttaaaaccggtttcgggttaaacgggtaacggggtaaaccggtaacgtacggtttaaccctaacccgttaacccgtaccgtttaaccccgggaaccggtaaacggaaccctttaaacgtaaacccgtaaaccgtaacccgtaccggtttaagttaccgtttaacttaaccgggttaaactaacgggtcgtacctaccgggttacgtacgggacgttacgggtcgtaaaccgggtacgggacgttaccggtagttaacgttattaaccggtgtaacggggaaggttacggaggtacggttaaggtacggttaacggtacgggttacgggtaccgggtacggacgggttaccggg

SEQ ID NO: 269028 - DNA, 733 bp, Homo sapiens
  misc_feature: GYAE6OF02H3SJI.28.57.F02.1.454.CMB.1.raw
  modified_base (178)..(178): a, c, t, g, unknown or other
  misc_feature (178)..(178): n is a, c, g, or t
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (320)..(320): a, c, t, g, unknown or other
  misc_feature (320)..(320): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagctgggttttccttgttgcttattttttaaaggntccagtgtgaggtgcngctggtggagtcgtgggggagcgttggccaggccgtgggggtccctggagactctcctgtgcagcctcgtggacttccgtaccttcgagttactttaancgtctatcgtcgtacgtcggggtcccncgacggtccgtaccgggaagggaacgggtacttaggaaacttcgttcggtacctacggtaacggttaattaaacgggtaaataacgtacggaaccgtaaagtaaactataagtttaattaacgacgtactaaacgttcgtagggtaaggaacgggtacacgtttatacccaacgtccttaccgtaccggtaaggtaaacttaacccgtaccgaaacgggtaccctaacggttcgttaatacccttacgttaacgaaagggtccggaataacccggcgtaaggtagcgaacggttaggaccggtataccgacgtttacgttaacttaggtcggttaaggaacgggtgaagggacggttaacggaggttttacggggaccggttaggggtacccgggtcgggtaccgaacggggg

SEQ ID NO: 269029 - DNA, 800 bp, Homo sapiens
  misc_feature: GYAE6OF02GZM4L.28.57.F02.1.454.CMB.1.raw
  modified_base (339)..(339): a, c, t, g, unknown or other
  misc_feature (339)..(339): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaatttttaaaggtgtccagtgtgaggtgcagtctggtggagtcggtgggggaggtcttggtccgagccggtggggggtccctgagtactctccgtgtgcacgtcctcgtaggtacttcctaccttcgaagtttattttatcggtacttagtcgtactaccgttcggggtcccnccggacggtccgtccggaaggggtaacgggtacgtacggaaattacggtcgtctacgtaaggttagttaacgaagttaacgtagtaaaccggtaaattaaacgatttaaacgttaattaacgtacgtaacctaaaaccgttcgttaaggtacgggtaacgggtacgtaacgtacgtttacccaaccgtaccgttacccggtaaacccggacgggtaaacctaaacccgtttaaaccgaaaccggtaaaccgtaacgttaccgtttacggttaacctttacgttaaacgtaaacggtcgggaaccgtagtacccgtttaggaaacgtcggtacggtaacggtaaggacccgtacggtattaaggttacgtttaacgtacggtaagggtagggtaaggaacggtacggtaacggtaaggttacggaacggtttgggtaacggggtcgggtaacccggtacggg

SEQ ID NO: 269030 - DNA, 939 bp, Homo sapiens
  misc_feature: GYAE6OF02JHDO7.28.57.F02.1.454.CMB.1.raw
tcagagtacgctatcacgaccggtgctcgatttagctcgatatagttgggtcgtgggagaggacgcccccgccctgggtttcccaggtgttctcatttggtgatcagcgacctgcacacagaaggagtcatcggacggtagtttggggccgtgacgtcgttgggtttttcccttggttgtcttaagtttttaaacggtcgttaccagttgtggaggtcgacagtcgtggtggagtcggtgggggaggtcgttgggtccgacggccggttacgggggggttccctggacgtaccttccgtccgtgtcggcgacgtccgtcgtaggtacttaccgtaccgttactaaggtttaacttttaacgtcggtacttacgttagacccgttaccggttaccggggtaccccgaccggaacgggtacccttaccgggaaggggtaaccgggagttacgggtaaagttaacgtttcggttaccgtacggtaaacggtttagttaaacggtaaacggttaacggttacggtaaaccgtaaagttaaactaaggtttaaacttaacggtttaagaccggttaaaccctaaagtttccggtgggaaaaccgggtaagggtacttaagttaccgttaaccctaacccgttaccgttaccgtaacccgtaacgggtaaacctaaccggttaaccgaaaaccgtaacccgttaccgtacgttaacgttacgtttaaccgttaaaccgtaaaggtaccgggtaacgttaacccgttacgttaacgtaacgggtaaccgtacggttaacgaaccggtaaccgtacggttacgttaccgtacgtttaaccggtaggttaacggggtacggttaagggaacgggttaaccgggtaaggtacgggttaacgggttaacgggttacggggtacgggtaccgggtaccgggtaaccggggg

SEQ ID NO: 269031 - DNA, 798 bp, Homo sapiens
  misc_feature: GYAE6OF02JTKWM.28.57.F02.1.454.CMB.1.raw
  modified_base (740)..(740): a, c, t, g, unknown or other
  misc_feature (740)..(740): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggctgagcgttggttttccttgttgtcttagtttttaaaggtgtcctagtgtgaggtgcgagtctggtggagttcggtgggggagcgttggtccgaggtccggtgggggtccctggagtacgtcctccgtgtcgcgacgtcctcgtggtacttccgtaccgttcgtaacgtttatttagtcgtacgttagtcgtaccgtaacggtccgggtcccgaccgaccggtacgtacccgggaaggggttaaccgggtactagggtaacttggttcgtaccgtacggtaaggttaagtaaagtaacggttaagcggtaacgttaaagtaacttaaacttacgtaaagtttcgtaaaccgtaacttaaacgttacgtagggaacggtaagggtaaccgtaacggtaccgttaacctaacgtaccgtaacgtaacccgggtaaacgttaaaccaaccgttaaacgtaaacggaacccttaggttacttttaaccgttaacgttaccgttaaacgtaaaggtaccggtacgtccgttaacggtaagacggttaaccgaggttacgaaccgtacgtacgttacgttattaccgtacgttacggaggtaaccggngttacggacggttaaggtacgtagggttacggttaggtacgggttacgaacgggtagg

SEQ ID NO: 269032 - DNA, 743 bp, Homo sapiens
  misc_feature: GYAE6OF02F1N4D.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttggggctgagcttgggttttccttgttgcttatttttaaaggtgtccagtgtgaggtgcagctggtggagtcgtgggggaggcttggtccaggccgtggggggtccctgagactctctgtgcacgcctcgtggattccgaccttctagttattttactgtacttatcgacctacgttcggggtcccaccgacggcctaccgggaggggaacgggtaccgtaggtaatagtcggttctacggtagttagttaagtaagtacgtgaacgtaacgtaatataatttagtagtacgaactaacgtcgttaggtaggaacgggactaagttactacaccctataccgtacgacggtaaacctaacgtacctaaacggactaccggtattacgttacttaaccttacgtaaaggttccggggactacgggtacgtacgggacgtacgggtaccggttagggaaacggtaccggtaacgggttacctacgtttattaccggttacgggttggggtaaggggtaacgggtaacgggtaggtaaccggggtaaggtttaccgggggaaaaccggttttggggggttacggggtaccggggtacccggtaacggggg

SEQ ID NO: 269033 - DNA, 746 bp, Homo sapiens
  misc_feature: GYAE6OF02GWTJP.28.57.F02.1.454.CMB.1.raw
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgctaatttttaaaggtgtccagtgtggaggtgcagctggtggagtcgtgggggagnttgggtcagtccgtcggggggtccctgacgactctcctgtagcacggtcctcgtggactcctaaccttctaggttaactttagtcgacttactgaccnggttcgggtcccacgacggccgtaccggaaggggacgggtaacctgggtaaacgttctggtacttaccggaggtttaagttaaaggtaaacggtattcgggaactaaaactacttaactaagtttattaatcggtaaacctaacgtcgttacggaggtaacgggactacgactttacaacctacgttaccgacggtacggtaactaaccgttaacggaaaccgttaacgacgtacttccgttaagttacccttaagttaacgaggtaccgtaaccgacgttacgggaacggtacgttacgaaccgggtaacgagtaaccggggtaccttaaggttacttaacgtttacggttggagggtacggaacgggtaggtacggttaaagggttacggttaacgggtagggttttacgggaccgggcggtaaccggg

SEQ ID NO: 269034 - DNA, 682 bp, Homo sapiens
  misc_feature: GYAE6OF02JVP8K.28.57.F02.1.454.CMB.1.raw
  modified_base (199)..(199): a, c, t, g, unknown or other
  misc_feature (199)..(199): n is a, c, g, or t
tcagagtacgctatcacgaccggtgctcgatttagctcgatatagttgggtctgggagaggagcccccgccctgggtttcccaggtgttctcatttggtgatcgagcactgcacacagaagagtcatgacggagtttgggctgagctggttttccttgttgcttattttaaggtgtcagtgtgagtgcagcgtggtggngttcgtaggggacgtcttcggtccgaggtccggtggggggttcccctaggacgtccgtactccgtgtcgacgtacgtccttcgtaggtacttcctaccttacgtaagttatttagtgtctatcgacctacggtccggccgtaccgaacggtcctaccggagggaaggtccgtaggtactagtccgtagttagacggttaatagtaacgtaaggtcgtaacgaacttaaatacttaaggtactttaggactaccgtaaattcggtagtaacggacggaactacgtacttacaccgtactacgttaaccgacgttactaaaccggtactaaacggtactacgtactagtacttacgtaacgtaaaggtcgaacgtcgtccgagtaggcgacgtaggacgaacgcggtacttggttactagttcggaacggtaggtaggacgtaggacgttagtcgggaagttgggtacgggtggacggtaccggg

SEQ ID NO: 269035 - DNA, 884 bp, Homo sapiens
  misc_feature: GYAE6OF02JQLH4.28.57.F02.1.454.CMB.1.raw
  modified_base (287)..(287): a, c, t, g, unknown or other
  misc_feature (287)..(287): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggttttccttgttgcttaagtttttaaaggtgtccgagtgtggtaggtgcgagctgggtaggagtcggtagggggagtcgttcggttaccgacggtccgggtcggggggttccctaggacgtacgtccttccgtggngtacacgtcctcgtaggtacttacctaccgttacgtaagttatttaacgtccgtactaacggtcgtaccgtacgggtccgggttacccgaccggacggttaccccggtcgggaaacgggggaaaccggttacgtaacggttaacgttacggttacggttacctagggttaaacggttaaaggttaacgggtaaaacttacggtacggtaaaccggttaaaattaaaccgtacgtttaaagttacgttaggtaacgtaaccttaaacgttaccggttagggtaacggaacggtaacgttaacgtaacgttacccgaacgtaacgtacccgtaacgggtaacggtaaacctaacggttaaaccgaaacccggtaccgtaccggttacgttaaccgttaaccggtttaactaaacggtaacggttacgggaccgttaaggttacccaggggtacccgtacgtaaccgggttaacgaacggtaacccggtaagtacggtttataacggtttagttacgggtacggtaaggacgggtaaggtcgggaaggttaggttaacgggtagggttaacggggttcgggtacgttacccggggtaacg

SEQ ID NO: 269036 - DNA, 886 bp, Homo sapiens
  misc_feature: GYAE6OF02F97D6.28.57.F02.1.454.CMB.1.raw
  modified_base (240)..(240): a, c, t, g, unknown or other
  misc_feature (240)..(240): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggtagtttgggctgagcgttgggttttccttggttgtcttaagtttttaaaggtgtccagtgtgaggtgcagcgtgggtggaggtcgtggggggaggtcgttcggtccgnggtcccggtcgggggggttcccctaggacgtacctccgtccgtggtcgccgacgtccctcgtcggtacttcctaccgttactagtttaattttatgtaccttagtcgtactacggtccgggtcccgcccggacggtccgtaccggagggggaaacgggtaccggtaaggaacgttagttacgtcttacggtaacgggttaagttaaaggaaagttaacgtacggaacgtaaataaacgtattaatttaagttaagtacgacgtaaaaccttcgtaggtaggaacgggtacgtaacgtaccttaacgtacctaacgttaccctaaccggtaacgggtaaacttaaaccgttaacccgaaaacggtaaaccctaaccgttaccgtttaacgttaaccttaaccgtttaaactaaaccgggttacggggtaacctacccgggtacccggttacggaacggttccgtaacgggtacggaaacgggtaacccggaaccgggttaacgttacggtttaccgtttaacgtttaacgggttggggttaacggggtaaaggggtaagggtaacgggttacgggttaaacgggtttaggggttaaaccggggttaggggtttacgggggttacgggggtaccgggtaacccggggg

SEQ ID NO: 269037 - DNA, 839 bp, Homo sapiens
  misc_feature: GYAE6OF02J1FO5.28.57.F02.1.454.CMB.1.raw
  modified_base (753)..(753): a, c, t, g, unknown or other
  misc_feature (753)..(753): n is a, c, g, or t
tcagagtacgctatcacgaccggtgctcgatttagctcgatatagttgggtctgggagaggagccccgccctgggtttcccaggtgttctcatttggtgatcagcactgcacacagaagagtcatgacggagtttgggctgagtcgttgggttttccttgttgtcttagttttaaaggtgtccagtgtggtaggtgcgagtcgtgggtggaggttcggtgggggaggtcgttggtccgacggtcccgggttcggggggtccctggacggtacctcgttccgtgtcggacctcggtaccttcgtacggtactttccgtaccttcgtaacgtttattacttcggtacttacgtggtaccgtaccggttccgggttacccgaccggtcgggtacctaacgggtaggggtaaaccgggtagttaaggtaaacgttcggttacgttacggttaaccggttaggtttaaaggttaacgggtaaaagttaacgacggtaaacctaacgttaaactagtttaacgtttattagtacgtaaccgtaacgttacggtacggtacggtaacggtacgtaacggttactttaccggaacgttaccttaccggaaccgtacggtaaacttaaccggtaacgtaaacgacgtcgttaacgtttacgtaacgttacgtaagtacggaccggtaacgtcgtacggtaacgtacggtacggtagtaccggaacgtaccgtaaggtcttaacgttagttacggttaagggngggttaacggaggtacggtacgggttaggtacggttaaccgggttaggggttacgggttacggggtaccggtacggttaaccgggg

SEQ ID NO: 269038 - DNA, 848 bp, Homo sapiens
  misc_feature: GYAE6OF02HXQ6Z.28.57.F02.1.454.CMB.1.raw
  modified_base (121)..(121): a, c, t, g, unknown or other
  misc_feature (121)..(121): n is a, c, g, or t
tcagagtacgctatcacgaccggtgctcgatttagctcgatatagttgggtctgggagaggagcccccgccctgggtttcccaggtgttctcatttggtgatcagcactgcacacagaagngtcatgacggagtttgggctgagtcttgggttttccttgttgcttaattttttaaaggtgtccagtgtgaggtgcagtcgtgggtggtagtcggtggggggaggtcgtttcggtcccacggccggtggggggtcccctggacgactctaccgtgtacgccgacgtccgtccgtaggtactttccgtaaccctttcgttaacgttacttttaacgtcggttccttaagtcggtccgtaaccgggttccggggttccccggaacccgttcgggacccgttacccggggaacggggtaacggggtaccgtaaggggtaaacttacgttcggttacccgttaagtagggttaaacgttaaggtaaagtttaacggtacggtaaccgttaaaattaaaccgtaaattaagtttaacgtttaagtaccgtaactaaaccgtttagtaggtaggaagggactaacgttactacctacgttactaccggtacccgaaagtacgtaaacgttaacccgaaacgtaaccgtaccgttaccgttagtaaccgtttacccttaaagtaaacggtcggtaacccgtagtacccgtagggaagtacgacggtaaggaccggtaaacgaccggttaactagtttacgttatttaaccggtggtaacggggaaggtacggacggtaaccggtaggttaacggtagggtttaacggggttagggttccgggaaggttaccgggg

SEQ ID NO: 269039 - DNA, 882 bp, Homo sapiens
  misc_feature: GYAE6OF02HNCU5.28.57.F02.1.454.CMB.1.raw
tcagagtacgctatcacgaccggtgctcgatttagctcgatatagttgggtctgggagaggagcccccgccctgggtttcccaggtgttctcatttggtagatcagcactgcacacagaagagtcatgacggagtttggctgagcgttgggttttccttgttgtacttatttttaaaggtgtacagtgtgaggtgcagtcgtggtggtagtcggtgggggagtcgttacggtccaggtccggttcgggggggtccctggtacgtaaccttccgttaccgtgtagctacgccttacgtggtactttccggtacctttccgtaagtttaacttttacgtacgttccgttagttacgaccggttaccggttaccgggggttcccgacccgggtaaccggtacccgtttaaccggggaacgggggtaacgggttaacccggttaaggtaaacgttacggttaccggttacccgtaagttaaacgggtttaaccgttaaaagggtaaacggttttaagtaacccggtaaaccttaaaagtttaaaaccctaagttttaaccgttaaagtttaccgtaacggtaaaccttaaacgtttacgttaaggggtaacggtaaacggggtactaacggtaaccctttaccgtaaccgttacccgttaaccggtacccggttaaaacggtaaccgtttaaaccggtaacgtaaaaccggacttaaccggttacgtttaagttaactacggttaacccgtaggtaccggaactacggtaccgtagacggatacggttacgacgtaccgaagtcgtagttactaggttcgtaagggaggtagggagtacgggtaagttacgggttagtacggtttagggcggttacggagttacgg

SEQ ID NO: 269040 - DNA, 690 bp, Homo sapiens
  misc_feature: GYAE6OF02H5A4U.28.57.F02.1.454.CMB.1.raw
  modified_base (223)..(223): a, c, t, g, unknown or other
  misc_feature (223)..(223): n is a, c, g, or t
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (556)..(556): a, c, t, g, unknown or other
  misc_feature (556)..(556): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaagtgttccagtgtgaggtgcagctggtggagtcgtgggggagcgttggtccngccgtggggggtccctggagctctcctgtgcngcctcgtggcttcnccttcagttatttangtctatgctacgtgggtcccgccaggtccgtacccggaggggaacggggtacgtgggaaactgttgttctacgtaggttattaggtaagtaatgacgtaataacattattattatgactaacttcgtgtggaagggtcaagtacttaccgacctaacttccgtaacccggtaagggtaacctaaacttacccgaaacgggtaaacaaccgttacgtacggttactttaaccgttaagaaacggtcgggcctacggacccttgggaacgtcgnggttaacggaacgggtaccgaaccgggtgttagttaattaccgttaggtgggttaaggggacggtagggaccgtagggtaacggttacgggtaaaccgggttggggtttcgggtcgggggtacgtaaccggggg

SEQ ID NO: 269041 - DNA, 797 bp, Homo sapiens
  misc_feature: GYAE6OF02HZJ24.28.57.F02.1.454.CMB.1.raw
  modified_base (278)..(278): a, c, t, g, unknown or other
  misc_feature (278)..(278): n is a, c, g, or t
  modified_base (618)..(618): a, c, t, g, unknown or other
  misc_feature (618)..(618): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtctatgaacggagtttgggcttggagtcttgggttttccttgtttgtcttaagtttttaaaggtgtcctagtgtgtaggtgcagctggtggtagtcgtgggggagtcgttggtccagtccggtacggggggtccctggagaccttctcctgtgccncgtcctcgtggactttccacctttcgagttatttactcgtacttagtagtcacggttcggggtcccgaccgtacggtccgtaccggtaaggggaacggtacgtacggtaagttaacgtgttctacgttaacggttattaaggtaaagtaagtcgtaacgtaataacgaattactttattagtacgtaactaaacgttcgttaggtacggagggtactaagtacgttaccgtaaccacgtacccgtaccgaacggtaactaaccgttaacgtaaacgaaccgtacgtacttagttaccgtactaacgtacgtacgggtacacgtaccgtacgaggttacgngttaacgggacgtaaccgaacgggttcttaacgtacgttttaacgtaccgggtttaagggttacgggtaacggggaggggttaaaccggacgggggttttaaacggttaacggggttaaccggggttttaacggggggttacggggtacccccgggggttaagggtaaaccccgggggg

SEQ ID NO: 269042 - DNA, 826 bp, Homo sapiens
  misc_feature: GYAE6OF02I2PHY.28.57.F02.1.454.CMB.1.raw
tcagagtacgctatcacgaccggtgctcgatttagctcgatatagttgggtctgggagaggagcccccgcccgtgggtttcccaggtgttctcatttggtgatcagcactgcacacagaagagtcatgacggagtttgggctgagcttgggttttccttgttgcttaagtttttaaaggtgtccagtgtgaggtgcagtcgtgggtggagttcggtggggggaggtccgtttgggtacccgaggtcccgggttcgggggggtcccctggacgtacctccgttcccgtggtcgaccgtcgccttcgtcggtacttccacctttacgtagtttatttagtccgtattacgtcggcctacgtccggggtaccccgccgacggccgtaccgggtaaggggaaggacgtacggtaaattccgttagggttaccttacggtaaggttaaagtttaaggtaaaacgttagtaaccgggtaactaaaacttaacgtaagttaactttaaatttacgtacgtaaaccttaacgttacgttacggtaggaaagggtctaacggtaccttaacccaaacttacgccggtaccgtaaaggtaaccttaaccgttaaccaaaccggtaaacctaccgtacgttaccgttacttacccgttaaagtacgggtacgtaacgtcgtaccggtaagtaccgtaacgcgttaagggaacgtcggtaaccgtactttacggtattacggtggttaacgggtaggacggtagggtaacggtacggttaacgggttagggttaaccgggttacgggtttacggggaccgggttacggtaacccgggg

SEQ ID NO: 269043 - DNA, 792 bp, Homo sapiens
  misc_feature: GYAE6OF02HRWW8.28.57.F02.1.454.CMB.1.raw
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
  modified_base (674)..(674): a, c, t, g, unknown or other
  misc_feature (674)..(674): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggtagtttgggctgaggtcttgggtttttccttgttgtcttagttttttaaaggtgtccagtgtgaggtgcagtcgtggnggtagtcggtggggggagtcgttcgggtacctacggtccgggttggggggtcccctaggacgtacgttccgtccgttggtcgacncgtcctcgtgtacttcctacttactagttatttancgtactagtctcgttacggtccggggtacccacccgtacggtaccgaccgggtaaagggggaacggtaccgtaggtaactttagtcgtacctacggtaaggttaacgttaaagtaaacgttagtaacgtaacgtaaataacgtaattaggtttaaactaggtactaaaccgtaacgttggtacggtaaggtaacgtacgtagttaccacgtaacctacgtaaccgacggtaagtaaccgtaaactaacgtaaacgtaaccgacgtaacgtattacgttacgtaaacgtaacggtcgagacgtaaccgtggtacgtacgacgtacgaaccgggtaacaaccggtnttaacgttacgttaacgtcgggttaaggggtaaggtagggggtaacgtaaccggggtaacggtaggttaaaccggggtagggttaacggggtacgggttaccgggtacggtaaccggg

SEQ ID NO: 269044 - DNA, 811 bp, Homo sapiens
  misc_feature: GYAE6OF02GNXTA.28.57.F02.1.454.CMB.1.raw
  modified_base (253)..(253): a, c, t, g, unknown or other
  misc_feature (253)..(253): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcaatgacggagtttgggctgagcttgggttttccttgttgcttaatttttaaacggtgtccagtgtgagtgcagctggtaggtagtcgtagggggagtcgttaggtccagccggtggggggttaccccngacgtacctcctccgttggtcacctgtcccgtcgtaggtactttcctacctttacgtagtttaatttaatcgtctacgtatccgtacggttcgggttacccgccggaacgggttcccaccgggtaaagggggtaaccggggacttaagggtaaattcggtcttacccgtaggttaagttaaaccggttaaagtaaagtttaagacggtaaacctaaatttaactaatttaaaattactttaagggacccaaactttaaaccgtccgttaaggggtaaccggtaaaggggactacgttaactttacccgaacttacctaccggaccgtaacggaacgtaacgttaacccgaaactaaccggactacggttaactacttacttaacgaaaggtcggaacctcgcgtacggaaggtcgtagtaaccgggaaacggtccggaaccggtatggttaaccgtttagtaccgggttaagggaaccggtaggggaaggtaagcccgggttaaaagggtcggtttaagggtttcggggtaacggggtgggtacccggtaacccgggg

SEQ ID NO: 269045 - DNA, 895 bp, Homo sapiens
  misc_feature: GYAE6OF02IX3VD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctgagtcgttgggtttttccttggtttgactttaaagttttttaaaggtcgtacctaggttgtaggagggttcgcgacgtcgttgggtaggtacgttcggtagggggaggtccgtttcggtaccgacggtcccggttcggggggtccctaggacgtactcctccgttgtcgacgacgtcctcgtaggtacttccaccgttcgtaacgttatttacgtgtacttagtcgtacctacggtccggtcccacgcggtccgtaccggaaggggtaacggtactaagtaactagtacgttaccgtacgtaaggttaagtaagtaaacgtagtcgaacgtaaattaacgtatttaagttagttaacgtacgtaaacgttaacgttcgttaagggtaacggtaacgggtaacttaagttacccgtttaacccgtaaccgtatttaccccggaaccggttaaacgggttaaacccttaaaaccgttaacccggaaaaacggtaaccccgtacgtttaacgggtttaacccttacggtttaaaacctacccggtaaagggtaaaccgggtaccttaacgggtccgttaaggaaccgttaacgtccggggtacgtaaacgggacccgttaccggtaacgttacgtttaacgttacgttacgggtcgggtaaagggtacggtaaaggttacgggtaacgtttaagggtttaccggggttaaacggtttaagggggtccccgggttaaggggacccgttaacggggg

SEQ ID NO: 269046 - DNA, 259 bp, Homo sapiens
  misc_feature: GYAE6OF01BQCJU.48.53.E09.1.454.CMB.1.raw
  modified_base (256)..(259): a, c, t, g, unknown or other
  misc_feature (256)..(259): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtatactctgagcgggctggcaaggcgcatagnnnn

SEQ ID NO: 269047 - DNA, 255 bp, Homo sapiens
  misc_feature: GYAE6OF01EO4RD.48.53.E09.1.454.CMB.1.raw
  modified_base (253)..(255): a, c, t, g, unknown or other
  misc_feature (253)..(255): n is a, c, g, or t
tcagagtatacatacacgaccggtgctcgatttagagagagtgtgttgggtttgggacagacttcactctcaccatcagcagactggagcctgaagattttgcagttgtttttctgtcagcagtatggaagttcacctcggacattcggccaggggaccaaggtggaaatcaaacgaactgtggctgcaccatctgtcttcatcttcccgcatctgatatgtatactctgagcgggctggcaaggcgcatagnnn

SEQ ID NO: 269048 - DNA, 258 bp, Homo sapiens
  misc_feature: GYAE6OF01DEUQP.48.53.E09.1.454.CMB.1.raw
  modified_base (255)..(258): a, c, t, g, unknown or other
  misc_feature (255)..(258): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgcatctgatatgtatactctgagcgggctggcaaggcgcatagnnnn

SEQ ID NO: 269049 - DNA, 167 bp, Homo sapiens
  misc_feature: GYAE6OF01CNSCQ.48.53.E09.1.454.CMB.1.raw
  modified_base (117)..(117): a, c, t, g, unknown or other
  misc_feature (117)..(117): n is a, c, g, or t
  modified_base (138)..(167): a, c, t, g, unknown or other
  misc_feature (138)..(167): n is a, c, g, or t
tcagagtatacatacacgaccggtgctcgatttagagagagtgtggttgggtttggggcgtactcttccccatagtaggtcttcatcttcccgccatcctgatatgtatactctgancgggctggcaaggcgcatagnnnnnnnnnnnnnnnnnnnnnnnnnnnnnn

SEQ ID NO: 269050 - DNA, 264 bp, Homo sapiens
  misc_feature: GYAE6OF01BVRT6.48.53.E09.1.454.CMB.1.raw
  modified_base (128)..(128): a, c, t, g, unknown or other
  misc_feature (128)..(128): n is a, c, g, or t
  modified_base (260)..(264): a, c, t, g, unknown or other
  misc_feature (260)..(264): n is a, c, g, or t
tcagagtatacatacacgaccggtgctcgatttagagagagtgtgttgggtttgggacagacttcactctcaccatcagcagactggagcctgaagattttgcagtgtattactgtcagcaaaaagtntggtagctcacctcaactcactttcggcggagggaccaaggtggagatcaaacgaactgtggctgcaccatctgtcttcatcttcccgccatctgatatgtatactctgagcgggctggcaaggcgcatagnnnnn

SEQ ID NO: 269051 - DNA, 259 bp, Homo sapiens; identical to SEQ ID NO: 269046
  misc_feature: GYAE6OF01DZFNM.48.53.E09.1.454.CMB.1.raw
  modified_base (256)..(259): a, c, t, g, unknown or other
  misc_feature (256)..(259): n is a, c, g, or t

SEQ ID NO: 269052 - DNA, 266 bp, Homo sapiens
  misc_feature: GYAE6OF01AZ2YF.48.53.E09.1.454.CMB.1.raw
  modified_base (252)..(252): a, c, t, g, unknown or other
  misc_feature (252)..(252): n is a, c, g, or t
  modified_base (258)..(266): a, c, t, g, unknown or other
  misc_feature (258)..(266): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaacttcactttcggcggagggaccaaggtgagatcaaacgaactgtggctgcaccagtctgtcttcatccttcccgccatctgatatgtatactctgagcgggctggcaaggcncatagnnnnnnnnn

SEQ ID NO: 269053 - DNA, 259 bp, Homo sapiens; identical to SEQ ID NO: 269046
  misc_feature: GYAE6OF01DFUUW.48.53.E09.1.454.CMB.1.raw
  modified_base (256)..(259): a, c, t, g, unknown or other
  misc_feature (256)..(259): n is a, c, g, or t

SEQ ID NO: 269054 - DNA, 270 bp, Homo sapiens
  misc_feature: GYAE6OF01C8H46.48.53.E09.1.454.CMB.1.raw
  modified_base (257)..(270): a, c, t, g, unknown or other
  misc_feature (257)..(270): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtatactctgagcgggctggcaaggcgcaatagnnnnnnnnnnnnnn

SEQ ID NO: 269055 - DNA, 260 bp, Homo sapiens
  misc_feature: GYAE6OF01AGXCR.48.53.E09.1.454.CMB.1.raw
  modified_base (256)..(260): a, c, t, g, unknown or other
  misc_feature (256)..(260): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtatactctgagcgggctggcaaggcgcatagnnnnn

SEQ ID NO: 269056 - DNA, 275 bp, Homo sapiens
  misc_feature: GYAE6OF01EW84B.48.53.E09.1.454.CMB.1.raw
  modified_base (258)..(258): a, c, t, g, unknown or other
  misc_feature (258)..(258): n is a, c, g, or t
  modified_base (260)..(275): a, c, t, g, unknown or other
  misc_feature (260)..(275): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtatactctgagcgggctggcaaggcgacagtagnannnnnnnnnnnnnnnn

SEQ ID NO: 269057 - DNA, 272 bp, Homo sapiens
  misc_feature: GYAE6OF01D19EY.48.53.E09.1.454.CMB.1.raw
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
  modified_base (259)..(272): a, c, t, g, unknown or other
  misc_feature (259)..(272): n is a, c, g, or t
tcagagtatacatacacgaccggtgctcgatttagagagagtgtgttggggttgggacagacttcactctcaccgatcagcagactggagcctgaagattttgcagttgtattactgtcagcagtatggtagctcacctcaactcacgtttcggcggagggaccaaggtggagatcaaacgactgtggctgcaccatctgtctnatcctcccgcatctgatntgtaatactctgagcgggctggacaagggcacatagnnnnnnnnnnnnnn

SEQ ID NO: 269058 - DNA, 264 bp, Homo sapiens
  misc_feature: GYAE6OF01CHVH7.48.53.E09.1.454.CMB.1.raw
  modified_base (257)..(264): a, c, t, g, unknown or other
  misc_feature (257)..(264): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgcatctgatatgtatacgtctgagcgggctggcaagggcacatagnnnnnnnn

SEQ ID NO: 269059 - DNA, 257 bp, Homo sapiens
  misc_feature: GYAE6OF01CPYCB.48.53.E09.1.454.CMB.1.raw
  modified_base (254)..(257): a, c, t, g, unknown or other
  misc_feature (254)..(257): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgcatctgatatgtatactctgagcggctggcaaggcgcatagnnnn

SEQ ID NO: 269060 - DNA, 789 bp, Homo sapiens
  misc_feature: GYAE6OF01ANXDD.48.53.E09.1.454.CMB.1.raw
  modified_base (304)..(304): a, c, t, g, unknown or other
  misc_feature (304)..(304): n is a, c, g, or t
tcagagtatacatacacgaccggtgctcgatttagagagagtgtgttgggtttgggggtgggctcaggaggcagagctctgggaatctcaccatggcctggacccctctcctgcctccccctcctcactttctgcacagtctctgaggcctcctctgagctgacacagcccaccctcggtgtcagtcgtcccaggacaacggccaggactcacctgctcgtggagatgctagttcgactaaagtaaattttgttatcggtacaactgaagtcaggccacggtccctgtcctggtactatttagnggacgacgaccgacgccgaccctcgaggtacctcccgtggaccgtaggttcctcggtagacgttaccgaaacgtcgaacggggtacctaggttaccggaccttaaccgttacgtaacctaagttcccgaaccgggttcggggacccgtaggggtacggacggtagtaggtaacggttcgtaaccttacgttcgtttacgtttaccgtacctaaaacgtacgtaaccgtaaccgtaaggtacaacgtaaactacgttaacggttaccggttacgttaacgggttttacccggggaaccggggtaaaccgggtaaccgtaacgggttccgtaaccgggtaccccggttacccggtacggggtacccgtaaacccgggtaccccggtaaacgggtcccccgttaccccggtacccccccggttaccggttaccccgttaaccccgtttcccgttcccccggtttaacccccgtaccccctttacccgg

SEQ ID NO: 269061 - DNA, 262 bp, Homo sapiens
  misc_feature: GYAE6OF01EMLG5.48.53.E09.1.454.CMB.1.raw
  modified_base (256)..(262): a, c, t, g, unknown or other
  misc_feature (256)..(262): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtatactctgagcgggctggcaaggcgcatagnnnnnnn

SEQ ID NO: 269062 - DNA, 260 bp, Homo sapiens
  misc_feature: GYAE6OF01B6TTB.48.53.E09.1.454.CMB.1.raw
  modified_base (224)..(224): a, c, t, g, unknown or other
  misc_feature (224)..(224): n is a, c, g, or t
  modified_base (256)..(260): a, c, t, g, unknown or other
  misc_feature (256)..(260): n is a, c, g, or t
tcagagtatacatacacgaccggtgctcgatttagagagagtgtgttgggtttgggacagacttcactctcaccatcagcagactggagcctgaagattttgcaacttattactgtcaacagcttagtagtaaccctccgtacacttttggccaggggaccaaggtggagatcaaacgaactgtggctgcaccatctgtcttcatcttcccgccatctgatatntatactctgagcggctggcaaggcgcaatagnnnnn

SEQ ID NO: 269063 - DNA, 286 bp, Homo sapiens
  misc_feature: GYAE6OF01CKHP8.48.53.E09.1.454.CMB.1.raw
  modified_base (170)..(170): a, c, t, g, unknown or other
  misc_feature (170)..(170): n is a, c, g, or t
  modified_base (257)..(286): a, c, t, g, unknown or other
  misc_feature (257)..(286): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtgganatcaaacgaactgtcggctgcaccatctgtcttcatcctcccgcatctgatatgtatctctgacgcggctggacaaggcactatagnnnnnnnnnnnnnnnnnnnnnnnnnnnnnn

SEQ ID NO: 269064 - DNA, 324 bp, Homo sapiens
  misc_feature: GYAE6OF01CQNJF.48.53.E09.1.454.CMB.1.raw
  modified_base (278)..(324): a, c, t, g, unknown or other
  misc_feature (278)..(324): n is a, c, g, or t
tcagagtatacatacacgaccggtgctcgatttagagagagtgtgttgggtttgggacagacttcactctcaccatcagcagactggagcctgaagtattttgcagttgtattactgtcagcagtatggtagctcaccctcaactctacgtttcgggcggagggaccaaggtggagatacaaaacgactgtggcctgaccaccatctgttcttcactccttcccgctatctgatatgtatactgtgaggcggctggacctaaagggcgactagtagcnnnnnnnnnnnnnnnnnnnnnnnnnnnnnnnnnnnnnnnnnnnnnnn

SEQ ID NO: 269065 - DNA, 271 bp, Homo sapiens
  misc_feature: GYAE6OF01ARM9D.48.53.E09.1.454.CMB.1.raw
  modified_base (257)..(258): a, c, t, g, unknown or other
  misc_feature (257)..(258): n is a, c, g, or t
  modified_base (260)..(271): a, c, t, g, unknown or other
  misc_feature (260)..(271): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgactgtggctgcaccatctgtcttcatccttcccgccatctgatatgtatactctgaggcgggctggcaaggcgcatagnngnnnnnnnnnnnn

SEQ ID NO: 269066 - DNA, 260 bp, Homo sapiens
  misc_feature: GYAE6OF01EPVJV.48.53.E09.1.454.CMB.1.raw
  modified_base (207)..(207): a, c, t, g, unknown or other
  misc_feature (207)..(207): n is a, c, g, or t
  modified_base (253)..(260): a, c, t, g, unknown or other
  misc_feature (253)..(260): n is a, c, g, or t
tcagagtatacatacacgaccggtgctcgatttagagagagtgtgttgggtttgggacagacttcactctcaccatcagcagactggagcctgatgattttgcagttgtttttctgtcagcagtatggaagttcacctcggacattcggccaggggaccaaggtggaaatcaaacgactgtgctgcacatctgtcttcatcctcccncatctgatatgtatactctgaggcgggctggcaaggcgacatacgnnnnnnnn

SEQ ID NO: 269067 - DNA, 285 bp, Homo sapiens
  misc_feature: GYAE6OF01B7QYM.48.53.E09.1.454.CMB.1.raw
  modified_base (263)..(285): a, c, t, g, unknown or other
  misc_feature (263)..(285): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggaggaccgaaggtggagatcgaaacgaactgtggactgcaccatctgtcttcatcttcccgcactcttgatatgtatactctgagcggtctgggacaaggcgcataaggnnnnnnnnnnnnnnnnnnnnnnn

SEQ ID NO: 269068 - DNA, 765 bp, Homo sapiens
  misc_feature: GYAE6OF01BD7MX.48.53.E09.1.454.CMB.1.raw
  modified_base (693)..(693): a, c, t, g, unknown or other
  misc_feature (693)..(693): n is a, c, g, or t
tcagagtatacatacacgaccggtgctcgatttagagagagtgtgttgggtttgggggtgggctcaggaggcagagctctgggaatctcaccatggcctggacccctctcctgcctccccctcctcactttctgcacagtctctgacgcctcctctgacgctagaccacacgcccacccgttcggtgtcagtcgtacccgaggaaccaaaccggcaggactccacctgcctcgtggacgatgctagttcgaccgtaaaagtttaaagtttttcgttaacgttacggttaacctaacgtagtaaacggtaccgaccggaccgtaaccggtccccgttcggttacccgttacggtttacttaacgttttacggttacgggaaccgggtaacccgtaaccggaccggtaccccggtaaccccgtaccggtacgggtaacccttccccgtacgggtaccggttacggtttacccgtcggttacggtacgtacggtaaccgtcggtaacgggtacgtacgtcggtaccctaccgttacgacgtacgtccgtacggtccgggtaccgaggggtacggaggtacgtagggtaaggtacgttaacttccgttacgttcgttaccactaacgtacgaacctaacgtacgtacgactaactacgacgtgtacgttcgtttacgggacggtacgacgacgtcgnggtccgtcggtcgcgacgaccacggtcccgtaccgtccctcgtacctccgtcctcccgtcccgtccgttccg

SEQ ID NO: 269069 - DNA, 256 bp, Homo sapiens
  misc_feature: GYAE6OF02GNIRM.48.53.E09.1.454.CMB.1.raw
  modified_base (253)..(256): a, c, t, g, unknown or other
  misc_feature (253)..(256): n is a, c, g, or t
tcagagtatacatacacgaccggtgctcgatttagagagagtgtgttgggtttgggacagacttcactctcaccatcagcagactggagcctgaagatttgcagtgtattactgtcagcagtatggtagctcacctcaactcactttcggcggagggaccaaggtggagatcaaacgaactgtggctgcaccatctgtcttcatcttccgcatctgatatgtatactctgagcgggctggcaaggcgcatagnnnn

SEQ ID NO: 269070 - DNA, 258 bp, Homo sapiens
  misc_feature: GYAE6OF02IP7E6.48.53.E09.1.454.CMB.1.raw
  modified_base (252)..(258): a, c, t, g, unknown or other
  misc_feature (252)..(258): n is a, c, g, or t
tcagagtatacatacacgaccggtgctcgatttagagagagtgtgttgggtttgggacagacttcactctcaccatcagcagactggagcctgaagatttgcagtgtattactgtcagcagtatggtagctcacctcaactcactttcggcggaggaccaaggtggagatcaaacgactgtggctgcaccatctgtcttcatcttcccgcatctgatatgtatactctgagcgggctggcaaggcgcatagnnnnnnn

SEQ ID NO: 269071 - DNA, 134 bp, Homo sapiens
  misc_feature: GYAE6OF02IERGE.48.53.E09.1.454.CMB.1.raw
tcagagtatacatacacgaccggtgctcgatttagagagagtgtgttgggtttgggcgtactcttccccatagtaggtcttcatcttcccgccatctgatatgtatactctgagcgggctggcaaggcgcatag

SEQ ID NO: 269072 - DNA, 256 bp, Homo sapiens
  misc_feature: GYAE6OF02HLRRT.48.53.E09.1.454.CMB.1.raw
  modified_base (255)..(256): a, c, t, g, unknown or other
  misc_feature (255)..(256): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttccgccatctgatatgtatactctgagcgggctggcaaggcgcatagnn

SEQ ID NO: 269073 - DNA, 258 bp, Homo sapiens
  misc_feature: GYAE6OF02F1RWV.48.53.E09.1.454.CMB.1.raw
  modified_base (256)..(258): a, c, t, g, unknown or other
  misc_feature (256)..(258): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtatactctgagcgggctggcaaggcgcatagnnn

SEQ ID NO: 269074 - DNA, 256 bp, Homo sapiens
  misc_feature: GYAE6OF02IJBG4.48.53.E09.1.454.CMB.1.raw
  modified_base (256)..(256): a, c, t, g, unknown or other
  misc_feature (256)..(256): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtatactctgagcgggctggcaaggcgcatagn

SEQ ID NO: 269075 - DNA, 260 bp, Homo sapiens
  misc_feature: GYAE6OF02FYULU.48.53.E09.1.454.CMB.1.raw
  modified_base (250)..(250): a, c, t, g, unknown or other
  misc_feature (250)..(250): n is a, c, g, or t
  modified_base (256)..(260): a, c, t, g, unknown or other
  misc_feature (256)..(260): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtatactctgagcgggctggcaaggcncatagnnnnn

SEQ ID NO: 269076 - DNA, 288 bp, Homo sapiens
  misc_feature: GYAE6OF02IYPG1.48.53.E09.1.454.CMB.1.raw
  modified_base (259)..(259): a, c, t, g, unknown or other
  misc_feature (259)..(259): n is a, c, g, or t
  modified_base (261)..(288): a, c, t, g, unknown or other
  misc_feature (261)..(288): n is a, c, g, or t
tcagagtatacatacacgaccggtgctcgatttagagagagtgtgttggggttgggacagacttcactctcaccgatcagcagtactggagcctgaagattttgcagtgtattactgtcagcagtatggtagctcacctcaactcactttcggcggagggaccaaggtggagatcaaacgactgtggctgcaccatctgtcttcatcttcccgcatctgactatgtatactctgacgcgggctggcaaaggcgcatagnannnnnnnnnnnnnnnnnnnnnnnnnnnn

SEQ ID NO: 269077 - DNA, 257 bp, Homo sapiens
  misc_feature: GYAE6OF02FID8E.48.53.E09.1.454.CMB.1.raw
  modified_base (255)..(257): a, c, t, g, unknown or other
  misc_feature (255)..(257): n is a, c, g, or t
tcagagtatacatacacgaccggtgctcgatttagagagagtgtgttgggtttgggacagacttcactctcaccatcagcagactggagcctgaagatttgcagtgtattactgtcagcagtatggtagctcacctcaactcactttcggcggagggaccaaggtggagatcaaacgaactgtggctgcaccatctgtcttcatcttcccgccatctgatatgtatactctgagcgggctggcaaggcgcatagnnn

SEQ ID NO: 269078 - DNA, 257 bp, Homo sapiens
  misc_feature: GYAE6OF02H86CR.48.53.E09.1.454.CMB.1.raw
  modified_base (255)..(257): a, c, t, g, unknown or other
  misc_feature (255)..(257): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgcatctgatatgtatactctgagcgggctggcaaggcgcatagnnn

SEQ ID NO: 269079 - DNA, 535 bp, Homo sapiens
  misc_feature: GYAE6OF02GF6TS.48.53.E09.1.454.CMB.1.raw
  modified_base (296)..(296): a, c, t, g, unknown or other
  misc_feature (296)..(296): n is a, c, g, or t
tcagagtatacatacacgaccggtgctcgatttagagagagtgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgaccaagtaaaattttgttattggtaccaactgaagtcaggccaggccccctgtcctggtcatttangtaggacgaccagcgaccctccaggatccctgcgaggttctctggatcgaactcagggacattggccacttgactatcactgggcccaggtggaggatgaaggtgactattctgtttctacacagacaccagtgacaatcatgcgtattttcggcggagggaccagctcgaccgtcgtgggtcaacggcccaaggcctcgcccccgttcggcctaccgtcctcgttccccacccttccc

SEQ ID NO: 269080 - DNA, 253 bp, Homo sapiens
  misc_feature: GYAE6OF02F97P4.48.53.E09.1.454.CMB.1.raw
  modified_base (252)..(253): a, c, t, g, unknown or other
  misc_feature (252)..(253): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcaccgatcaccttcggccaagggacacgactggagattaaccgaactgtggctgcaccatctgtcttcatcttcccgcatctgatatgtatactctgagcgggctggcaaggcgcatagnn

SEQ ID NO: 269081 - DNA, 261 bp, Homo sapiens
  misc_feature: GYAE6OF02G8UNJ.48.53.E09.1.454.CMB.1.raw
  modified_base (255)..(261): a, c, t, g, unknown or other
  misc_feature (255)..(261): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgactgtggctgcacatctgtcttcatcttcccgccatctgatatgtatactctgagcgggctgggcaaggcgcatagnnnnnnn

SEQ ID NO: 269082 - DNA, 259 bp, Homo sapiens
  misc_feature: GYAE6OF02FSA9H.48.53.E09.1.454.CMB.1.raw
  modified_base (257)..(259): a, c, t, g, unknown or other
  misc_feature (257)..(259): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatccttcccgccatctgatatgtatactctgagcgggctggcaaggcgcatagnnn

SEQ ID NO: 269083 - DNA, 561 bp, Homo sapiens
  misc_feature: GYAE6OF02IC3WS.48.53.E09.1.454.CMB.1.raw
  modified_base (259)..(259): a, c, t, g, unknown or other
  misc_feature (259)..(259): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (324)..(327): a, c, t, g, unknown or other
  misc_feature (324)..(327): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
tcagagtatacatacacgaccggtgctcgatttagagagagtgtgttgggtttgggacgagtacttccacgtctcaccatcagcagtaccgtggacgccgtgaagattttgcagtgtattacctgtcacgcagtatggtagctcacctcaacgtcactttcggcgaggaccaaggtgagagtcaaacgactcgtaggcttaggccttaccgattcgttcgtcttcagtccttcccgcatctcgaattactgtatcttcnggagccggcttggactaaggcgacactaggctgnagngnagtcgtctgacatattcacncncacnnnngcncncacgngtcngngtgtcgtcgtactatactacgactactacttacttactttacgtacgtactacgttacgtacgtacgacgtacgtacgtacgagacgtacgtacgtacgtagtacgcacgtactacgtacgtactacttacgtactactacgtacgtctactacgtacgtacgtacgtactactacgtacgtcgtacgtacgtcggtcgtacggtacgacgacgtacg

SEQ ID NO: 269084 - DNA, 582 bp, Homo sapiens
  misc_feature: GYAE6OF02F4Y5N.48.53.E09.1.454.CMB.1.raw
tcagagtatacatacacgaccggtgctcgatttagagagagtgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaaagaaaattttgtattggtaccaactgaagtcaggccaggcccctgtcctggtcatttatgaggacaccagcgaccctcaggactccctgcgaggttctcgtggatcgaactcagggtacattggccacttgaactatcacgtcggggcccaggtggaggtatggaaggtgacttacttctgtttctcaacgagacaccgtagtacaacacgtacagtcgtacgtttacggttacgggacgggtaacgaacgacgtacgtacgtaccgttacggtcggtacgaccgtaccggacgtccgtaccccgcccgttacgtcctaccgttccgtcccgttaccctcccttaccg

SEQ ID NO: 269085 - DNA, 259 bp, Homo sapiens
  misc_feature: GYAE6OF02FH27O.48.53.E09.1.454.CMB.1.raw
  modified_base (256)..(259): a, c, t, g, unknown or other
  misc_feature (256)..(259): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatccttcccgcatctgatatgtatactctgagcgggctggcaaggcgcatagnnnn

SEQ ID NO: 269086 - DNA, 857 bp, Homo sapiens
  misc_feature: GYAE6OF02G5QJ7.48.53.E09.1.454.CMB.1.raw
tcagagtatacatacacgaccggtgctcgatttagagagagtgtgttgggtttgggggtgggctcaggaggcagagctctgggaatctcaccatggcctggacccctctcctgcctccccctcctcactttctgcacagtctctgaggcctcctctgagctgacacagcccaccctcggtgtcagtcgtccccaggacaaacggccaggatcacctgctctggagatgcattgaccaagtaaattttgtatggtaccaatgaagtcaggccaggcccctgtcctggtcatttatggaggacgaccagccgaccctccgaggactccgtgcgtagtctcgtggactcgaactcgagggactagttcggacctaccgttgaaccttataccgtaacggtcgggggaccccgtaaggggtcgggaagggtacgtaagggtaaacgggttacggtaaccgtttaaccgtttaccgtttacggtttttacccgtaaccgtaaaccgtaacggtaaacccgtaaccccgtaacggttaaccggtaaaccgttaaacgttaccgtaacgttacgggttacccgggtttaaccgggtttttttaacccgggggtaaccgggggttaaaccggggggtaaaccccggtaaaacgggtacccggttaacccgggttacccccgggtttacccgggtttacggggggttaaccccggtaaccgggtaaccccccgggtaaaccggggtccccggttacccccgggtttaccccccccgggtttacccgggttaaccccggttaccccggttttacccccgttttacccccgggttttccccccctaacccccccgtttttacccccgg

SEQ ID NO: 269087 - DNA, 249 bp, Homo sapiens
  misc_feature: GYAE6OF02GZGHA.48.53.E09.1.454.CMB.1.raw
  modified_base (245)..(249): a, c, t, g, unknown or other
  misc_feature (245)..(249): n is a, c, g, or t
tcagagtatacatacacgaccggtgctcgatttagagagagtgtgttgggtttgggggtgtggtggtctccactcccgccttgacgaggctgattactactgtcagtctttgataacaacaatcacgtggtcttcggcggagggaccagcctgaccgtcctaggtcagcccaaggctgccccctcggtcactctgttcccgccctcctctatgtatactctgagcgggctggcaaggcgcatagnnnnn

SEQ ID NO: 269088 - DNA, 335 bp, Homo sapiens
  misc_feature: GYAE6OF02HUWOU.48.53.E09.1.454.CMB.1.raw
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (262)..(335): a, c, t, g, unknown or other
  misc_feature (262)..(335): n is a, c, g, or t
tcagagtatacatacacgaccggtgctcgatttagagagagtgtgttggggttttggggacagacttcactctcaccatcagcagactgagcctgaagattttgcagtgtattactgtcagcagtatggtagctcacctcaaactcactttcggcggagggaccaaggtggagatcaaacgaactgtggctgcaccatctgtcttcatctcccgcatctgatatgtatctctgagcggctggnaaaggcgacatagctnacnnnnnnnnnnnnnnnnnnnnnnnnnnnnnnnnnnnnnnnnnnnnnnnnnnnnnnnnnnnnnnnnnnnnnnnnnn

SEQ ID NO: 269089 - DNA, 261 bp, Homo sapiens
  misc_feature: GYAE6OF02HXSFI.48.53.E09.1.454.CMB.1.raw
  modified_base (254)..(261): a, c, t, g, unknown or other
  misc_feature (254)..(261): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtgctgcaccatctgtcttcatcttccgccatctgatatgtatactctgaggcggctggcaaggcgcatagnnnnnnnn

SEQ ID NO: 269090 - DNA, 260 bp, Homo sapiens
  misc_feature: GYAE6OF02F7EY9.48.53.E09.1.454.CMB.1.raw
  modified_base (254)..(260): a, c, t, g, unknown or other
  misc_feature (254)..(260): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggaggaccaaggtgagatcaaacgaactgtggctgcaccatctgtcttcatcttcccgcatctgatatgtatactctgagcgggctggacaaggcgcatagnnnnnnn

SEQ ID NO: 269091 - DNA, 269 bp, Homo sapiens
  misc_feature: GYAE6OF02HZ9BG.48.53.E09.1.454.CMB.1.raw
  modified_base (260)..(269): a, c, t, g, unknown or other
  misc_feature (260)..(269): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaaactcactttcggcggagggaccaaaggtggagatacaaacgaactgtggctgcaccatctgtcttcatcttcccgccatctgatatgtatactctgagcgggctggcaaaggcgcatagnnnnnnnnnn

SEQ ID NO: 269092 - DNA, 263 bp, Homo sapiens
  misc_feature: GYAE6OF02I3PCI.48.53.E09.1.454.CMB.1.raw
  modified_base (255)..(263): a, c, t, g, unknown or other
  misc_feature (255)..(263): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtatactctgagcggctggcaaggcacatagnnnnnnnnn

SEQ ID NO: 269093 - DNA, 267 bp, Homo sapiens
  misc_feature: GYAE6OF02H5AJ0.48.53.E09.1.454.CMB.1.raw
  modified_base (138)..(138): a, c, t, g, unknown or other
  misc_feature (138)..(138): n is a, c, g, or t
  modified_base (257)..(267): a, c, t, g, unknown or other
  misc_feature (257)..(267): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctnaactcactttcggcggagggaccaaggtggagatcaaacgaactgtggctgcaccatctgtcttcatcttcccgccatctgatatgtatactctgagcgggctggcaaggcgcaatagnnnnnnnnnnn

SEQ ID NO: 269094 - DNA, 267 bp, Homo sapiens
  misc_feature: GYAE6OF02GQNS8.48.53.E09.1.454.CMB.1.raw
  modified_base (251)..(251): a, c, t, g, unknown or other
  misc_feature (251)..(251): n is a, c, g, or t
  modified_base (257)..(267): a, c, t, g, unknown or other
  misc_feature (257)..(267): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatacaaacgaactgtggctgcaccatctgtcttcatcttcccgccatctgatatgtactactctgagcggctggcaaggcncatagnnnnnnnnnnn

SEQ ID NO: 269095 - DNA, 291 bp, Homo sapiens
  misc_feature: GYAE6OF02F4ZSA.48.53.E09.1.454.CMB.1.raw
  modified_base (265)..(291): a, c, t, g, unknown or other
  misc_feature (265)..(291): n is a, c, g, or t
tcagagtatacatacacgaccggtgctcgatttagagagagtgtgttgggtttgggacagacttcactctcaccatcagcagactggagcctgaagattttgcagtgtattactgtcagcagtatggtagctcacctcaactcactttcggcggagggaccaaggtggagatacaaacgaactgtggctgcacatctgtcttcatccttcccgcatctgatatgtactactcctgacggtcggctggacgaggcgacagtagcannnnnnnnnnnnnnnnnnnnnnnnnnn

SEQ ID NO: 269096 - DNA, 832 bp, Homo sapiens
  misc_feature: GYAE6OF02F3UFF.48.53.E09.1.454.CMB.1.raw
  modified_base (138)..(138): a, c, t, g, unknown or other
  misc_feature (138)..(138): n is a, c, g, or t
  modified_base (539)..(539): a, c, t, g, unknown or other
  misc_feature (539)..(539): n is a, c, g, or t
tcagagtatacatacacgaccggtgctcgatttagagagagtgtgttgggtttgggggtgggctcaggaggcagagctctgggaatctcaccatggcctggaccccctctccgtgcctcccccctcctctacctttcncgtacacagtctctaggacggccttccttccgtagacgtcgtcgaaccatccggccctccccgttgggtcggtcaggttccggtcccccaaggacccaaaacgggcctaaacggtattcccaacggttcgccgttacggtaggacgttaacgtccggaataacgtttacggaacccgttaaaaagggttaaaaaactttttttgggttaaaccggtttggtaaaccctaacggttagtaacggtactacgggaacccttacgggtccccccgtgttaccggttagggtccttaacgttagtggaaaccggaccgtcgaaccgtcccgacccgttacgacgggtaacttccccggtcggacgttccggttaccgtgtacggtaaccgttcgaaacgtacggnggtaaccgtgtttaccggacctactacgtacgtaaccttacgacggtccgggaccctagggtacggtagagttacgggacgtggtaccttacgttcgttacgttacgtacgtagtaaccgtacgaccgtaagtacgtataactagtacgtagttaccggtcgttacgggtaccggaacgtacgacgtaccggtaccgacgttaccggacgttaccggcggttaccggaacgcccgttccggtacccggtccgttaccgtaccgttaccggtcccgtttacccgcccttacccg

SEQ ID NO: 269097 - DNA, 698 bp, Homo sapiens
  misc_feature: GYAE6OF01CSWDS.40.21.B10.1.454.CMB.1.raw
  modified_base (301)..(301): a, c, t, g, unknown or other
  misc_feature (301)..(301): n is a, c, g, or t
  modified_base (688)..(688): a, c, t, g, unknown or other
  misc_feature (688)..(688): n is a, c, g, or t
tcagtctagcgactcacgaccggtgctcgatttagtgtcgtcgcaagaggagaggggacccaaaaccacacccctcctaggagaactcccctagaccacagctcctcaccatggactggacctggagcattccttttcttggtggcagcagcaacaggtcgcccactcccgaggttcaaatgctgcagtcgtaggaggcgaggtagaagaagccgtggggcctgaggtggacgggttcctccgtggacgagtacttcgtggttacagtacctttaccgattagtggtatcgagcgttgggnacgacgccggaccccggagaaggtcttggaggtggagtgggatcggacgacgtagactaattacgagtcggtaacgaacctaaacgtaaaccgttagtacgaaccgaaacgtaaacggtaaccgttaacgaacgggaacttaacggaacgtaaccgaacctaaggtaacccgaaccaaccgtaacgaaaccaaccctaaccaccccgaaacgacgaacccaacgaaccgtccgttaaagttcggaagggacggtagaaccggtacgttcgaagtactaacgtacgtacggaaccggaacccgtacgtaaccttagtcgttaacgtggacgacgtaagtgacgtacgtaggtcgggtaggtcgtaacgtcggttaccgttagtaccgnggtacgtacg

SEQ ID NO: 269098 - DNA, 668 bp, Homo sapiens
  misc_feature: GYAE6OF01BLYU3.40.21.B10.1.454.CMB.1.raw
  modified_base (303)..(303): a, c, t, g, unknown or other
  misc_feature (303)..(303): n is a, c, g, or t
  modified_base (369)..(369): a, c, t, g, unknown or other
  misc_feature (369)..(369): n is a, c, g, or t
  modified_base (665)..(665): a, c, t, g, unknown or other
  misc_feature (665)..(665): n is a, c, g, or t
tcagtctagcgactcacgaccggtgctcgatttagtgtcgtcgcaagagaggagggggaacccaaaaaccacacccctcctagggagaactcccctagaccacagctcctcaccatggactggaccgtggagctacttcctttttcgttgggtggcagcagacaacgaggtcgcccactcccgaggttacaaatgctgacagtcgtaggacggcgaagggtagaaggacgtccggtcggggcctacgaggtggacggtctccgtgacgagtcttcgtgttacacgttcttacgatagtggtangagtgtgggtcgacgaccgaccgggaccgaggacgggtctaggaggtaggtaggagggtcgtggancgacgtactaacgtagaggtggtaacaacgaaactaacgtcgacgacaaagtaacggtaaccgtacggaacaaggtaccgtacaacccgactacggaccaaacctacggactaacacctacgacccagaacacgtacgactaagttagagggtggaagacgggtacacggtcagggacttaacgcgaacggaccgtacggaccgttaattcggtactaagtggaacgaggacgtacgtagtacggagggaacgggttggtaccgtaacgggtcgttacgggaggttccaagggtcncgg

SEQ ID NO: 269099 - DNA, 698 bp, Homo sapiens
  misc_feature: GYAE6OF01CGFS6.40.21.B10.1.454.CMB.1.raw
  modified_base (431)..(431): a, c, t, g, unknown or other
  misc_feature (431)..(431): n is a, c, g, or t
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (581)..(581): a, c, t, g, unknown or other
  misc_feature (581)..(581): n is a, c, g, or t
  modified_base (592)..(592): a, c, t, g, unknown or other
  misc_feature (592)..(592): n is a, c, g, or t
  modified_base (635)..(635): a, c, t, g, unknown or other
  misc_feature (635)..(635): n is a, c, g, or t
  modified_base (643)..(643): a, c, t, g, unknown or other
  misc_feature (643)..(643): n is a, c, g, or t
  modified_base (649)..(649): a, c, t, g, unknown or other
  misc_feature (649)..(649): n is a, c, g, or t
  modified_base (693)..(693): a, c, t, g, unknown or other
  misc_feature (693)..(693): n is a, c, g, or t
tcagtctagcgactcacgaccggtgctcgatttagtgtcgtcgcaagagaggagggggaacccaaaaaccaccacccctccgtagggagaactcccctagaccacagctcctcaccatggactggacctggagctattccttttgttggtggcagcagacaacgaggtcgcccactcccaggttacaatgctgctacggtcggtgggaggacggagggtagaaacgaacgtccgggtcggggccttacggaggttggacggggttcctcggtcggcggtacgttaccgtttcggttaggttaccgtacgttaccgtttaaccgtacgttaggtagggttagtaggtacggtcggtcggggtcgaccggaaccggacccggggacccccggaaggttacggttcgtaggaggtaggagttgggagtacgganaccgagtcctaaacttaggagtcgtaacgaactaaacgtagtagagaccaaggtacgtaacgaccggaagtacgacgtacgtaccaacgtacgaccacacggactacacaccgaccacanaaccncgtaatcgtagacgtaggtacgggngtacgcgaacngtacaacttccgacggactacggtaccttataagtcgttaacnggtaacgngtaagnttacggagtacggaggttagaccggtgtccgggtaattggagtngtacg

SEQ ID NO: 269100 - DNA, 294 bp, Homo sapiens
  misc_feature: GYAE6OF01CGID6.40.21.B10.1.454.CMB.1.raw
  modified_base (142)..(142): a, c, t, g, unknown or other
  misc_feature (142)..(142): n is a, c, g, or t
  modified_base (159)..(159): a, c, t, g, unknown or other
  misc_feature (159)..(159): n is a, c, g, or t
  modified_base (164)..(164): a, c, t, g, unknown or other
  misc_feature (164)..(164): n is a, c, g, or t
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (260)..(294): a, c, t, g, unknown or other
  misc_feature (260)..(294): n is a, c, g, or t
tcagtctagcgactcacgaccggtgctcgatttagtgtcgtcgcaagagaggagggggaacccaaaaaccacacccctccgtagggagaactccccagaccacagctcctcaccatggactggacctggagcattccttttnttggtggcagcagcaanaggtncccactccagttcaaatgctgcagtntggaggnggtagganaaagaaggccgttcggggcctacggnggtggcggtcctcgngngattcgttgtannnnnnnnnnnnnnnnnnnnnnnnnnnnnnnnnnn

SEQ ID NO: 269101 - DNA, 685 bp, Homo sapiens
  misc_feature: GYAE6OF02H1VPT.40.21.B10.1.454.CMB.1.raw
  modified_base (221)..(221): a, c, t, g, unknown or other
  misc_feature (221)..(221): n is a, c, g, or t
  modified_base (395)..(395): a, c, t, g, unknown or other
  misc_feature (395)..(395): n is a, c, g, or t
tcagtctagcgactcacgaccggtgctcgatttagtgtcgtcgcaggagagaggggacccaaaaaccacaccccctctagggagaatcccctagaccacagctcctcaccatggactggacctggagcattccttttctggtgcagcagcaacaggtcgcccactcccaggttacaaatgctgctagtcgtggaggcgaggtagaagacgccgtgggcctnagtgaggtcctccgtgcgagtacttcgtgtacagtcctttaccgatacgtggtatgagtcgtgggtcaccgtacgaccgggccccccggagtaaggtcgttaggacggtggtaggtgggtagtggacgtaccgacgtcctaacgtaactaggtggtacgaacaacctaagttanacgacacggtaagtacgtaccgaagtacgagtaacgaccaacctagtaccgacccagaacgacaacgaccctaccgaacaccggccaaccgacgtaccgttagtaacggttggaaagggtcgaagggtaccgaccgtaccggaataccggttacgtaccgtaaccgaccgggtaacccgtacctttacgttaaccgttgtacgggtacgtacgaacgtacgtacgttacgtcggtaacgggtacggtacgtacgggttccgtaccggtttacgacggtacgtacggtacg

SEQ ID NO: 269102 - DNA, 509 bp, Homo sapiens
  misc_feature: GYAE6OF01BGAJR.52.37.D04.1.454.CMB.1.raw
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctcctgaccatctctggctcagctgaggacgaggctgattatactgcagctcatacaacaaacagaacacttggtgttcggcggcgggaccaaacgtgaccgtctacgtcagacccaagctcgcccctgtctaccg

SEQ ID NO: 269103 - DNA, 555 bp, Homo sapiens
  misc_feature: GYAE6OF01DJX0S.52.37.D04.1.454.CMB.1.raw
  modified_base (431)..(431): a, c, t, g, unknown or other
  misc_feature (431)..(431): n is a, c, g, or t
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaatacccggcaaacgtccccaaactcatgatcttgaggtcagtgatcggccgcagggtttctcatcgcttctccggctccaagtctggcagcacggccctccctgaccatctctcgggctccgaggctggacggacgaggcctgatttattactgacngctcaatataacaaacaagaaactacgtttagggcgttcgggccggacgggaacccgaaacgtcggtacccgtccgtacgtaccacggacccgtaacggctaccggcccccttggtcctacccg

SEQ ID NO: 269104 - DNA, 531 bp, Homo sapiens
  misc_feature: GYAE6OF01BTPWO.52.37.D04.1.454.CMB.1.raw
tcagcgcagtacgacacgaccggtgctcgatttagtagcatactgttgggtttgggggtctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaacgtccccaaactcatgatcttgaggtcagtgatcggcccgcaggggtttctcatcgcttctccgctccaagtctggcagcacggcctcctgaccatctctggctccgagctgaggacgagctgattagtactgcagctcatataacaaacagtaaactacgttaggtcgttcggacggtacggaaccaacgtcgaccgtccgtacgtacacgcccgtaacggctacgccccctggtcctaccg

SEQ ID NO: 269105 - DNA, 555 bp, Homo sapiens
  misc_feature: GYAE6OF01EG53D.52.37.D04.1.454.CMB.1.raw
  modified_base (397)..(397): a, c, t, g, unknown or other
  misc_feature (397)..(397): n is a, c, g, or t
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatcttgaggtcagtgatcggccgcaggggtttctcatcgcttctccggctccaagtctggcagcacggctccctgaccatctctggctcagctgnggacgagctgatttattacgtgacagctcaatataactaaaacagaaaactacgttagggtacggttcggacgggccgggtaacccgaaacgtcggtaacccgttccgtaaccgtccgacgaccccgaacggcctcgaccccccgttcgcgtaacccg

SEQ ID NO: 269106 - DNA, 754 bp, Homo sapiens
  misc_feature: GYAE6OF01DYO6Y.52.37.D04.1.454.CMB.1.raw
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcaccatcctctgcacgtcggaaccagacaagtgaacttagtttcggttaactttaattaactttccgtcgttccttaccgttacggtaaccctaaacctaaaccgtaacccccggaacaaaaccgtaccccctaaaactcgtactacgtactttcgtttacggacggttacgtagtacgacgtccgggacccggtacggtacggggtttctcgtacgttccgtcgtttccgtcccgtactaccgtaacgttcgtcggactacggccgtaacccggtcccttacccgtacgtaccctacttccgtcggtccgggtcctaccgacggtcgtacgggaacgggtaccggaggtaccgttagttaacgtttaacttaccgtacgtacgtacgtactacgtaaataacgtaaacctaaacgtaacgtaacgttaccgggttagggttacggtaccgggaccggaaccgggaaacctaacgtccggtaccgtaccgtaccgaccgaacggacccgtacggtccctaccccgtcccgtccgtccgttcccg

SEQ ID NO: 269107 - DNA, 680 bp, Homo sapiens
  misc_feature: GYAE6OF01C47JB.52.37.D04.1.454.CMB.1.raw
  modified_base (122)..(122): a, c, t, g, unknown or other
  misc_feature (122)..(122): n is a, c, g, or t
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
  modified_base (386)..(386): a, c, t, g, unknown or other
  misc_feature (386)..(386): n is a, c, g, or t
  modified_base (442)..(442): a, c, t, g, unknown or other
  misc_feature (442)..(442): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
tcagcgcagtacgacacgaccggtgctcgatttagtagcatactgttgggtttgggggctgggtctcaggaggcagcgctctcgggacgtctccaccatggcctgggctctgctattcctcnccctcctcactcgagggcacgtgggtccctgggcccaggtcctcggccctgactcgacgtcctgcccttcgtcgtcctgggtcctcctggacncgtcgatccacctatcctccgtgccacgttcggaaaccnggcaagtcgactagttcgaacttagtaagttctgtcctcgtaggtaaccaactaactaccccggacaaacgtaccccaatccgatcgacttcttagacggtcagtgaacgtccggcccgcgtagggttcctnactccgtctcgtccgactcctaaggtcctggccagtccaccggtcctcctgacctntccgcgtcggacctccgaggtctaggacggtacgngtcgtatagtacgtacgcgtnaacgtcttacaggttactacggtcaaccgggtcgtaaccgtaccgtacgtttagtccggtcccgtttaaccgggaccgttaacccgggggcccgtaacgggtaccccggttaccctacccggtttacgggccctaacccggtcccccgttaaacccggcccccgttaaccccggtaacccgg

SEQ ID NO: 269108 - DNA, 888 bp, Homo sapiens
  misc_feature: GYAE6OF01DLPKF.52.37.D04.1.454.CMB.1.raw
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgccttccgtgtcgtgggtctccgtggacagtcgatcaccatcctcctgcacgtacggaaccagaccaatgaactagtttggttaactttaattaactttcttcgttccttaccgtacggttaaccaaaaccgtaaaccgtaacccccggaactaaaaccgtaccccctaaaacgttaccaagttagtactttacgtttaggaacgggttcaggtcggtaacgtcccgggcccggtacggtacggggttttcctacgtactccggtcctttccgtacccggtactaccgtaacgttccgtcgggaccctggaccccgacccggtcccccttacccgtaccgggtaacccttaacgttcccgtcggtccgggtaccgttacccggacggggtaccgttaacgggaacgggtaaccgggcggtacgtagttaacgtttaacttaccggtacggtaccgtcgtaaccgttacgtaaactaaccgtaaaaccgtaaaacgtaaaccggttaaaccggttacggtttacgggggtttaccgggttcccggggtaaccgggggtaaacccggggtaaaaccctaaaaccgggtttcccgggttaacccccggtttacccggttcccgtacccgggtaacccggttaacccccgggtaacgggttccccccggttaccccgggtccccccccgggtttaagtcccccggtttaacccccg

SEQ ID NO: 269109 - DNA, 851 bp, Homo sapiens
  misc_feature: GYAE6OF01EJ1WX.52.37.D04.1.454.CMB.1.raw
  modified_base (203)..(203): a, c, t, g, unknown or other
  misc_feature (203)..(203): n is a, c, g, or t
tcagcgcagtacgacacgaccggtgctcgatttagtagcatactgttgggtttgggggctgggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacngtcgatcacatctcctgcacgtggaaccagacaatgactagttaggttactttaattaatttcgttcgttcctccgttacggtaacccaacctaaccgtaacccccggaacctaaaccgtaccccctaaaactactacgtacggtactttccggttttaggtaacggttacgtaacgttacggtaacgttccccgggccccgggtaccggttaacgggggtttttccctaaccgtcgttcccgttcccgtttacccggtcccggttaccttacccgtaaacgttccggttcgggaccacgggtccccgtaaccgggtccccctttacccgtacccgtaacccttacgttcccgttacggggtccgggtccgttaccccggaacggggtccgtacggggtaacggggaccggtaagggttccttacggttaagttttaaccttaccggtacggtacctacggtacctacgtaactaacgaaacctaaacgaacggttaaaccgtcggtttaggggttccgggttacccggggacggtacccggaaccggtacggtccgtaaccggttaccccgttccggaaccgttcccgaaacccggttcccggtacggtacccccgttccccgggtcccccggttaacggtaccccg

SEQ ID NO: 269110 - DNA, 682 bp, Homo sapiens
  misc_feature: GYAE6OF01EOBFP.52.37.D04.1.454.CMB.1.raw
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
  modified_base (467)..(467): a, c, t, g, unknown or other
  misc_feature (467)..(467): n is a, c, g, or t
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacgagggtcctgggcccagtctgccctgactcacgcctgcctccgtgtctgggtctccgtggacagtcgatcacctatcctcctgacacgtacggaaccaggcaagtgactattggtaacttataacttctgtctccgtgtaaccaacaactaccccggacaaacgtaccccaaactcatcgtattccgttgtaggtcagtgacgtcggccctacgttgggttcctcgtacgtcgtcttaccncggtctaccgaagttcgngacacgcgaccgtcctccctgaccctagtcctacgtcggcctccgacggtctagggcggaaccggnggtacgttagttaactttagttccgacgacgtacgtctaacgttaactaacgtaaacgaaaccgtaagtaaaccgtagggtttacgggtcggtttaccggggaccgggtacccgggaaaccttaaaccggtccgaacccggttacccggttaccgtaccgaaccgtacccggtaaaggtcccgttacccggtcccccgtcggtcccttaacccgg

SEQ ID NO: 269111 - DNA, 744 bp, Homo sapiens
  misc_feature: GYAE6OF01EGPI2.52.37.D04.1.454.CMB.1.raw
  modified_base (528)..(528): a, c, t, g, unknown or other
  misc_feature (528)..(528): n is a, c, g, or t
  modified_base (606)..(606): a, c, t, g, unknown or other
  misc_feature (606)..(606): n is a, c, g, or t
tcagcgcagtacgacacgaccggtgctcgatttagtagcatactggttgggtttgggggctggggtctcaggaggcagcgctctcgggacgtctccaccatggcctgggctctgctattcctcaccctctcactcagggcacgagggtcctgggcccagtctcgcctgactcagcctgcctccgtgtctgggtctcgtggacagtcgatcactatctcctgacactacggaaaccaggccaaagtcgactagttgtaactttaataacttctggtcctaccgtacggttaaccaaactaaccgttacccccggactaaaaccggtaccccctaaaactctaattacggtaactttccgtttagggaacggttccgaattcggtaacgtcccgggtacccgacggtttaacggggtttcctacgtacgttccgccgtttccgtccgggtcctaccgtaacgtcgttcggacacgccgaacccggtcctacccgtacgaacctcttcccgtcggtagggccctaacccgnggtaccgttacggacgggtacggcgtcgttaaggttaacttacgttacgtcgtccgtacgtcttaacaaccgtttaanaaccgtaaaacgaaacgttaaccgtacggtttacgggttacggttccgggaaccgggtaccgaaaccgttacgtaccgttacgtccgtaacgtccgaacccgtacgacggttccacccgtcccgtccggtataccccg

SEQ ID NO: 269112 - DNA, 702 bp, Homo sapiens
  misc_feature: GYAE6OF01BJ6UK.52.37.D04.1.454.CMB.1.raw
  modified_base (358)..(358): a, c, t, g, unknown or other
  misc_feature (358)..(358): n is a, c, g, or t
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgctctgactcagcctgcctcgtgtctgggtctcctggacagtcgatcaccatctcctgccactggaaccagtcaatgacattacggtaacttataattctcgtctccgtcggtaaccaacctaaacgtaccccggacaaacgtaccccaaactcatgtaatcttgagtctagtgacgtccggccgtcgtagggttcncgagtccgtcgttcctcggctaccgaaggttctacggcacgaccgaccggcccttaccctcggtaaccctacgttacccgtccggtcgggtccttaccgacgggtcgtacgggacggaccggacgtacgtaggtactttaactacgtgaccgtaacgtccttacgaattaacctaaacgtaaaccaaacggtaaaccgttacggttcggggttacggtaccgggaccggggtaccgggtaaacccgtaaaccggttacccggacccggttacccgtaccggtaccggtaaccgtaaccccgtaaccgggtacccgttccccgtccccccgggtcgttaccccgg

SEQ ID NO: 269113 - DNA, 773 bp, Homo sapiens
  misc_feature: GYAE6OF01EQ65I.52.37.D04.1.454.CMB.1.raw
  modified_base (235)..(235): a, c, t, g, unknown or other
  misc_feature (235)..(235): n is a, c, g, or t
tcagcgcagtacgacacgaccggtgctcgatttagtagcatactgttgggtttgggggctgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccattcctcctgcactcggaaccngacaatgacattggttaacttataattctgtcttcctgtaccaacaactaccccggacaaacgtaccccaaactcatagtattccgtttaggacggttcaggttacgtacgttcccgggccccgtacgtacggggttttcctacgtacgttccgtcctttaccggtccccggtaccttacccgaaaggtttcccgacggtacccacgggtcccgaaacccgggtccccttacccgttacgaaccctacgttccgttccgttcggggccgtttaccccgaagggaccgttcgggacgggaaccgggtaacgggccgttacgtacgtttaactttaacccgtggaccctaacgtaccttacgtaacttaaacgttaaccgaaaaacacgtaaaacgtaccgtttacggggtacggtttaccgggaccgggtacccgggtaaaccgtaaacccgttacggtaacccgggttacccgtaccgtaccgtaaccgtacccgaaacggcccgttaccggtcccccgttaccggttccgtaacccg

SEQ ID NO: 269114 - DNA, 739 bp, Homo sapiens
  misc_feature: GYAE6OF01A547E.52.37.D04.1.454.CMB.1.raw
  modified_base (203)..(203): a, c, t, g, unknown or other
  misc_feature (203)..(203): n is a, c, g, or t
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacgagggtcctgggcccagtctgccctgactcagcctgcctcgtgtctgggtctccgtggacngtcgatcaccatcctcctgcctactcggaaccagacaatgactagttgtacttataattctgtctctgaaccaacacgaccccgactaacgtaccccaactcatgtattcttaggtacggtcaggtcgacgtccgacccgtcggttacggggtttctaccgtactccggttaccttccgtcccgggtaccttacccgtaacggtcggtacgaccgacggtcccgaacccggtcccctaccccgtaccgtacccgtaccgtttaccgttccgggttccgggtacccgtacccggtacgggtaccgttacgggaagggtaacccgggtaggtaccgttagttacgtttaacgttacgtacggtactacggtactaccgtaacgtaacctaaacgaaaccgtaaacttaacggttacggttacggggtcggttacccgggaccgggtaacccggtacgtaacccgtccggtaccgttaccggtaccgtacgtacccgacccgtacggccccttaccggtcccccgtagtccgtaccccg

SEQ ID NO: 269115 - DNA, 744 bp, Homo sapiens
  misc_feature: GYAE6OF01ANALD.52.37.D04.1.454.CMB.1.raw
  modified_base (313)..(313): a, c, t, g, unknown or other
  misc_feature (313)..(313): n is a, c, g, or t
tcagcgcagtacgacacgaccggtgctcgatttagtagcatactgttgggtttgggggtcgtggggtctcaggaggcagcgctctcgggacgtctccaccatggcctgggctctgctattcctcaccctcctcactcagggcacgagggtcctcgggccagtctgccctgactcacgcctcgcctccggtgtcgtgggtctacctggactagtcgatccactactctcctgcactggaacacgctaatcgactattcgtactatagtctgtctctgtaccaacactacccggacaacgtacccctaactaccntacgtattctttcgaaggtccgtagtacgtactccgggtccgacgttaacgggggtttctcctagttccgtcttccgttaccggcctaccgtaacgtccgtcgggctacgtcaacccggtcctcccgacgtacctacttcgtccgtcgggccttccgacggtcgttacggacggacggcggctacggtattaaacttcgtggctacggtctacgtaaactaccaaactaaaccgaaactaacgtaccggttacggtttaggggtacccggggtaccggggtaacccggtaacccggttaaaaccgttaccggttaaccccggggttacccccgttttagggacccccggttaaacccggccccgggttaaacccggggcgtttaaccccccggccccccgggtttaaacccgggtacccgtttacccccgg

SEQ ID NO: 269116 - DNA, 802 bp, Homo sapiens
  misc_feature: GYAE6OF01CAACH.52.37.D04.1.454.CMB.1.raw
  modified_base (246)..(246): a, c, t, g, unknown or other
  misc_feature (246)..(246): n is a, c, g, or t
tcagcgcagtacgacacgaccggtgctcgatttagtagcatactgttgggtttgggggctggggtctcaggaggcagcgctctcgggacgtctccaccatggcctgggctctgctattcctcaccctcctcactcgagggcacgagggtcctgggcccagtctcgccctgactcacgcctcgcctcgtgtcgtcgggtcctccgtggccagtcgactcacctatcctctgacctacgtacgaaccngaactaacgtgaactagttacggttaacttaattaattcgtcgtcctacgtacgtaaccaaaccaaccgtacccggtaactaaaccgtaccccaaacgtctagtacgttacttcgttacgaggtctaggtactacggtcccggccgtacggttacggtttccacgttacgtcccgtcgttcccggtccgtaccgtaccgtaacggtcgaccggacgtaccgtaccggtacccgttcccgttaccccgtacgtaccctaaccgttcgtccgggtccggtaccgtccgggacggtacgacgggtaacgggaccggtacgggtaaccttacgttaactttacgtaccggtacgtacggtaacctccgtaaactaaaccgttaaacctaaacccgtaaaccgtaaacgtaaacgttacgggttccgggtaccgggttaccgggaacccgggaacccggtaaccgtaaacccgtaccgggtacccgtaccgtaccggtaaccgacccggacccgtaaccgggtccccgtaccccgggtcccgttcccgtaccccgttcccg

SEQ ID NO: 269117 - DNA, 763 bp, Homo sapiens
  misc_feature: GYAE6OF01BCV2Q.52.37.D04.1.454.CMB.1.raw
  modified_base (204)..(204): a, c, t, g, unknown or other
  misc_feature (204)..(204): n is a, c, g, or t
  modified_base (268)..(268): a, c, t, g, unknown or other
  misc_feature (268)..(268): n is a, c, g, or t
  modified_base (311)..(311): a, c, t, g, unknown or other
  misc_feature (311)..(311): n is a, c, g, or t
tcagcgcagtacgacacgaccggtgctcgatttagtagcatactgttgggtttgggggctggggtctcaggaggcagcgctctcgggacgtctccaccagtcggcctgggctctgctattcctcaccctcctcactcagggcacagggtcctgggcccagtctgccctgactcagcctgcctccgtgctgggtctccgtggacngtcgatcaccatcctcctgcactggaaccagcaagtgactatttggtaacttagtaacttcgtnttcctacgtacaaccaacaccgtaccgaactaccgaacctaancgagtcttcgttgtaggcgtagagtcgtccgtcggaccggtcggttacggttcacgtaccggttccttccgtccggtacgtccctagaccgttggcgacgtaccgaccgtccggtacccttacgaccgtacttcggtacgttccgggtcggtcccacggggtcgtacggtacggggacgggtaacgacgggttcttaacgtttaatttaacccgtggacgtcgtaacccgttactaaactaaactaacccggaaaactaaaccggttaaagaaccgggttttggggttaaccggggtttcgggaaacccggggtccggtaaaacccgggtaaaacccgttacccggtaaacccggttaccccgttacgggttaaccccgaaaccgggtaccccgttaccgggaccggtcccccggttaacccccgttccgggtcccctaccggtttaccccg

SEQ ID NO: 269118 - DNA, 518 bp, Homo sapiens
  misc_feature: GYAE6OF02JER4D.52.37.D04.1.454.CMB.1.raw
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcagggggtttctcatcgcttctccggctccaagtctggcagcacggcctccctgaccatctctgggctccaggctgaggacgaggctgattattactgcagctcatatacaaacagaaacacttgggtgttcggcggcgggaccaacgtgaccgtctacgtcagcccaaggcctgccccctcggtctaccg

SEQ ID NO: 269119 - DNA, 514 bp, Homo sapiens
  misc_feature: GYAE6OF02H2WHC.52.37.D04.1.454.CMB.1.raw
  modified_base (327)..(327): a, c, t, g, unknown or other
  misc_feature (327)..(327): n is a, c, g, or t
  modified_base (444)..(444): a, c, t, g, unknown or other
  misc_feature (444)..(444): n is a, c, g, or t
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaatacccggcaaagtccccaaactcatgatctttgaggtcagtgatcggcccgnaggggtttctcatcgcttctccggctccaagtctgcagcacggctcctgaccatctctgggctccaggctgaggacgaggctgattattactgcagctcattatacaaacagaaacncttgggtgttcggcggacggaccaagtcgaccgtctacgtcagccaacggctcggcccctcggtctaccg

SEQ ID NO: 269120 - DNA, 662 bp, Homo sapiens
  misc_feature: GYAE6OF02JFYR1.52.37.D04.1.454.CMB.1.raw
  modified_base (288)..(288): a, c, t, g, unknown or other
  misc_feature (288)..(288): n is a, c, g, or t
  modified_base (455)..(455): a, c, t, g, unknown or other
  misc_feature (455)..(455): n is a, c, g, or t
tcagcgcagtacgacacgaccggtgctcgatttagtagcatactgttgggtttgggggtcgtggggtcgtcaggaggcagcgctctcgggacgtctccaccatggcctgggctctgctattcctcaccctcctcactcagggcacagggtcctgggcccagtctgccctgactcagcctgcctccgtgcctgggtctcctggacagtcgatcaccatctcctgcactggaaccagcaatgacattggtacttataattctgtctcctgtaccaacaactaccccgganaaacgtccccaaatcatgatcttgagtcagtgactcggccgcgtaggggtttctcatcgcttcgtaccggctaccaagtctggcagcaccggccttcccgtgacctactcctacgtcgggtcctccgaggtctaggacggtacgaaggtcttagtatttaacttacngtaccagtcctacgtaattaactaaaccaaaccgtaacgaaaaccttaccggtttagggttacggttacccggggtaccgggacccggggtaaacctaaaccggttccggtaaccccggttacccttaaccgggtaccctaaccgggaccccgtaaacgggtccccgttacccggtacccccccggttacgggtacccttaacccgg

SEQ ID NO: 269121 - DNA, 542 bp, Homo sapiens
  misc_feature: GYAE6OF02H3PKX.52.37.D04.1.454.CMB.1.raw
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatcttgaggtcagtgatcggccgcaggggtttctcatcgcttctcggctccaagtctgcagcacggcctccctgaccatctctcgggtctccgaggctcgaggacggaggtctagtattattactgcagctcatacgtacaaacagaaacctagttgggtacgttcggcggtacgggaccaacgtcggtaccgtcctaaccgtcgacgacccgtaaggcctacgcccctcggtctacccg

SEQ ID NO: 269122 - DNA, 553 bp, Homo sapiens
  misc_feature: GYAE6OF02I6HCA.52.37.D04.1.454.CMB.1.raw
  modified_base (283)..(283): a, c, t, g, unknown or other
  misc_feature (283)..(283): n is a, c, g, or t
  modified_base (451)..(451): a, c, t, g, unknown or other
  misc_feature (451)..(451): n is a, c, g, or t
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctctggtaccaacaataccccggnaaacgtccccaaactcactgatcttgaggtcagtgatcggcccgcaggggtttctcatcgcttctccggctccaagtctggcagcacggcctcctgaccatcctctcgggctccgaggctggacggacgaggctgattatactgcagctcatactacaaacagaaacncgttgggtacgttcgggacggacgggaaccaaacgtcggaacccttccgtaaccgtcgaacgccccgtaaggcctaccggtccccctacgggtcctaacccg

SEQ ID NO: 269123 - DNA, 586 bp, Homo sapiens
  misc_feature: GYAE6OF02IA6DC.52.37.D04.1.454.CMB.1.raw
  modified_base (330)..(330): a, c, t, g, unknown or other
  misc_feature (330)..(330): n is a, c, g, or t
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagacaatgacattggtacttataattctgtctcctggtaccaacaataccccggcaaacgtccccaaaactcatgatcttgagtcagtgatccggcccgngtaggggtttctcaatcgcttctccggctcctaagtctgggcagcctacggccctaccctgacccatccgtcgtgggcctccaggctgaggacgaggcctgtacttattacngcngctactataactaacaaacaagaaaccgtacgttgggtacgttacgggccggtaccgggaaccctaacgtcggtaacccgtaccgtaaccgtcgaaccgtacccgtaacggcccgttccgcccccgttaccgccttacccg

SEQ ID NO: 269124 - DNA, 517 bp, Homo sapiens
  misc_feature: GYAE6OF02HQQCA.52.37.D04.1.454.CMB.1.raw
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccgctccaagtctggcagcacggcctcctgaccatcctcgtggctccgagctgaggacgagctgattattactgcagctcatataacaaacagaaactacgttggtacgttcggcggcggacaaacgtcgaccgtctacgtcacgaccgagcctcgccccgtgctaccg

SEQ ID NO: 269125 - DNA, 694 bp, Homo sapiens
  misc_feature: GYAE6OF02JT09N.52.37.D04.1.454.CMB.1.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (353)..(353): a, c, t, g, unknown or other
  misc_feature (353)..(353): n is a, c, g, or t
tcagcgcagtacgacacgaccggtgctcgatttagtagcatactgttgggtttgggggcgtggggtcgtcaggaggcagcgctctcgggacgtctccaccatggctgggctctgctattcctcaccctcctcactcagggcacagggtcctgggcccagtctgccctgactcagcctcgcctccgtgtctgggtctcctggacagtcgatcaccatcctcctgcactcggaaccngacaatgacnttggtactatattctgtctctggtaacactanccccganaactacccaacnctancgtatcttggtaacgtcagtacgacgttccggaccgtcgtacgggggtttacnccgtacgtccgtccgttccggtaccggtccgttaccgtaacggttccgtacggaccggtaacggtccaccggggtcccccttaccgtaccggtacctaactccggtaccgttcgggtacccgtaccgacggtcggttacggacggggtaacggtaccggggtacttcgggttaacttaagtttacccgacttacggcctcgtacgtactaacctaacgaaactacgtaacgttaacggttcgggtaggtacccgggccggtacggaacctaaggtacccgacgttaccggtacgtacgaccgtccgacggtcctaccggaccccgtttcggacccttaccg

SEQ ID NO: 269126 - DNA, 772 bp, Homo sapiens
  misc_feature: GYAE6OF02HSVRR.52.37.D04.1.454.CMB.1.raw
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
  modified_base (339)..(339): a, c, t, g, unknown or other
  misc_feature (339)..(339): n is a, c, g, or t
tcagcgcagtacgacacgaccggtgctcgatttagtagcatactgttgggtttgggggctggggtctcaggaggcagcgctctcgggactctccaccatggcctgggctctgctattcctcaccctcctcactcagggcacgacgggtcctcgggccctagtcctcgccctgacctcacgcctcgcctccggtgtcgtcgggtctccgtggacngtcgactccacatctcctgcctacgtacggaaaccnggacaagtcgactgttggttacgttaataactatcgtctcgtagaccgaacaaccgacccgacaaaccgaccccaaactcatagtattntcgtctcgtactactacgtccggccgtacgacggtcttctctctcgttcttctcgtcgtcctacgtaacgtcgtacgaaccctaaccggacccgtcccttaccctacctaaccctaccgttcccgttccggttccggtcccttacccgtacgtaacggtacgggaacgggtaacgggtacggtaccgttaagttaactttaacgttacgtacgtaccgtaacgttaccttaacctttaaacgttaaaccgaacccgtaacccgtaacccctaacccgtaaccttaccgttaacgttaaccgtttccgggttaaccggggaaccgggtaaaccgggtaaccggtaaccggttaccggttaacccgggttacccggttaaccgttaaccgggtaccgtaacccggtaacccggtaccgggtccccgttaccccgg

SEQ ID NO: 269127 - DNA, 653 bp, Homo sapiens
  misc_feature: GYAE6OF02FG09M.52.37.D04.1.454.CMB.1.raw
  modified_base (232)..(232): a, c, t, g, unknown or other
  misc_feature (232)..(232): n is a, c, g, or t
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccaggtctgccctgactcagcctgcctccgtgtctgggtctcctggacagtcgatcaccatctcctgcactggaaccngcaatgactattggtacttataattctgtctctggttaccaacaataccccggcaaacgtccccaaactcatgatctttgaggtcagtgatcggcccgcgtacggggtttctctatcgtcttcctccggcctaccgaacgttcgtggcacgcgacgggtccctcctcgacctactctctacgggtcctaccgacggtcgtacggacgggtaaccggacgggtcgttacggtaacgtttaagttaccgttgtaccgacgtcgttaccaattaaccttaaacaaaacgtaacgaaaaccgtacggttagggttaccgggtttaccgggaccgggtaccggggaaccgaacggtccgtaaccggttaccctacggttaccgacgtacccgacggtaccgtccgacccccgtcggtaccgtaccc

SEQ ID NO: 269128 - DNA, 642 bp, Homo sapiens
  misc_feature: GYAE6OF02JTD69.52.37.D04.1.454.CMB.1.raw
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaactaccccggcaaacgtacccaaactccatcgacttctttggaggtcagtgacgtcggcccgtcgaggggtttctcgatccgtcttcctccggccttccaagtctaggtcagcgaccggccctccgtacgacctactctccgtcgggtcctaccggtacggcgtacgacgggaccgacggtcgttagtacgtttattacgtcgcacggtctactataactaaccgaaacaacgtaaacgttcggttagggtacggttcggaccgggtacgtaaccgtaacggttaaccggtacccggttcccgtaacgttaccgtaccggacccgtaacgggtccctaacccggttccccgtccggtacttaccccgg

SEQ ID NO: 269129 - DNA, 788 bp, Homo sapiens
  misc_feature: GYAE6OF02G3IVG.52.37.D04.1.454.CMB.1.raw
tcagcgcagtacgacacgaccggtgctcgatttagtagcatactgttgggtttgggggctgggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatctcctgcctacgtcggaaccagactaagtcgaactagtttacggtaacttaataatttctgttccttcctacggtaaccaaacctaaaccgttacccccggaactaaaaccgtaccccctaaaactcaatgtacttcgtttaggaggtccaggtgtacgtccggcccgtacggttacgggggtttacctactacgttaccggttccgttaccgttcccggtaccgtaccgtaaacggttccgtacgggtacaccggtaccgtaacccgggtccccttacccgtacgtaccctaacgttccgtacggtcggtaccgtaccgacgggtacgtacgggacggaaccggacggtcgttaacgttactttaacgttacgtcgacgtacgtcctaacgtaacgtaaactaaaccgaaactaacgtaaaccgttacgggtttaacgggttcggttaccggggaccgggtaaccgggtaacctaaaccggttaaccggtaaccccggttcgttaaccggaccgtaacgtaacccggtacggtaccttaccccggccccgttacggtaccttaaccccgg

SEQ ID NO: 269130 - DNA, 858 bp, Homo sapiens
  misc_feature: GYAE6OF02HV6XO.52.37.D04.1.454.CMB.1.raw
  modified_base (248)..(248): a, c, t, g, unknown or other
  misc_feature (248)..(248): n is a, c, g, or t
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
  modified_base (524)..(524): a, c, t, g, unknown or other
  misc_feature (524)..(524): n is a, c, g, or t
tcagcgcagtacgacacgaccggtgctcgatttagtagcatactgttgggtttgggggctggggtctcaggaggcagcgctccgtcgggacgtctccaccagtcggcctgggctctgcttacttcctcacctctcactcacgggcacgacgggtcctgggccctaggtctcgccctggactcgacgcctcgcctccggtcgtcgtgggtacctccgtaggacgacgtcgactccaccgtatcctaccngacctacgtacggaaccctagtaccaatacgtaacgtacgttacggttaactttacgtaaactttcgtaccgttctaccgttacggtaaacccaaactaaaccgttaacccggactaaaccgtaccctaaatcctagtacgtacgtacgttcggaacggttcaacggtgaacggttccggtaccggtacggtaggggtttcccngtaccgttcgtaccgtttcncccggtaacgtaccgtaacgtcggtacgacgtaaccgacctacccggtaccnccggtttaacacgtacctaccgtggtacccgtgtaccgtacggtacgtaccgggagaccggtagtaccgtaagtttaacgttacggtaactacggtaccgtatccgttaaacgtaacgttaaaccgaaccttaaaaggaaccggtttaaaccgtagggtttaccggggtaaaccggggttcgggtaacccccgggtaacgggtacccttaaaccggggttacccgttaaacccgttccggttaaaaccccggtaccggtaacccgtaacccggttaccggggttaccccgttaccccggtaacccccgggtttaccgaaccgtttaaccccggg

SEQ ID NO: 269131 - DNA, 831 bp, Homo sapiens
  misc_feature: GYAE6OF02FX5NE.52.37.D04.1.454.CMB.1.raw
  modified_base (200)..(200): a, c, t, g, unknown or other
  misc_feature (200)..(200): n is a, c, g, or t
tcagcgcagtacgacacgaccggtgctcgatttagtagcatactgttgggtttgggggctggggtctcaggaggcagcgctctcgggacgtctccaccatggcctgggctctgctattcctcaccctcctcactcagggcacgagggtcctgggcccagtctgccctgactcagcctgcctcgtgtctggtctctggacngtcgatcaccatccgtctgctacgtcgaaccagactaagtcaaccgtagttcggtacttataacttcgtcgtaccttcgtacggtaaccaaccgtaacgtacccggaactaaaccgacccctaaactcaagtgtacgttcgttaggacggtcgtaacgtcgtaacggtcccggtaccggtcggttacggggtttctacgtaccgttcgtaccgtttccgtaccggttacctaacgtacgttccggtacggacgacggttacccgtaccggtcccttaacccgtacgtaaccgtactttccggtaacggtccggtaccgttacggacggtcccggttaagggaccgggtacggttacccggtgttaacggtttaaacgttccgtaacggtcgtaccgtacgttaccttaagtaaaccggttacaaaaccgaaacgttaaacggtaaacgtttcggggttacgggtttaacccgggtcccggggaacgggttaacccgggttaaacccgttaaccggttcccccgtaaacggttaacccgtaacccgggttaaccgtaaccccggttacccggtaaccccggttcccgttacccccgggtaacccccggttacggtttaacccttaacccggg

SEQ ID NO: 269132 - DNA, 736 bp, Homo sapiens
  misc_feature: GYAE6OF02IXMDY.52.37.D04.1.454.CMB.1.raw
tcagcgcagtacgacacgaccggtgctcgatttagtagcatactgttgggtttgggggctggggtctcaggaggcagcgctctcgggacgtctccaccatggcctgggctctgctattcctcaccctctcactcagggcacagggtcctgggcccagtctgccctgactcagcctgcctcgtgtctgggtctcctggacagtcgatccaccatctctgcactcggaaccagacaatgacattcggtacttataattctgtctcctggtaccaactaacgtacccgacaaacgtaccccaaactcatcgtattcgtttagaggtcagtgacgtccggccgcgtacggggtttctcacgtccgtccgttcgtcccggacttccgtaacgttcgtacgggtccaacggaccgtacccgggtcccttaccccgtacgtaaccctacttcccgtcggtaccgggtaccgtccggaacggtcgtaacgggacgggtaacgggacggtacgttaggttaacgttttacgttaccgtcgtacgtacgtctactaagtaactaaaccaaacgaaagtaaaccgttacgggttacgggttacgggttaccggggaccgggtaccgggaaccctaaaccgggtaccggtaaccccggtttaccgtaaccggtacccgtaaccggtaaccccggtaacggttaccccgtaccccggtaccccccggttacggttacccctaaccccgg

SEQ ID NO: 269133 - DNA, 501 bp, Homo sapiens
  misc_feature: GYAE6OF01BAF4K.26.55.E11.1.454.CMB.1.raw
  modified_base (336)..(336): a, c, t, g, unknown or other
  misc_feature (336)..(336): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgtcgggcgagtcagggcattagcgtatttttagccttggtttcagcagaaaccgagggaaacgcccccaagtccctgactctatgctgcgtccactttagaaggtgagtccatcaaggttcagcgnagtggatctggacagagttcactctacaacatcagcacgcctgcagccctgacggtattttcgactaacttatactgaccagcagtataatgacttaccctatccaccgttcgggccggggacacgggcgtaggaaactaacgactgtggctgcaccattctgtc

SEQ ID NO: 269134 - DNA, 555 bp, Homo sapiens
  misc_feature: GYAE6OF01BPTBX.26.55.E11.1.454.CMB.1.raw
  modified_base (530)..(530): a, c, t, g, unknown or other
  misc_feature (530)..(530): n is a, c, g, or t
  modified_base (547)..(547): a, c, t, g, unknown or other
  misc_feature (547)..(547): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaattcttaaattggtatcaaggagaaaccagggagagcccctaaggtcctagatctagtggtgcatcctattttgacgtaaagtcggggtaccccaacctaaaatttcgaaggtggacaagtggatcgtgggacagtatttcactctcagtctaattaataatctacgactaaccctgtaggtattttagactaacgtttactactagtacaactagtacgttaacacggtaccccccttattaccgttttcggacccgtaaggggaccaggcgtggagatacacgtaggacttggnggtctgacctacatctnttctctac

SEQ ID NO: 269135 - DNA, 921 bp, Homo sapiens
  misc_feature: GYAE6OF01D2LLW.26.55.E11.1.454.CMB.1.raw
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatccctccctgtctgcatctgtaggagacagacgtccaccatctacgttcggccgggacaaggtggacggacaaataaaactaaatttacttaaagttggtatacgaaggaacgaaaccgagggaacgaccgtaccccgtaaggtcctagtactactagtggtgacctacttaccttagttttacgaacgtaaaacggggttccggggtaaccccctaaaccgttaaaacgtttaccgtaaggttcgggtacctaaggggtacgggtaacgtttccgggttaacggggaacctaagggtttacttttaccctaacccgtttaccgtttaccgaaacggtactttaaaacgttttaaaacttaaaccgtttaccgtacgtaaaccccgttaaacccggttagggttaaacgggttttaacgtttttaccggtaacccttttaaaaccgttttaaacccgttaacgttttaccggttaaacccgtaaaaccggttaaacgggtttaaaccggttttaaacccggtaaacccccggggtttaaccccccccttttaaacggtttttaccccgggtttttaccggggaaccccgggtaaaccggggggtaaaccctaaacgggttccgttaacggggtaaacgtacgttaacccgtaaaccggtaaacgggtaaaccgttcgggtttaccggacccgttacggaaccccgtaacccttaaccgttaccgtttaccggtttaccttacccgttaaccccg

SEQ ID NO: 269136 - DNA, 536 bp, Homo sapiens
  misc_feature: GYAE6OF01BJQI0.26.55.E11.1.454.CMB.1.raw
  modified_base (268)..(268): a, c, t, g, unknown or other
  misc_feature (268)..(268): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccaggganagcccctaaggtcctgatctatggtgcatccattttgcaaagtgggtcccacaaattcagtggcagtggatcgtgggacagtatttcactctcagctaattaataatctgcaacctgagtatttgactaacttactactcgtacaacagtagttaacacggtccccctaattacgttttcggacctacggggaccaaggcgtaggagtactacaacgtacggtaactggtcggctacgacctaccacttactcgttccttcgtacccg

SEQ ID NO: 269137 - DNA, 668 bp, Homo sapiens
  misc_feature: GYAE6OF01DDZWU.26.55.E11.1.454.CMB.1.raw
tcagagactatactcacgaccggtgctcgatttagcactcgcacgttgggtttggggagtctcagtcaggacacagcatggacatgcgggtccccgctcagctcctggggctcctgctgctctggctcccaggtgtcaaatgtgacatccagatgacccagtctccttccaggctgtctgcatctgtcggagacagagtcaccatcacttggccgggccagtcagagtagttgggtaggtggttggccgtggtatacgagacaacgaaaccgaggaaacaactaccctaagactacctaatcctctcgaggtcgtcgttgggttaggtaaaggtcgggtacccagtacgtaaggttcgaggtcggcgcggatcgtagggacagtaactcactctcaccactcgacggccggtacctaccgtagtcgtaggacgtactcgtacgactaactttacttacgtacgaaccctaaactaattacgttagttaactttaacttttacgttaccttaccgacggttaccggttacccgggacccgggtaacgggggtaacccgtaaaggggtaccggtaaaggtaccggtaaacggtaccggtaaacggttgggtaaccgggtaccgtacggtacccctaacgttacgttacccgtttcgttccctttaacccg

SEQ ID NO: 269138 - DNA, 525 bp, Homo sapiens
  misc_feature: GYAE6OF01BKJ91.26.55.E11.1.454.CMB.1.raw
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccggnaagtgaggcataaacaattctaaatggtatcagagaacagganagccctaaggtcctgatctatggtgcatccattttgcaaagtgggtaccactaaattcaagtggacagtgatcgtagggacagatttcacgtctcagtctaattaagtaatacttacgactaaaccctagaaggtattttacgactaacgttactactagtacaacagtagttacaacggcccccttatacctttaggaccagggtaccaagctaggagtactacgacaggtaactggtcgctgactacctatctgtcttctaccg

SEQ ID NO: 269139 - DNA, 570 bp, Homo sapiens
  misc_feature: GYAE6OF01DGFOJ.26.55.E11.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (377)..(377): a, c, t, g, unknown or other
  misc_feature (377)..(377): n is a, c, g, or t
  modified_base (422)..(422): a, c, t, g, unknown or other
  misc_feature (422)..(422): n is a, c, g, or t
  modified_base (448)..(448): a, c, t, g, unknown or other
  misc_feature (448)..(448): n is a, c, g, or t
tcagagactatactcacgaccggtgctcgatttagcactcgcacgttgggtttggggaggtctcagtcaggacacagcatggacatgcgggtccccgctcagctcctggggctcctgctgctctggctccgaggtgccagatggtgacatccagatcgacccagtctccactccctccctgtctgcatctgtagganacagagtccaccatcacttacggccgganaagtggagggactaaattaaaactaaatttacttaaagttcgtaatacgaaggaacaaaccgagggaacaacgaccccgtaagtccctagtatctagtggtcgacattcctatttgacgtaaggtcggtaccaactaattcagtcgctagngatcgtaggactagtcttcactctacagtactaataataatctanacaacgtgtagtattagactattacnctagtacaatagtactacgacgtcccctagttaccgttggaccgtagggacctagcgtaggagtactacgacgtaaggtactaggtcggctacgcctaccgtatccgttctcttcgtacccg

SEQ ID NO: 269140 - DNA, 594 bp, Homo sapiens
  misc_feature: GYAE6OF01AH3CA.26.55.E11.1.454.CMB.1.raw
  modified_base (437)..(437): a, c, t, g, unknown or other
  misc_feature (437)..(437): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattacttaaattggtatcgaggaagaaaccagggagacgccccgtaaggtcctgatctatggtgcatcctattttgcaaaggtcgggtaccctaactaactttcagtggcaggtggatcgtgggacagatttccatcctacacgactaatttaataatctagacctaaccgtagacggtattttgactaaccttactacgtntacaacagtacgttacaccgtaccccctaatttaccgttttcggacccgtaacggggtaaccctacggaccgtgggacgtacgtaaccgaacgtaacggtaaccgttaggtcgggtacctacggaccctacccgtacttacctcgttccttctaccg

SEQ ID NO: 269141 - DNA, 680 bp, Homo sapiens
  misc_feature: GYAE6OF01DUZOJ.26.55.E11.1.454.CMB.1.raw
  modified_base (518)..(518): a, c, t, g, unknown or other
  misc_feature (518)..(518): n is a, c, g, or t
tcagagactatactcacgaccggtgctcgatttagcactcgcacgttgggtttggggagtctcagtcaggacacagcatggacatgcgggtccccgctcagctccgtggggctcctgctgctctggctccggaggtgccagatgtgacatccagatgacccagtctccactccctcctgtctgcctatcgtggtaggagacaggactccaccatcctacgttcggccggacaaggtggaggacaataaactaattacttaaatggtatacgaaggaagaaaccgagggacgaacgaccccgtaaggtccgtagtacgttactagtggtcgtactacttacctagttttacggaacgtaaacgggttccgggtaacccctaaccttaaaacgtttccggaaggttacggtacgtaagggttgggtaacgtcgttagggaaccgtaagttacgtttactacgtctacgacgtaacttaattaacttagtccttagaacctaacgtaggtaggttactttnaacgttaaccttagtacgtgtacaaacgtagtactaacccgtccgttaacccctacgtttcgtaccggaccgtaacgggacctagaccggtaggactacgtaccgaacgtacggtaagtgtacggtcacgtacccacttacgtccacgtttcctactacccg

SEQ ID NO: 269142 - DNA, 746 bp, Homo sapiens
  misc_feature: GYAE6OF01BZ0A4.26.55.E11.1.454.CMB.1.raw
  modified_base (203)..(203): a, c, t, g, unknown or other
  misc_feature (203)..(203): n is a, c, g, or t
tcagagactatactcacgaccggtgctcgatttagcactcgcacgttgggtttggggagtctcagtcaggacacagcatggacatgccgggtccccgctcagctccgtggggctcctgctgctctggctccgaggtgccagatgtgacatccagatcgacccagtcctccactccctcccgtgtctcgcatcgtaggtagganacagacgtcacatcacgtcggaccgggacaaggtggaggactaagtaaactaattacttaagttggtatacgaaggaacgaacgaggacgacgtaccccgtaggtcctagtactactagtcggtacgctacttacctagtttacgaacgtaaacgggttaccgggtaccctaacgttaacgtttccggaggtacggactaagggtacgacgttcggtagggaactaggttacctttacaccttctaacgtaacgtaacttaatttaactaacgttcgtacggtaacctaaacggttaggttaacgtttaacgtttacgaacctttaacgtttaacctacgtttaacgaaccgttaaacgtaacgtaaaccgttacccggtaacccgtaccccgtttaagtttacccggttacgggaacccggaacgggtaaccgtaagaccggttaaggtaacgacgttaaccgaaacggtacggttaaccgtgggtccgtacgtaaccgtaccctaacggttatacccgtttacttcccgttacttaacccg

SEQ ID NO: 269143 - DNA, 791 bp, Homo sapiens
  misc_feature: GYAE6OF01C1YTZ.26.55.E11.1.454.CMB.1.raw
  modified_base (223)..(223): a, c, t, g, unknown or other
  misc_feature (223)..(223): n is a, c, g, or t
tcagagactatactcacgaccggtgctcgatttagcactcgcacgttgggtttggggagtctcagtcaggacacagcatggacatgcgggtcccccgctcagctcctggggctcctgctgctctggctccgaggtgccagatgtgacatccagatgacccagtcctccatccctccctgtctgcatctgtaggagacagagtccaccatcacgttcgccgggnaagtggaggcaataaactaaattacttaaagttggtatacgaaggtaacgaaaccgagggaacgacgacccctaaggtccctagacttacgtagtggtcgacctacttcctaagttttcgaaccgtaaaagggttcccgggtaacccctaaaccgttaaactttccgaaggttacggacgtaacggtaggacgttacggtaggggaacctaaggttacttttaccgaacgtttaccgtacctaacggtaactttaaagtttaaacgtaaactttccgtaacggtaaccctaaacccggttgtaacgggtttacttttacggaaccttaaacctttaaccgttacttaaccgtactaaaccgtaacgttaaccgtttaacccgaacccggttaccccccttaagttttacccgggtttaaccgggtacccggaaacggggttaaccctacgggtaaccgtacgggtaaaccgtaccttacgaaccggtaacggtaacccggttggtaccggaccgttaacccgaccgtacccttaacggttaccttccggttccgttacccgttacccg

SEQ ID NO: 269144 - DNA, 822 bp, Homo sapiens
  misc_feature: GYAE6OF01B8GB2.26.55.E11.1.454.CMB.1.raw
  modified_base (150)..(150): a, c, t, g, unknown or other
  misc_feature (150)..(150): n is a, c, g, or t
  modified_base (169)..(169): a, c, t, g, unknown or other
  misc_feature (169)..(169): n is a, c, g, or t
  modified_base (189)..(189): a, c, t, g, unknown or other
  misc_feature (189)..(189): n is a, c, g, or t
  modified_base (235)..(235): a, c, t, g, unknown or other
  misc_feature (235)..(235): n is a, c, g, or t
  modified_base (443)..(443): a, c, t, g, unknown or other
  misc_feature (443)..(443): n is a, c, g, or t
  modified_base (455)..(455): a, c, t, g, unknown or other
  misc_feature (455)..(455): n is a, c, g, or t
tcagagactatactcacgaccggtgctcgatttagcactcgcacgttggggtttggggagtctcagtcaggacacagcatggacatggccgggtccccgctcagctccgtgggctcctgctggctctggctccggagtcgccagatggtnacactacagatcgaacccngtcctacctactccctcgtntctcgactattcgaggttacggacgacgacggtacgtacctaaccncgttaaccgtggttaaccggccgggaactaggaggaacggactaaaagtaaaaccttaaattttacggttaaattaggtaacaacggtaagggaacgaaccgaaggggtaactaccggtaacccggtaacggtaccgtagtaacgtagtttacggataccgtattactacgttagtttacaacggttaaggtaccggactaaaacgtnttacgaggttanacggtcggtacgttagtccgtaagggtatacgtttacggtttaacaccttaacggtttaaccgaacgtttaacgttaaagtttaaacttaaccgttacgttaaacggttacctaacccggttaagggtttaaccgtttaaacggttaacctttaacgttaaacgttttaaccgtaagttaaccgtaacgttaaaccggtaacgttaaccggtaaccgtacccgttaaccccgtttaccgtttaaacggtttaccccgggaaagttacggaacggtcgtacgtaggaacgttacgtaccgtaacggtacggtaactacggtcgtaacgtcgaacttaaccggtatacgttccttacgtctttaacccg

SEQ ID NO: 269145 - DNA, 685 bp, Homo sapiens
  misc_feature: GYAE6OF01BD0NY.26.55.E11.1.454.CMB.1.raw
tcagagactatactcacgaccggtgctcgatttagcactcgcacgttgggtttgggggagtctcagtcaggacacagcatggacatgcgggtccccgctcagctcctggggctccctgctgctctggctccgaggtgccagatgtgacatccagatgacccagtcctccatccctccctgtctgcattctgtaggagacagagtcaccatcacgttcggccgggacaggtggagggacaataaaactaaatttacttaattaggtatacgaagggaacgaaaccggaggggagaaccggtaccccctaaggtcctaggtacttactagtggtacgacacgttctagttttacgacgtaacggtcgggtacccctaactaacgttcgaggtcggacgtagtaggtatacgtagggactagttattaccacgtctacagtactaattaacgtaattcgtagacctaacgtggtaagttacttacgacttaacgttaaccgtcttacgtacctaacgtacgtacgttaccgacccgttaccccttagtttaccgttaccggaccggtaaccgggaactagggtacctaagggtaacctacgtaaacggaccggtaaacgggttactacggggttacggctaaccgggaccttaccggtactacggttccgtttccttcccgttacccg

SEQ ID NO: 269146 - DNA, 614 bp, Homo sapiens
  misc_feature: GYAE6OF01A5YGP.26.55.E11.1.454.CMB.1.raw
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccggcaagtgagggcaataaacaattacttaaattgtatcaggaagaaaccaggagacgccctaaggtcctgatctatggtgctatcctattttcgactaaaggtcgggtaccccaactaaactttcgagtggctaggtgatcgtggacagtatttcacgtctcgagtactaatttaataacttctagtaacctaaccgtaggtaggttaattttcgacttaactttactacttacgtacaactaacgtaacgttacaacccggttcccccttaagttaccgttttacggaccgtacggggtaacccacggtacggtacgagtactacgtaacgtaacgggtaacgttcggttcggtacgtcgtacctaaccgtacttaccgttcgttaccgttcttaacccg

SEQ ID NO: 269147 - DNA, 484 bp, Homo sapiens
  misc_feature: GYAE6OF02IJD87.26.55.E11.1.454.CMB.1.raw
  modified_base (407)..(407): a, c, t, g, unknown or other
  misc_feature (407)..(407): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgaggcataaacaaattcttaaattggtatcaggagaaaccagggagagcccctaaggtcctgatctatggtgcatccattttgcaaagtgggtcccacaaattcagtgcagtggatctgggacagatttcactctcagcattaataatctgcaactgaggattttgctaacttactactgtacaanagattacaggtcccctatactttgccagggaccaagctggagatcacgaggaactgtggctgcacatctntctntac

SEQ ID NO: 269148 - DNA, 496 bp, Homo sapiens
  misc_feature: GYAE6OF02HWDQR.26.55.E11.1.454.CMB.1.raw
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccggcaagtgaggcataaacaattcttaaattggtatcaggagaaaccaggagagccctaaggtcctgatctatggtgcatccattttgacaagtgggtccacaaatttcagtgcagtggatctgggacagatttcactctcagcattaataatctgacaacctgaggtattttgactaacttactactagttacaacagagttacgacgtccccctatactttgccgaagggtaccaagctagagatcacgaggaactgtacgtctcgcacatctgtcttctac

SEQ ID NO: 269149 - DNA, 556 bp, Homo sapiens
  misc_feature: GYAE6OF02IFCM0.26.55.E11.1.454.CMB.1.raw
  modified_base (195)..(195): a, c, t, g, unknown or other
  misc_feature (195)..(195): n is a, c, g, or t
  modified_base (218)..(218): a, c, t, g, unknown or other
  misc_feature (218)..(218): n is a, c, g, or t
  modified_base (454)..(454): a, c, t, g, unknown or other
  misc_feature (454)..(454): n is a, c, g, or t
tcagagactatactcacgaccggtgctcgatttagcactcgcacgttgggtttgggggtaggtcgtcagtcaggacacagcatggacatgcgggtcccgctcagctcctgggctcctgctgctctggctccgaggtgccagatgtgacatccagatgacccagtctccatcctccctgtctgccatctgtagganacagatcaccatcacttgccggnaagtgaggcaataaacaattacttaaattggtatcgaggagaaacgaggagacgcccgtaaggtctagatcgtagtggtgctatcctattttgactaaagggttcgggtaccccaactaaactttcaagttggacaggtggtatcgtagggactagtatttcacttctacagtactaattaataatctagactaactgagtatttgactaacttactatgttacaatagagttacnccgtacccttatacgtttcgaccgtagggaaccaagcgtagacgtatacgacgtaacggtactggtacgcgtcgactaccgtactcttacgttctactaccg

SEQ ID NO: 269150 - DNA, 490 bp, Homo sapiens
  misc_feature: GYAE6OF02GOAGY.26.55.E11.1.454.CMB.1.raw
  modified_base (487)..(487): a, c, t, g, unknown or other
  misc_feature (487)..(487): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctggacagatttcactctcagcattaataatctgcaacctgaggattttgcaacttactactgtcaacagagttacagccccctatacttttggccagggaccaagctggagatcacaggaactgtggctgcaccatctgtcttntac

SEQ ID NO: 269151 - DNA, 535 bp, Homo sapiens
  misc_feature: GYAE6OF02JCTR6.26.55.E11.1.454.CMB.1.raw
  modified_base (416)..(416): a, c, t, g, unknown or other
  misc_feature (416)..(416): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctggatctatggtgcatccattttgcaaagtggggtcccaccaaatttcagtggcagtggatctgggacagatttcactctcagcattaataatctgcaacctgaggtattttgactaacttactatgtactaanacagtacgtacgtaccccgtacttactttacgtccgtacggaccggaacgtacgtcggagtacgtacacgaacggacgtaacgtggtacgtgacgacctacgtctcgttcttcttaccg

SEQ ID NO: 269152 - DNA, 502 bp, Homo sapiens
  misc_feature: GYAE6OF02HW5K8.26.55.E11.1.454.CMB.1.raw
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgagattttgactaacttactactgtacaacagagttacacggccccctatacctttggcctaggggtaccaagctggagatcacgaggaactgtggctgcaccatcctgtcttctaccg

SEQ ID NO: 269153 - DNA, 498 bp, Homo sapiens
  misc_feature: GYAE6OF02FOJTO.26.55.E11.1.454.CMB.1.raw
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgctaacctgagtatttgactaacttactacttgtacaactagagttacacggaccccctatactttgccacgggaccaagctaggagatcacaggaactgtgctgcaccatctgtcttctac

SEQ ID NO: 269154 - DNA, 790 bp, Homo sapiens
  misc_feature: GYAE6OF02GMQEA.26.55.E11.1.454.CMB.1.raw
tcagagactatactcacgaccggtgctcgatttagcactcgcacgttgggtttggggagtcgtcaggtcaggaccacacgtcgatcggacatgcgggtccccgctcgagctccgtgggctcctagctgctctggacctccgaggtgtccgagatggtgtacgttacttccgtagattagtaaaccccgagttcctaccattccctcccgtgtcctgcctagttcgtggtacgggagactaggacgtcgacccggtactcgaacttcggcccgggataaggtggacgggacaattaaaaccaaagttcttaaattggtaattcgaaggtaagaaaacccgaggggacgtaacgtacccccgttaaagggtcccgttacggaacttacgttaagttcgggtacggaacgtacgttaccgtagttttcggacgtaaagggtccggggtaccctaaaccgtaaaactttaccgaggtacggacgtaggtacggaacttacgttagggactagtacgtttccgaccgttcgtacaaggtcctaagtttaactaacttctacgtacctaaccgtagaaggttatttacgactaaacgttacgtaaccttacgtacctaacgtagtaacgttaaccgtaccggtacccccttaagttaccgttttaccggaccggtaaacggggaccctaaacggaccgttacgggtaacgttacgttaccgaacggtaacggaaccttggtacgtacgttacgtaccgtaaccgttagttacctttacggttaccttacgttaccg

SEQ ID NO: 269155 - DNA, 547 bp, Homo sapiens
  misc_feature: GYAE6OF02FYR0S.26.55.E11.1.454.CMB.1.raw
  modified_base (421)..(421): a, c, t, g, unknown or other
  misc_feature (421)..(421): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatcctattttgactaaaggtcggggtcccaacctaaatttcagtggcagtggatcgtggacagtatttcactctcagctaattaataatctagcaacctgaggtattttgactaacttactacttntacaactagtacgttacacggtacccccttattaccgtttcggaccgtacggggaaccaacgcgtaggacgtactacaacgaaggaactggtcggtactgacctactactctcgttccttctaccg

SEQ ID NO: 269156 - DNA, 493 bp, Homo sapiens
  misc_feature: GYAE6OF02F24D8.26.55.E11.1.454.CMB.1.raw
  modified_base (463)..(463): a, c, t, g, unknown or other
  misc_feature (463)..(463): n is a, c, g, or t
  modified_base (490)..(490): a, c, t, g, unknown or other
  misc_feature (490)..(490): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtccctgatctatggtgcatccattttgcaaagtggggtcccaccaaatttcagtggcagtggatctgggacagatttcactctcagcattaataatctgcaacctgaggtattttgctaacttactactgtcaacagagttacacggaccccctatactttggcctagggaccaagctagagancagagaactgtgctgcacatctgtctntac

SEQ ID NO: 269157 - DNA, 579 bp, Homo sapiens
  misc_feature: GYAE6OF02F1NMB.26.55.E11.1.454.CMB.1.raw
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgaggacataaacaattcttaaatgtatcaggagaaaccaggagagcccctaaggtcctgatctagtggtgcatcctattttgactaaaggttcggggtaccccaaccaaattttcaggtaggctaaggtggaagtcgtaggggactaagtatttacactctacaactatcacgcagcctgcacgcctggaggtattttgactaacttattactgcctagctaagtaattaatagtaactttaccctattccgacccgtttcgggcccggggaactacgggaccgtaacggtaaaaccgtaaacggtaacgttaggtacggtaccgtacgcctaacccgtacttcttacgtctttaccg

SEQ ID NO: 269158 - DNA, 543 bp, Homo sapiens
  misc_feature: GYAE6OF02IHSDN.26.55.E11.1.454.CMB.1.raw
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggccagtcagagtattggtaggtggttggcctggtatcagcagaaaccaggaacaatccctaagatcctaatctctcaggcgtctggtttggaaagtgggtcccatcaaggttcagtggcgccggatcgtgggacagaattcactctacacatcaggccggctccagtctggacgtactctgcctaactttattactgacctaacaattacgtagtaattattttattctccgtagtcgtttaccggccgtacggggtacccaggttcggaagtcgaaaggccgtaacttcggtaggtccgtacggcctaccgacttcgtcgtttaccc

SEQ ID NO: 269159 - DNA, 511 bp, Homo sapiens
  misc_feature: GYAE6OF02IFKA0.26.55.E11.1.454.CMB.1.raw
  modified_base (372)..(372): a, c, t, g, unknown or other
  misc_feature (372)..(372): n is a, c, g, or t
  modified_base (506)..(506): a, c, t, g, unknown or other
  misc_feature (506)..(506): n is a, c, g, or t
tcagagactatactcacgaccggtgctcgatttagcactcgcacgttgggtttggggagtctcagtcaggacacagcatggacatgcgggtccccgctcatctcctggggctcctgctgctctggctccgaggtgccagatgtgacatccagatgacccagtctccatcctccctgtctgcatctgtaggagacagagtcaccatcacttgccgggcaagtgaggcataaacaaattcttaaattggtatcaggagaaaccaggagagccctaaggtctgatctatggtgcatcattttgcaagtgggtcccaactaaattcagtggacagtggatcgtggacagtatttcactctcagcattaataatctnacactgagtatttgactaacttactactgtacaacagaagttacgacgtacccctattactttcggaccgtacgggaccaacgcgtaggagatacgacgacgtacgtgtcgtctgcaccgataccgtgttcctntaccg

SEQ ID NO: 269160 - DNA, 580 bp, Homo sapiens
  misc_feature: GYAE6OF02GLU4F.26.55.E11.1.454.CMB.1.raw
  modified_base (381)..(381): a, c, t, g, unknown or other
  misc_feature (381)..(381): n is a, c, g, or t
tcagagactatactcacgaccggtgctcgatttagcactcgcacgttgggtttgggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaattcttaaattggtatcaaggagaaaccagggagagcccctaaggtcctagatctatggtgcatcctattttgactaaaggtcggggtacccactaaatttcaggtggctaggtggatcgtagggactagtactttcactctcganactaattaatatctagacaactgaggtatttgactaacttactacttagtactaactagtacgttaccgaccgtacccccttagtttaccgtttcggacccgtaaggggacccaaggtaccgtaggacgtactacgaacgtaacggtaactacggtcggtactcggacaccgtacgttcgtacgttacctacttacccg

SEQ ID NO: 269161 - DNA, 516 bp, Homo sapiens
  misc_feature: GYAE6OF02JQ3CH.26.55.E11.1.454.CMB.1.raw
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (418)..(418): a, c, t, g, unknown or other
  misc_feature (418)..(418): n is a, c, g, or t
  modified_base (494)..(494): a, c, t, g, unknown or other
  misc_feature (494)..(494): n is a, c, g, or t
  modified_base (502)..(502): a, c, t, g, unknown or other
  misc_feature (502)..(502): n is a, c, g, or t
  modified_base (513)..(513): a, c, t, g, unknown or other
  misc_feature (513)..(513): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgaccccagtctccatcctccctgtctgcatctgtaggagacagagttcacccatccncttnccgggcaagtgagggcataaaacaaattctaatggtatcaggaataaaccnggganagccccctaagtccctgatctatggtncatccattttgcaaagtggggtcccaccaaattttcagtggcagtgggatctgggacagatttcactctcagcatataatctgcaacctgaggattttgcaacttactacttgtcaacanagtttaacacggcccccttattacctttttaggcctagggggaccaaagctggagatacacaagggaactcgtggntgcacctntctgtcctttnacc

SEQ ID NO: 269162 - DNA, 703 bp, Homo sapiens
  misc_feature: GYAE6OF02HUM9O.26.55.E11.1.454.CMB.1.raw
tcagagactatactcacgaccggtgctcgatttagcactcgcacgttgggtttgggggagtctcagtcaggacacagcatggacatgcgggtccccgctcagctcctggggctcctgctgctctggctccgaggtgccagatgtgacatccagatcgacccagtcctccatcctccctgtctgcatctgtaggagacagagtcaccatcacttgccgggacaagtgaggcaataaacaattcttaattggtatcaaggacgaaacgaggaagacgaccctaaggtcctgatctatggtgcatccattttgacgtaaaggttcgggtacccaactaaactttcagttggcagtggatcgtaggactagtactttcaactctacacgtactaattaaactaactacgtagaccgtaaaccgttaggtaacggtaagtttttacggaacttaaaccgtttaacgttaaccgttacggttaacctaaaacgtaacgtaaacggttaaaccgtaacccgggtacccccctttaaagttaacccgtttttacgggaccccgtaaacgggggtaaccccgaaaggttccgttaagggaacggtacgttaccggaaaccgtaaacgggtaaccgttagggtaccgggtacgttaccggtacctaacccggtacgtttacccggtacgttacccgtttaccgttaaccccgg

SEQ ID NO: 269163 - DNA, 550 bp, Homo sapiens
  misc_feature: GYAE6OF02FP9IX.26.55.E11.1.454.CMB.1.raw
  modified_base (364)..(364): a, c, t, g, unknown or other
  misc_feature (364)..(364): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctagatctatggtgcatccattttgctaaagtggggtcccaccaaatttcagtggcagtggatcgtgggacagtatttcactntcagcattaataatctgacaacctgagtattttgactaacttactacttgtacaactagtacgttaacgacggtaccccccttataccgtttttaggcccgtaaggggaccctaaagcgttagggagtactcaacgtaaggaaccttggtacggctagccacctactcgtcgttacttcgttaccg

SEQ ID NO: 269164 - DNA, 545 bp, Homo sapiens
  misc_feature: GYAE6OF02IF6JQ.26.55.E11.1.454.CMB.1.raw
  modified_base (270)..(270): a, c, t, g, unknown or other
  misc_feature (270)..(270): n is a, c, g, or t
  modified_base (334)..(334): a, c, t, g, unknown or other
  misc_feature (334)..(334): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgtcgggcgagtcagggcattagcgtatttttagcctggtttcagcagaaaccagggaacncccccaagtccctgatctatgctgctcatttagaggtgatccatcaagtcagcgcagtgatcgngggacagtagttcactctacaactatcagcagcctgcacgcctgaggtattttcgactaactttatactgaccagcaagtataagtcgtacttaccctatccgtaccgttcggggccggggtacaccgggtacgtaacgggtaaaccgtaaaccggtaaccgttcggtacggtccgtacggacccgtacctaacgttccgttacgttaccc

SEQ ID NO: 269165 - DNA, 612 bp, Homo sapiens
  misc_feature: GYAE6OF02GHUDA.26.55.E11.1.454.CMB.1.raw
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtccaccatcacttggccgggcaaggtgagggacaataaaactaaattacttaaattggtaatcaaggaagaaaccgagggagacgccccgtaaggtccctagatctagtggtgcatcctattttcgacgtaaaggtcgggtaccccaactaaatttcagtggcagtggatcgtagggacagtatttcactctcagtactaatttaataatctagactaacctgagttatttggactaactttactacttacgtacaaactagtacgttaccgaccggttacccccttagtttaccgtttacgggaccgtaacgggtaaccctaggacgttacggacgtactaacgaacggtaacggtaactcgggtacgtaccgtacgtaccgaccgtacttacgttcgtacctttactacccg

SEQ ID NO: 269166 - DNA, 559 bp, Homo sapiens
  misc_feature: GYAE6OF02HHEDT.26.55.E11.1.454.CMB.1.raw
  modified_base (414)..(414): a, c, t, g, unknown or other
  misc_feature (414)..(414): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttggccgggcaagtgagggcaataaacaaattcttaaattggtatcaggagaaacagggagagccctaaggtcctgatctatggtgcatcctattttgactaaaggttcggggtaccccaaccgtaaatttcgagttaggctaggtggatcgtgggaacagtatttcactctcagtctattaaatatctgacaacgtgagtatttnactaacttactatagtacaacagtacttacaccggtaccccttattaccgtttcggaccgtacgggaaccaagtacgtacggagactacaccgaaggtacgtggtacgtcgtacgccaccgtagttacctcgttactacttaccg

SEQ ID NO: 269167 - DNA, 672 bp, Homo sapiens
  misc_feature: GYAE6OF02IS2TV.26.55.E11.1.454.CMB.1.raw
tcagagactatactcacgaccggtgctcgatttagcactcgcacgttgggtttgggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccgagggagagcccctaaggtcctagatctagtggtgcatcctattttgactaaaggtcggggtacccactaaattcagtggcagtggatcgtgggacagtattcacttctacacgctaagtttaaataacttcgtagacctaaccgttggtaacggttaattttacggaccttaaacgtttaaccgtaacgtttcgtaacctaaacgtaacggtaacgtttaacgacccggttaaccccccttaagtttacccgtttttcgggacccgtaacggggggtaaccctaacggtaccgttagggaaggtacgtaccgtaaccggtaaacgggtaaccgttagggtacggtaccgttacggaccccgtaccgttaaccgttccgtttacgtttacccgtttacttaacccccgg

SEQ ID NO: 269168 - DNA, 567 bp, Homo sapiens
  misc_feature: GYAE6OF02G24EJ.26.55.E11.1.454.CMB.1.raw
  modified_base (274)..(274): a, c, t, g, unknown or other
  misc_feature (274)..(274): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgtcgggcgagtcagggcattagcgtatttttagccttggtttcagcaagaaaccgagggaaacncccccaagtccctgatctatgctgcgtccactttagaggtggacgtccatcaaggttcaggcggacaggtggatcgtgggacagtagttcacttctacaacatacacgcagcctgcagtcctaggacgtattttcgacttaaactttattacctgtaccagtactaagttataagttgtaactttaaccctattcccgtaccgttccggggaccgggacgacggtaccgtaacggaaaccttaaacggaccgttacggtggaccttcggacctaccgtacttcgtcgttaccc

SEQ ID NO: 269169 - DNA, 788 bp, Homo sapiens
  misc_feature: GYAE6OF02II9KB.26.55.E11.1.454.CMB.1.raw
  modified_base (194)..(194): a, c, t, g, unknown or other
  misc_feature (194)..(194): n is a, c, g, or t
tcagagactatactcacgaccggtgctcgatttagcactcgcacgttgggtttggggagtctcagtcaggacacagcatggacatgcgggtccccgctcagctctggggctcctgctgctctggctccgaggtgccagatgtgacatccagatcgaccagtctccatccctcctgtctgctatcgtagtagganacagacgtcaccagtcctaccgttcggacccggactaaggtcggacggtactaaactaaaacctaatttacgttaaagttggtaacgtacgaaggaacgaaacgagggagaccgtacccgtaagtccgtacgtattacgtagtggtcgtactacgtaccgttatttcgacgtaacgggtccgggtacccaacgttaacttcgtagtcggtacgtaggtcggtacgtcggtacggtacgtacgttacgtttaccgtacctcgtaacgtacgtaactttaaacttaaacgttaaacgtcctacgtaaccctacggttacgtaacggtttactttacggtaaacccttaacgtttaaccgtaaccgttaacgtaaccgtaaacgtaacccgttaaacggttacccgaacccgttaccccctttagtttaaccggtttacgggtacccggaacggggtaacctaacgggtaccgtttaacgggaccgttacgttacgaaccggttaacgggaccgtttcggggttaccgtaccgttaaccggtacccgtaaccgttacgttacccggtttaacccgtttaccgtttaccgtaaccccg

SEQ ID NO: 269170 - DNA, 675 bp, Homo sapiens
  misc_feature: GYAE6OF02HGGGU.26.55.E11.1.454.CMB.1.raw
  modified_base (192)..(192): a, c, t, g, unknown or other
  misc_feature (192)..(192): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtagganacagagtcaccatcacttggccggcaagtgaggacataaaacaattacttaaattggtatcgaaggaagaaaccgagggagagtaccccgtaaggtcctagatcgtagtggtagctatcctagttttgacgtaaggtccgggtaccctaacgtaaacgttcgaggtcggactaggtggtactcggtagggaactaagtacttttacaccgtctacgaacgtactaaagtttaaacttaactccgtaacgtacctaaaccgttaggtaacgggtttaacttttaccggacttaaccgtttaacttaccgtacgttaccaaacgtagtaaccgttaccgaccggtaaccccttagttaccgtttacggaccggtaacgggaaccgtaaggtccgtaggacacgtaactaacggtaacggtaaccgttcgggtaccggcttaccgacctaccgttacgtaccgttacgtttacgtccttaacccgg

SEQ ID NO: 269171 - DNA, 494 bp, Homo sapiens
  misc_feature: GYAE6OF02ITHMC.26.55.E11.1.454.CMB.1.raw
  modified_base (421)..(421): a, c, t, g, unknown or other
  misc_feature (421)..(421): n is a, c, g, or t
  modified_base (456)..(456): a, c, t, g, unknown or other
  misc_feature (456)..(456): n is a, c, g, or t
  modified_base (463)..(464): a, c, t, g, unknown or other
  misc_feature (463)..(464): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaaagtgagggcataaacaaattctaaattggtatcaggagaaaaccagggagagccctaaggtcctgatctatggtgcatccattttgcaaatggggtaccaccaaaatttcaagtggcagtggatctggacagatttcactctctagcattaaataaatctgcaacctgaggtattttagcaaacttactaactgtacaaacngagttacagcccctatactttggccagggacaagntagagannacaggaatgngntgcacanctntctntacg

SEQ ID NO: 269172 - DNA, 741 bp, Homo sapiens
  misc_feature: GYAE6OF02JFNAW.26.55.E11.1.454.CMB.1.raw
tcagagactatactcacgaccggtgctcgatttagcactcgcacgttgggtttggggagtctcagtcaggacacagcatggacatgcgggtcccgctcagctcctggggctcctgctgctctggctcgaggtgccagatgtcgacatccagatcgacccagtctccatcctcctgtctgctatctggtacggacgacagtacgtccacactctacgttcgggaccggtacaaggtggacgggactaaagttaaaacctaagtttaccgtttaaaattcggtaactacggaaggaaacgtaaaccgacgggaacgaaccgtaccccggtaaggttacccgtaggtaacttcctaggtcggtcggtactacgtaccgttagtttcgacgttaaacgggtccgggttaccccaacgtaaactttcgacggtcgtactaggttcggtaacgtcgtacggactaagtccgttacgaaccttcgtacgaactacgtaactttaacgtacttcgtacgtaaccgtaccgttaggtaacgttgtttaacgacgttaacttaacgtacttcggaactaaacgtacggtaacgttaccacccgggttaacccttacgttaccgtttacgggacccgttaacggggaccttaacggccgtaaggtacgtacgtaccgtaacgtaaggtaccgtacggtacggttacgtacgttaccgtacttaccgtccgtttcgttaccgttccttacccg

SEQ ID NO: 269173 - DNA, 848 bp, Homo sapiens
  misc_feature: GYAE6OF02GWCB3.26.55.E11.1.454.CMB.1.raw
tcagagactatactcacgaccggtgctcgatttagcactcgcacgttgggtttggggagtctcagtcaggacacagcatggacatgcgggtccccgctcagctcctggggctcctgctgctctggctccgaggtgccagatgtgacatccagatcgacccagtcctccatccctcctgtctgctatcgtgtaggagacgagacgtaccacctatcctacgttcgggaccggactaaggtcggaacgggtactaaaacgtaaaaccgtaaattttaccgtttaaaaggtttggttaacctaacggtaacggaaacggtaaaaccggaggggaaccgtaaccggtacccccggttaaacgggtccctaggtaacttacgtacgttcgggtagactacttaccgtagttttacgaacggtaaacgggttccggtaacccctaacgttaacgttcgaaggttcggaacctaggggtacggtacgttacggtacggggaactacgggttactttacaccgttacgtacgtaacgttacttaaagttaacgttaccgttccgtacgtaaacccgttaaccgggttagttaaacgggttttactttacgttaacccgttaacgtttaaccctacggtttacgtaaaccgtaacgtaacggtaccgtttacccgtaaccccgggtttacccctttaggtttaccgttaccgggaccgggttaaccgggaaaccgtcggtaagtacggtaacgttactaacccggtaacggaacggtacggtttccgggacgtaccgtaccggttaaccctacgttaccttttacggtcccggttttaccctaccggtttacccccg

SEQ ID NO: 269174 - DNA, 592 bp, Homo sapiens
  misc_feature: GYAE6OF01DHOWI.29.28.C06.1.454.CMB.1.raw
  modified_base (308)..(308): a, c, t, g, unknown or other
  misc_feature (308)..(308): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactggaaccagcagtgacgttggtggttatgactatgtctctggtatcaacaaccacccggacaaacgtaccccaaactcctgtatttangacgtcgctacgcgaccctcgacgggtccctgatcgtcttttctggctccaagtctggcaacacggcctccctgaccgtctcgtgggctccgaggctgacgatgagctgtactattactgtctgctctatttgcgacggccacccgctacgttgtcgtacgttccgttcgggacgggtacgggaaccgaacggtccgtacggtaccccggttacccgttacgggtccacggtccgtaccggtaaacgggtccttacccggtccccccgttccgggtcctacccg

SEQ ID NO: 269175 - DNA, 583 bp, Homo sapiens
  misc_feature: GYAE6OF01A00Q8.29.28.C06.1.454.CMB.1.raw
  modified_base (354)..(354): a, c, t, g, unknown or other
  misc_feature (354)..(354): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactggaaccagcagtgacgttggtggttatgactatgtctcctggtatcaacaaccacccggacaaaacgtccccaaactcctgtatttatgacgtcgctacgccgaccctcgagggtccctgactcgtcttttcnggtctccaagtctggcaacacggccctccctcgacccgtctcgtgggcctccgaggctgacgagtggagctgactattactgcctcctcatatgacgagaccaaactaacttagtttagtacgttttcgggacgggtacgggaaccaacgcgttacgacccggttcctacgagtccgagtacctacgtaacggtcctcccggtacccccgtccggtcctaccgttcccg

SEQ ID NO: 269176 - DNA, 550 bp, Homo sapiens
  misc_feature: GYAE6OF01B5LF5.29.28.C06.1.454.CMB.1.raw
  modified_base (228)..(228): a, c, t, g, unknown or other
  misc_feature (228)..(228): n is a, c, g, or t
  modified_base (361)..(361): a, c, t, g, unknown or other
  misc_feature (361)..(361): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactggaaccngcagcgatgtcggtgttataactttgtctcctggtaccaacaacacccaggcgacggccccccgactcataatttatgatgtcattaagcggccctcgaggggtccctgactcgcttctctggctccaagtcngcaacactgccctccctgacctatctctcggctccaggctgacgatgacggtgatttattactgctgcttctatttgcgacggcccacccgctacgtgtgtacttcggttcgggcggacgggaccaagtccgtggacccggttcgtaggtacacggtcctacgaacggcccgtccgcccccgttaccgg

SEQ ID NO: 269177 - DNA, 504 bp, Homo sapiens
  misc_feature: GYAE6OF01CQ6TS.29.28.C06.1.454.CMB.1.raw
  modified_base (490)..(490): a, c, t, g, unknown or other
  misc_feature (490)..(490): n is a, c, g, or t
tcagatagagtactcacgaccggtgctcgatttagagctcacgtattgggtttggggggtcgtcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcgccatctcctgcactggaaccagcagtgatgttgagattatgactgtctcccttggtaccaacaacacccagacacagtccacaaacacatgatatacaatgtcaatactcggccctcaggggtccctgatcgtttctctggctccaagtctggcaatgcggcctccatgaccatctctggactccaggctgaggacgaggctgattattagtgctgctcatatataagcagtgtcacttaaggggtgttcggcggagggacccaaggcctgaccgtcctgggtnacgcccaagggtcc

SEQ ID NO: 269178 - DNA, 664 bp, Homo sapiens
  misc_feature: GYAE6OF01DXE2H.29.28.C06.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactggaaccngcagtgacgttggtgttangactatgtctctgtatcaacaacacccggacaaacgtccccaaactcctgatttatgacgtcgctacgcgaccctcgacggggtccctgactcgtcttttcgtggctcaagtctggacaacgaccggcctcccgtcgtaccgtctcgtcgggcctcgacggccgtggacgagtaggacggtcgtacgtaacttactttacgtcgtccctcctctattactcgacaacggaccaaacctaaactttaacgttttagttacggttttaccggggacggggtaaccggggtaaaccgtaaacggtccgttaccggtaaccccgttacccgtaccgtacggttaccgacggtcccgtaacgtaaaccgggtcccgttaccccggtccccccggttaccgggttcccgtcccgtttaccccg

SEQ ID NO: 269179 - DNA, 694 bp, Homo sapiens
  misc_feature: GYAE6OF01BZ4CQ.29.28.C06.1.454.CMB.1.raw
  modified_base (255)..(255): a, c, t, g, unknown or other
  misc_feature (255)..(255): n is a, c, g, or t
  modified_base (311)..(311): a, c, t, g, unknown or other
  misc_feature (311)..(311): n is a, c, g, or t
tcagatagagtactcacgaccggtgctcgatttagagctcacgtattggggtttggggggggtctcaggaggcagcgctctcaggacgtcaccaccatggcctgggctctgctcctcctcaccctcctcactcagggcacagggtcctgggctcagtctgccctgactcagcctccctccgtgtccgggtctccgtggacagtcagtcaccgtctcctgcagtggaaccagcagtgacgttggtggttatgactntgtctcctgtactcaacaaccacccggacaaacgtccccaaactcctagtatttangacgtcgctacgccgacctcgacgggtccctgtactcgtcttttcgcggtctaccgaagtcgtcggacaaccgaccggtccctcccgtcgtacccgtctccgtcggtcctccgacggtctacggaacgtacgtggagtcgttacgtaacttattaccgtcgtccgttccttactaacgttacgtcgaccgtaacggtacctaaacgttaacgtttagttttacggttaaggttttaccggggacgggtaacgggtaaccgtaacggtaccgttaccggtacccggttaccgtacgtaacggtacgtaccggtaccgttaaccggaaccgggttcccgttaccccgggtacccccgttacgggttccctacccggtttccccgg

SEQ ID NO: 269180 - DNA, 612 bp, Homo sapiens
  misc_feature: GYAE6OF01DCF7J.29.28.C06.1.454.CMB.1.raw
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
  modified_base (315)..(315): a, c, t, g, unknown or other
  misc_feature (315)..(315): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (476)..(476): a, c, t, g, unknown or other
  misc_feature (476)..(476): n is a, c, g, or t
tcagatagagtactcacgaccggtgctcgatttagagctcacgtattggggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatcctccgtgccactggaacccngcagtggacgtttggtggttaangactatgtctctggtatcaacaaccacccggacaaacgtccccaaactcctgtatttangacgtcgctacgccacctcgacgggttcccngactcgtcttttcnggtcctacaagtctggcaacgcgccctccctgacgtctcgtgggcctcgagctgacganggngctgtaactattactgtacctcctntatacngacaggacctaaactaacgtttnttttaggtacggttttccgggacgggtacgggaacctaaacggtccgtacggtcccgttacccgtacgtacgtacctacgacccgttagaacggttccctacccggtcccccgttacggtccctaaccgttccccg

SEQ ID NO: 269181 - DNA, 701 bp, Homo sapiens
  misc_feature: GYAE6OF01EJGLI.29.28.C06.1.454.CMB.1.raw
tcagatagagtactcacgaccggtgctcgatttagagctcacgtattgggtttgggggggggtctcaggaggcagcgctctcaggacgtcaccaccatggcctgggctctgctcctcctcaccctcctcactcagggcacagggtcctgggcccagtctgtcctgactcagcctccctccgcgaccgggtctccgtggacagtcagtcaccatctcctgcactaggaaccagcagtgacgttggtgttatgatatgtctcctggtatcaacaaccacccggacaaacgtcccccaaactccctagtactttatcgtacgtcgacgtacgaccgacccgtcgtacgggtccctagtactcgtcttttcgcggtctaccgaaggtcgtcggactaacccgaccggtccctccctacggacccgttcctcgtcgggcctaccgacggtcgtacgaacgatagggtcgtacgtacggtaacttaacgtttacctcgtacccttacctacgtacttacgtacgccgaacggtaccaaacttaacgtttaagtttttacgttacggttttaccggggacgggtaaacgggtacctaacggtccgttaccggtaccccgttaccctacggtaacggttacccgacgtaccgtaccgtaaccggtccccgtacccgtcccccggttaccggtccctccgtttacccccg

SEQ ID NO: 269182 - DNA, 603 bp, Homo sapiens
  misc_feature: GYAE6OF01BHJ9A.29.28.C06.1.454.CMB.1.raw
  modified_base (227)..(227): a, c, t, g, unknown or other
  misc_feature (227)..(227): n is a, c, g, or t
tcagatagagtactcacgaccggtgctcgatttagagctcacgtattgggtttgggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactggaaccngcagtgacgttggtggttatgactatgtctcctggtatcaacaacacccggaaaagtccccaaactcctgatttatgacgtcgctacgcgaccctcgacggggtccctgactcgtcttttcgtcggtcctaccgaagttccgtggaccaaccgaccggtcccttcccgtcgtacccgttcctcgtcgggcctcccgaggctgacgagtcggagggctcgacttaacttactcgtccttcctcatatcgcacgacaactaaccttattttgtagttttcgggacgggtaacgggaccaaggtccttggacccgttcctcgacgtacacgtctacgaacgccgtccgtcccccgtacggtcctccgttccgttccccg

SEQ ID NO: 269183 - DNA, 638 bp, Homo sapiens
  misc_feature: GYAE6OF01A6F3V.29.28.C06.1.454.CMB.1.raw
  modified_base (354)..(354): a, c, t, g, unknown or other
  misc_feature (354)..(354): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcacgtggaaccagcagtgacgttggtgttatgactatgtctctggtatcaacaaccacccgacaaacgtaccccaaactcctagtatttatgacgtcgcgtacgccgacccgtcgacgggtccctgatcgtctttcncgctcagtcgtgcaacgacgtcctccctcgtacccgtcgtcctgggcctccgaggtcgtgacgacgtggacgtcgtacgtaacttaacttacctcgtcccttccgtactaatacgttcgccgtacggaccaaaccgttaattacgtttttaggtaacgttttcgggacgggaacgggtaaccctaaggtacgtaccggtaccccgttacctccgtagtaccgtacgacctaacggaccggtaccgtccccggttaccccgtccggttacctcccgttaccccgg

SEQ ID NO: 269184 - DNA, 718 bp, Homo sapiens
  misc_feature: GYAE6OF01ETM63.29.28.C06.1.454.CMB.1.raw
  modified_base (246)..(246): a, c, t, g, unknown or other
  misc_feature (246)..(246): n is a, c, g, or t
  modified_base (579)..(579): a, c, t, g, unknown or other
  misc_feature (579)..(579): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcaggcacgagggtcctgggcccagtctgtcctgactcacgcctccctcgcgaccggtctcctggacagtcagtcacatctctgcactggaaccagcagtcgtacgttggtgttangacttatgtctcctaggtactacaacaaccgacccggactaaaccgtcccctaaaactccttagtactttacgtcggtaccgttaccggcctaccggaccgtaccccgttacggtaccgggggttacccctaggtaccgttccgtaccgtttttccgtacgggtacccttaccgtaacggttcgtacggtaccgaaaccgtacccgggtcccgttaccccgttacggaccccgtttcgtccgttacggggtccttacccgacggtccgttacgaacggtatacgggtaggtacctacggtaacttacgttactcggtcctaccgtacattacncgacgagaacctaaacgtacttagtttcgttagtttacggggacggtacgtaaccgtagcctcggtaccttaccgctacgtacgcgtaccgtacgaaccgtccgtacccgtaccccttcgggtaccctaccgttcccgg

SEQ ID NO: 269185 - DNA, 691 bp, Homo sapiens
  misc_feature: GYAE6OF01B6EDB.29.28.C06.1.454.CMB.1.raw
  modified_base (201)..(201): a, c, t, g, unknown or other
  misc_feature (201)..(201): n is a, c, g, or t
  modified_base (257)..(257): a, c, t, g, unknown or other
  misc_feature (257)..(257): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggttcctgggcccagtctgtcctgactcagccctccctcgcgaccgggtctccgtggacngtcagtcaccatccgtctgcactcggaaccagctagtgacggtttggtaggttacnggactagttcgtacttcctggtactactaaacaaccgacccggaacaaaccgtaccccaaacttcctagtaactttagtcgaccgtccgaccttacggcccgacccgtcgtacggggtccctaggtacttcgtcttttcgnggtcctaccgagttccgngaccacgccgcctcccgtacgtacccgttctccggtaggcccgttaccgaggtccgtacggaacgtacgtacgggacggtactacggtaactttaacgttactccgtacttcctacctattacgcgaacgacgaacctaacaacgtttagtttacggttacgtttaccgggaacggtaccgtactaacggtccgtacgtaacccgttctccgttacgacgtccgttaccgacgaccggtcccgtccgacccccgtccgtccgtaccgttccccgg

SEQ ID NO: 269186 - DNA, 735 bp, Homo sapiens
  misc_feature: GYAE6OF01AQ99P.29.28.C06.1.454.CMB.1.raw
  modified_base (237)..(237): a, c, t, g, unknown or other
  misc_feature (237)..(237): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacgagggtcctgggcccagtctggtcctgacctcacgccctcccgtccgccgaccgggtctccgtggacagtcagtcaccatcctcctgcactggaaccngctagtgtacgttggtagttatgacttatcgtactccgtggtactccaacaaccgacccggacaaaccgtcccccaaactccgtacgtaacgtttactcgacgtacgaccgtaccgccgaccccgtcgtacggggtccctggtaccttcggttacttttccgcggtaccttaccgtaagtccgtcgggaccaaaccgtaccggcccttcccgtacgtacccgtcgtcgtcggcctccgacgtcgtacgtacgtacgtacggtacgtcgtacggtaacttagttaccgttcggtacccttacctacgtaactttaacgcggtaccgaacggtacctaaacgtaacgtttaacttttaggtaaccgttttaccgggacgggtaaccggaaccgtaacggtaccgtaccggttacccgttaccgtaccggtaacgttcgaaccgttccgtaacgaccggttccgtaccccggtcccggttaccgtccgtacccgttccccg

SEQ ID NO: 269187 - DNA, 901 bp, Homo sapiens
  misc_feature: GYAE6OF01E6BXY.29.28.C06.1.454.CMB.1.raw
tcagatagagtactcacgaccggtgctcgatttagagctcacgtattggggtttgggggggggtctcaggaggcagcgctctcaggacgtcacccaccatggcctgggctctgctcctcctcaccctcctcactcagggcacagggtcctggccctagtctgtccgtgactcacgccctccctccgcgaccgggtcctccgtaggacacgtcacgtccacctactcctcctgaccacgtacggaaccaggtaccgagttacggtacggtttggttcgggttaatgtacttacgtccgtccgttacgtacgtaactaaccgaaacccgaaacccgaacccggtaacctaaaccccgtacccctaaaccgttaccgtaacgttaacgtttacgtaccgtaccggtaccgaaccgtacccggtacccgtacccgtacgggttacccgggtacctacggttaccgttccgtttccgtttaccggtaccgtaccgtaaccggtacggtaccgtaccggaacccgtaacccggtcccggtaccccgttcccggttaacccggtacccggttccggtacccggtccggttacccggtacgtaaccggtaccggtaacggaacggtaacggtacgggtaacgggttacgtaaccgttaactttaaccgttacccgtacgtacccgttacgtaacgttaacgttaacggtaccgtaacgtaaacgtaaaccgttaaacctttaacggtttacggtttaacggttaaccgggttaacgggaaccgggtaaccgggtaaccgtacggttaccggacccgtaaaccgtccgtaccggtacgttacggaacctaccgtaacccggtccggtacccgttaccccggtacccgttacccgtccgttaccccgtccg

SEQ ID NO: 269188 - DNA, 722 bp, Homo sapiens
  misc_feature: GYAE6OF01BZJ1J.29.28.C06.1.454.CMB.1.raw
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
tcagatagagtactcacgaccggtgctcgatttagagctcacgtattgggtttggggggggtctcaggaggcagcgctctcaggacgtcaccaccatggcctggctctgctcctcctcaccctcctcactcaggcacagggtcctggcccagtctgtcctgactcacgccctcccgtccgccgaccgggttctccgtggacagtcagtccaccatcctcctcgcacgtcggaaccngcagtgacgttgggtgttangtacttatgttctccgtaggtactacaaaccaacccacccggaacctaaaccgtaccccaaaccttacctagttaacgtttagtcgtaccggtccgtacgtaccgccgaccccgtaccggtaaccggggttccctaggtacgttccgtttctttttccgcggtccctaccgtaaacgttccgtacggaaccgtaacccgacccggtcccgtcccttccgacccgttcctcggttacggtccttccgacggtctcggaaccgtagtggaggtcgttaagtactttaacttaccgtcgtccttcgtactagtgtacgaccgtacggtaacctaactaaccgtttaagttttcggttaacgttttccggggaacgggaccggtaaccgtagtacctccggtaaccgttccacgtcgtacgtacgcgtacgaccgtccgtaccccggtcccgttcggcccttcgtacccg

SEQ ID NO: 269189 - DNA, 625 bp, Homo sapiens
  misc_feature: GYAE6OF01EHO8A.29.28.C06.1.454.CMB.1.raw
  modified_base (198)..(198): a, c, t, g, unknown or other
  misc_feature (198)..(198): n is a, c, g, or t
  modified_base (306)..(306): a, c, t, g, unknown or other
  misc_feature (306)..(306): n is a, c, g, or t
  modified_base (379)..(379): a, c, t, g, unknown or other
  misc_feature (379)..(379): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctcgcgaccgggtctcctggacngtcagtcaccatcctcctgctactcggaaccagcagcgtatgtacggtggttaatactttgtctcgtgtaccaacacaccgaggcgacggcccccgatcacttattangatgtcattaagcgtcctcgacgggtccctgactctcttctcgtcggtctaccgtaacgtctcggactaaacncgtcgtccctccctcgaaccctcttccgtcgtcgggtcctccggacggtccgtacggacgtacgtacggtacggtaggtactttacttacgttcgtcgtcgtctacgttacgtttcgcgtacggtccacccgtctacgtgtcgacttcggtcggacggaacggaccgtacggccgttacggacccgttcggtaacggttacgacggtaccgtacggtaacggtcccgtcccggtccccgttcccgg

SEQ ID NO: 269190 - DNA, 714 bp, Homo sapiens
  misc_feature: GYAE6OF01BYXPI.29.28.C06.1.454.CMB.1.raw
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
tcagatagagtactcacgaccggtgctcgatttagagctcacgtattggggtttggggggggtctcaggaggcagcgctctcaggacgtcaccaccatggcctgggctctgctcctcctcaccctcctcactcagggcacagggtcctgggcccagtctgtcctgactcagccctccctccgcgaccgggtctccgtggacagtcagtcaccatctccngcacgtggaaccngcagtgacgttggtgttangactatgtctctggtatacaacaaccacccggactaaaccgtccccaaacttcctagtatttacgtcgtacgtcgaccgtacgaccgtacccgtacggacgggttccctagtacgttaccgttcgtttttccgacggtcctaccgtaacgttcgtacggaaccgtaaccgacccgggtccccttacccgtaccgtacccgttctccggtcgggcctccggacggtctcggacgtacgtcgggtacgacgttacgtaactttacgttactcgtacccttccgtactaattcgtggtaccgaacggtaccaaacttaacgtttacgttttacgttaccggtttaccgggaccgggtaacgtaacccgtaggtaccgtaccgtaccccgttctacgttcgacggtcgaccgttaacggaccgttccctacccggtacccccgttcgtcccgttccgttacccccgg

SEQ ID NO: 269191 - DNA, 606 bp, Homo sapiens
  misc_feature: GYAE6OF02HNGUQ.29.28.C06.1.454.CMB.1.raw
  modified_base (247)..(247): a, c, t, g, unknown or other
  misc_feature (247)..(247): n is a, c, g, or t
  modified_base (361)..(361): a, c, t, g, unknown or other
  misc_feature (361)..(361): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactggaaccagcagtgacgttggtgttangactatgtctcctggtatcaacaaccaccccggcaaaacgtcccccaaaactcctagtactttatcgacgtcgctacgccgaccctcgacggggtccctgactcgtcttttcgnggctccaagtctgcaacacggcctcctgaccgtctctcgggctccgaggtctgacgatggaggctgacttattactgccttcctctatatgacaggacctaaacaactagttttacgtacgttttcgggacggtacgggtaacctaacgtcgttacggtacccgttaccgttacgacgttaccgtaacgtccgtacgaaccgggtccgttacccggtcccccgttcggtaccctaccgttcccgg

SEQ ID NO: 269192 - DNA, 552 bp, Homo sapiens
  misc_feature: GYAE6OF02H6LZU.29.28.C06.1.454.CMB.1.raw
  modified_base (419)..(419): a, c, t, g, unknown or other
  misc_feature (419)..(419): n is a, c, g, or t
  modified_base (438)..(438): a, c, t, g, unknown or other
  misc_feature (438)..(438): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgccctgactcagcctcgctcagtgtccgggtctcctggacagtcagtcaccatctcctgcactggaaccagcagcgatgtcggtgttatactttgtctctggtaccaacaacaccaggcgacggccccccgactcaattaatttatgatgtacattaacgccggccctcgacgggtcctgactcgcttctctggctaccagtctggacaacactcgccctccctgacctatctcgtggcctccgagctgacgatgacggtntatttattactgtctgctntattcgcgagccacccgcacgtgtgtacttcgttcgggcggtaacgggaaccgtaacggccgtacggtacccgttccgttaacggtccacggtacctacgacggtcctccccgg

SEQ ID NO: 269193 - DNA, 571 bp, Homo sapiens
  misc_feature: GYAE6OF02F9UVE.29.28.C06.1.454.CMB.1.raw
  modified_base (250)..(250): a, c, t, g, unknown or other
  misc_feature (250)..(250): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
tcagatagagtactcacgaccggtgctcgatttagagctcacgtattggggtttgggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactggaaccagcagtgacgttggtggttangactatgtctcctggtatcaacacaccccgacaaacgtccccaaactcctgatttatcgacgtcgctacgcgaccctcgacggggtccctgactcgtcttttcncggtctcaagtctggcaacncgcctcctgaccgtctcgtcgggctccgacgctgacgtatggaggtctagacttattactgtcctctactatatcgacgacggacaactaacgttattttgtacgtttcgggacggtacggaaccgaacgtcgtcgtaccgtctcgtagtcgacgtcctacgaacgtcgtacccgtccccgtcgtccctacttcccg

SEQ ID NO: 269194 - DNA, 703 bp, Homo sapiens
  misc_feature: GYAE6OF02F3JQ7.29.28.C06.1.454.CMB.1.raw
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctcctccgcgaccgggtctcctggacagtcagtcaccatctcctgcactggaaccagcagtgacgttggnggttangactatgtctcctgtactacaacaccgacccgacaaacgtaccccaaactcctagtatttagtcgtacgtcgactaccgccgtacctcgacggggttccctagtacttccgttcttttcgacggtctaccgtaacgtctacggacaacgaccggtccctccgtcgacccgttcgtcgtcgggcctaccgaggtcgtacgacgagtggacggtcgtagtaacttacgttacgtcgtccttccttacgtaattcgtacggtacacggaacctaaaccgtaacgtttaacgtttttacggttacggttttaccgggaacgggtaaacccgggtaaccgtaacggtaccgttacggaacccggttacccgtaacgtaacggttcctaaaccgggttctaaccggaacggttcccgtaccccggttacccccggttcggttaccctacccgtttaccccgg

SEQ ID NO: 269195 - DNA, 600 bp, Homo sapiens
  misc_feature: GYAE6OF02IK021.29.28.C06.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (415)..(415): a, c, t, g, unknown or other
  misc_feature (415)..(415): n is a, c, g, or t
  modified_base (444)..(444): a, c, t, g, unknown or other
  misc_feature (444)..(444): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactgaaccngcagtgacgttggnggttangactatgtctctgtatcaacaaccaccccgcaaacgtaccccaaactcctagtatttatgacgtcgctacgcgacccgtcacgggtccctgactcgtcttttctggctccaagtctcggacaacgacggcctcccgtcgaccgtctcgtcgggctccgaggctgacgngtggagtctgaacttattctcgtcttccntaactatcgacgaggaccaactaacttattttacgtacgttttccgggacggaacggtaacaagtccgtacgtaccggttacccgtcgtacgtacctacgtccgtacggtaacggtccctacccggtcccccgttacggttccctaccgttccccg

SEQ ID NO: 269196 - DNA, 569 bp, Homo sapiens
  misc_feature: GYAE6OF02H0TXE.29.28.C06.1.454.CMB.1.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccgtctcctgcagtggaaccngcagtgacgttggtncttataaccgtgtcctcctggtaccagccacgcccccaggcacacgcccccaaactcatgtattttcgacgtcagtaatcggccctcgagggtccctgactcgcttctctcgggtcctaagtcgtggctagcaccggcctcctgattactctcgtcggctcagacgtgacggacgaggctagaattattaattgcacgtctacatactagaaggacaactacttagtctcttacggaactacgggtacctaagtctaccgtcgtacggtaccacgtacccgaacggacccaacccgtacgtctacgtaccttcgttccgttacccc

SEQ ID NO: 269197 - DNA, 676 bp, Homo sapiens
  misc_feature: GYAE6OF02JS7YY.29.28.C06.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
  modified_base (455)..(455): a, c, t, g, unknown or other
  misc_feature (455)..(455): n is a, c, g, or t
tcagatagagtactcacgaccggtgctcgatttagagctcacgtattgggtttgggggggtctcaggaggcagcgctctcaggacgtcaccaccatggcctgggctctgctcctcctcaccctcctcactcaggcacagggtcctgggcccagtctgtcctgactcagcctccctcgcgaccgggtctcctggacagtcagtccaccatctcctgccactggaaccngcagtgacgttggtgttangacttntcgtctctggtatcaacaaccaccccgganaaacgtccccaaactcctagatttacngaaccgttcacctaccgcctacccgttcgaacggggttcccctaaggtctccgttccttttcgcggtcctaccaaggttctcggacaaccgaccggtcctaccctgacccgtcttacgcgggtaccttccgagtctacgtacgtancggaacgtcgtaggtacttacgttacgtcgttccttacctctaagtaacttcgacgaaccggttaacaaccgtaactttacgtttacggttacgttttaccgggacggacggtaaacctacggtccgtacgttacccggtacgtttaccgaacgttacggctaacccgtcggtaacgcccctaccggttcccccgtacggtttacccctacccgtttcccg

SEQ ID NO: 269198 - DNA, 750 bp, Homo sapiens
  misc_feature: GYAE6OF02H7ZXV.29.28.C06.1.454.CMB.1.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctctcactcagggcacagggtcctgggcccagtctgtcctgctcagcctccctcgcgaccggtctcctggacagtcagtcaccatctctgcactggaaccngcagtgacgttgtggttangactatgtctcgtgtatcaacacacccganaacgtccccaaatcctagtactttaagtcgtaccgtcgacgttaccgaccgacccgtcgacggggtccctagtactccgttcgttttaccgtggtacctaccgtaatcgtacggacaaccgaccggtcctccccgtataccggttcctcggtcgggtccctaccgtagggtaccgtacggtaacgtagtacggacggtacgtacgtaacgtttaacgtttacgtacggtccctttacctaccgtaagttacgtcggaccgtaacggaacctaaaaccgtaacgtttaacgtttttaggttaaccggtttttaccggggaaccggggtaaacggtaaaccgtaacgtaccggttaccgttacccggttacccgtcgttaaccggttaccgtaaccggttacctaaccggtacggttaccccgttaccccgggttacccccccggtttaacggttacccccgttaccgtttaacccccgg

SEQ ID NO: 269199 - DNA, 607 bp, Homo sapiens
  misc_feature: GYAE6OF02G8KLJ.29.28.C06.1.454.CMB.1.raw
  modified_base (351)..(351): a, c, t, g, unknown or other
  misc_feature (351)..(351): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactggaaccagcagtgacgttggtggttatgactatgtctcctggtatcaacaacaccccggcaaagtccccaaactcctgtatttatgacgtcgctacgcgaccctcacggggtccctgatcgtcttttcgnggtctccaagtctggcaacgacggccctccctcgaccgtcttcgtcgggcctcccgaggctggacgtagtcggacggtctagtacttaagttaccgtgtccttcctctattactgcgtacgacctaaacaacttagttttgtacgttttccgggcgggtaacggaaccgaagtccgtcgtacccggtccgtcgtacgttaccgacgtccgtacgtaacggtcctcccgtaccccccgtcggtccctacgttccccg

SEQ ID NO: 269200 - DNA, 691 bp, Homo sapiens
  misc_feature: GYAE6OF02HWAP5.29.28.C06.1.454.CMB.1.raw
  modified_base (232)..(232): a, c, t, g, unknown or other
  misc_feature (232)..(232): n is a, c, g, or t
  modified_base (276)..(276): a, c, t, g, unknown or other
  misc_feature (276)..(276): n is a, c, g, or t
  modified_base (310)..(310): a, c, t, g, unknown or other
  misc_feature (310)..(310): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcgagggcacgagggtcctcgggcccagtctgtcctgactcacgcctccctccgcgaccgggtctccgtggacagtcagtcactatctctgcacgtgaaccngcagcgatggtcggtgttacttattgtctctgtaaccaacaccnccgaggcgaccggcccccgatacaattaacttangtactgtacaagttacgtccggcctacggtacgggttccctgtacgtccgtcttcgtaccgtcggtacctaccagttcgtcggaaccaactcgtcctccctacccgtcgacctacgtcccgttacggtcgggtccctccggtacggttaccgtaacggtacgtaacggtcgggttaaccggtatttaaacgtttacgttacccgtggtacccttggtaccttagttacgttcgccccgtaaggcccccgtaaccgtcgaccgttagtacgtctcggggttccgggaacggaccggtaccgtaacggtccgtaccggttaccgtcggttaacgtccgagttaccggaccggaccgtcccgttaccccggtacccgttcccgg

SEQ ID NO: 269201 - DNA, 715 bp, Homo sapiens
  misc_feature: GYAE6OF02JXMQJ.29.28.C06.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
  modified_base (462)..(462): a, c, t, g, unknown or other
  misc_feature (462)..(462): n is a, c, g, or t
  modified_base (667)..(667): a, c, t, g, unknown or other
  misc_feature (667)..(667): n is a, c, g, or t
  modified_base (706)..(706): a, c, t, g, unknown or other
  misc_feature (706)..(706): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcgagggcacgagggtcctcgggcccagtctgtcctagactcgagccctccctccgccggaccgggtcctcctggacngtcagtccacatcctccngcacgtcggaaccagctaggtgacggtttgggcgttaanggacttatcgttctcgtggtactacaaccaaccgaccccgacaaccgtaccccaactcctagtactttacgacgtacgtaccgaccgtaccgccgtaaccctaccggtaccggggtccctaacgtccgttaccgttccgtttacgtcggtccctacccgtaagttaccgtcgaacccgtaacggaccggttaccccncccgttaccggccccgttccgttccggtccgggtccctaaccgggcgtccgtaacggtaacgtacggtcggacggttccaacgttacgttacttaccgttcgccgttactcgttatcgtacgtacggacgtaaccaacgtaacttagtttcgtacggtttcggacgggtaacgaccgagtaccgtacgtcccgtatccggtacgngtacccgtactacgacggtctcccggaccctcggttacnccgttcccg

SEQ ID NO: 269202 - DNA, 674 bp, Homo sapiens
  misc_feature: GYAE6OF02GA1UW.29.28.C06.1.454.CMB.1.raw
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactggaaccagcagtgacgttggtggttatgactatgtctcctggtatcaacaacaccccggacaaacgtccccaaactcctagtatttactcgacgtcgacctacgccgaccctcgacggggtccctgactcgtcttttcgtggcctaccaagtctggacaacgccggtcctcccgtcgtacccgtctcgtcgggtcctccgacggtccgtgacgtagtacggacgtcgtacgtacttaacttaccgtcgtcctccttactaacttacgtcgtacgaacggacctaaaacgtaacctttacgtttttacgttacgtttttaccgggaccgggtaaacggtaaccgtaacgtaccgttacgtacccgttccgtaaccgtacgttaccgacggttacctaacggtaaccggtcccgttacccggtcccccgttccggttaccctacccgttccccgg

SEQ ID NO: 269203 - DNA, 876 bp, Homo sapiens
  misc_feature: GYAE6OF02HFAFI.29.28.C06.1.454.CMB.1.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
tcagatagagtactcacgaccggtgctcgatttagagctcacgtattgggtttgggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatcctcctgcactcggaaccagcagtgacggttggtggttangactatntctcctggtatcaaacaaccgaccccggacaaacgtaccccaaaactcccgtagtaactttaatcggtaaccgtccgccttaaccggaccgtaaccccgtcgaacggggttcccctaggtaaccttccggttacctttttccgtcgggtaccctttacccgaaaaggtttcgtacggaccgtaaaaccgtacccgggtacccccttaccccgttaccggtaccccggttacccttaccgggttcgggtacccttacccggtacgggtcccttacgggaaaccggttaaggtacgggtaacgggtccgttacggtaacctttaaacgtttaccttacggtaccctttacccgttaacgtaactttacgttaccggaaccgtaaccggtaacctaaaacctaaacgtttttaaccgttttttaacggttaaccgggttttttaccgggggaaccgggtaaacggggtaaacccttaaacgggccgttacccggtaacccgtttcccgttaaccggtaaaccgttaccgtaaccggtacccgttaaaccgggaaccggtccccgtttaaccccgggtccccccggtttaacgggttaccccttaacccgtttacccccgg

SEQ ID NO: 269204 - DNA, 603 bp, Homo sapiens
  misc_feature: GYAE6OF02JDWRX.29.28.C06.1.454.CMB.1.raw
  modified_base (198)..(198): a, c, t, g, unknown or other
  misc_feature (198)..(198): n is a, c, g, or t
  modified_base (249)..(249): a, c, t, g, unknown or other
  misc_feature (249)..(249): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccggtctcctggacngtcagtcaccatctcctgcacgtggaaccagcaggtgacgttggtggttangactatgtctcctgtactacaacaaccgacccggacaaacgtaccccaaactctagtatttactgacgtcgcgtacgccgacctcgtacgggtcctgtactcgttctttcgcgctaccaagttcgtgaccaacgaccggtcctccgtacgtaccgtcgtcgtcgggtcctcgacggtctacgacgacgtcggacggtctacgtacttacttacgtcgttcctaccttacactgtcgacgacgtaacaactacttatttacggtacgtttcgggacggaacgtacgagtccgtacgtaccgtcgtcgtacgtctacgtctacgacgtccgtccgtcccgtcgtcctacgttcccg

SEQ ID NO: 269205 - DNA, 554 bp, Homo sapiens
  misc_feature: GYAE6OF02JD5JP.29.28.C06.1.454.CMB.1.raw
  modified_base (248)..(248): a, c, t, g, unknown or other
  misc_feature (248)..(248): n is a, c, g, or t
  modified_base (449)..(449): a, c, t, g, unknown or other
  misc_feature (449)..(449): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactggaaccagcagtgacgttggtggttangactatgtctcctggtatcaacaacaccccggcaaaacgtccccaaactcctagtatttatcgacgtcgctacgccgaccctcgacgggtccctgactcgcttctctggctccaagtctggacaacactcgccctcctgaccatctcgtcggctccgagctgacgatggacggtgtatttattacgtgtactcgcttaccntttcgcgacggccacccgctacgtgtagtacttcgtcgggacggacggaccaggtcgtacgtaccggtcgtacgtctgcgtacgacggtcctccgtcccgtaccg

SEQ ID NO: 269206 - DNA, 722 bp, Homo sapiens
  misc_feature: GYAE6OF02F2TED.29.28.C06.1.454.CMB.1.raw
  modified_base (259)..(259): a, c, t, g, unknown or other
  misc_feature (259)..(259): n is a, c, g, or t
  modified_base (409)..(409): a, c, t, g, unknown or other
  misc_feature (409)..(409): n is a, c, g, or t
tcagatagagtactcacgaccggtgctcgatttagagctcacgtattggggtttgggggggggtctcaggaggcagcgctctcaggacgtcaccaccatggcctgggctctgctcctcctcaccctcctcactcgagggcacagggtcctgggcccagtctgtcctgactcacgccctccctccgcgaccgggttcctccgtggacagtcagtcaccatcctcctgctactggaaccagcagtgtacgttggtgttacngactatcgtctcctgtatacgtaaacaaaccaccccggacaaaccgtaaccccctaaacctacctagtaatttaacgtcgtaccgtcgccgtaaccgccgacccgtcgacggggtacctgtacttcgtcttttgcgtcctaccacgtcgngaccaacgaccgtcctccctcgaccgttctccgtcggcctaccggacgtcgtacgaacgtagtacggacggtctacgtaacgttaacttacgtaccgtacctccttaactaagtactacggacgacggtaaccaaacgttaaccgttttaagttttaggttaacggttttaccgggtaccggggtaaacggtaaccgtaaacgtccggtaccgttaccccgtcgttaacgaccggttaccgaaacggtccttaacggtaacccggtcccgttaccccggtcccccggtttacgttacccgttacccggttccc

SEQ ID NO: 269207 - DNA, 608 bp, Homo sapiens
  misc_feature: GYAE6OF02G80HL.29.28.C06.1.454.CMB.1.raw
  modified_base (231)..(231): a, c, t, g, unknown or other
  misc_feature (231)..(231): n is a, c, g, or t
  modified_base (355)..(355): a, c, t, g, unknown or other
  misc_feature (355)..(355): n is a, c, g, or t
  modified_base (420)..(420): a, c, t, g, unknown or other
  misc_feature (420)..(420): n is a, c, g, or t
tcagatagagtactcacgaccggtgctcgatttagagctcacgtattgggtttgggggggggtctcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcacgtcggaaccngcagtgacgttggtaggttatgactatgtctcctggtatcaacacaccccgacaaacgtaccccaactcctgtatttatgacgtcgctacgcgaccctcgacgggtccctgactcgtcttttcncggtctccagtcctggacaactcggcctccgtgaccgttcctcgtcggtcctcgacgcgtcgagntcggacgtcacgtacttacttactcgtcctccttcattacgtcgacgacgtaccaaccgtaacttgtttttacggtagttttccgggaggacggaactacgacgtcggtaaccctccgtcgtacgtaccgtagaccgttacgacggttccgtccccggtaccccgtccgttaccgttccttaccccgg

SEQ ID NO: 269208 - DNA, 869 bp, Homo sapiens
  misc_feature: GYAE6OF02GNBLR.29.28.C06.1.454.CMB.1.raw
  modified_base (211)..(211): a, c, t, g, unknown or other
  misc_feature (211)..(211): n is a, c, g, or t
tcagatagagtactcacgaccggtgctcgatttagagctcacgtattggggtttggggggggtctcaggaggcagcgctctcaggacgtcaccaccatggcctgggctctgctcctcctcaccctcctcactcacgggcacagggtcctgggcccagtctgtcctgactcacgccctcccgtccggccggacccgggtcctccgtggaccngtccacgtaccacctattcctctcgaccacgtcggaacccagcaggctagtcggtacggttaggttaacttaacgttttcgtccttaccgtacggtaaaccaaaccaacccgaccgacgggaccggacccggaccccccgtactaccgtaaaactttaaacgtttactaggtacgtttacgtaaccgtaacgtttaacggccccggtaccccgttaccgggtaccggggttccccgttaggtaccgttccgttccttacgtccgtcggtacctacgttacggtcgtacggaacctaaccgtctacccggtccctacccgaacgtacctaccgttcgtccggcggtccgtaccggtcggtaccgtaggacgtacggtcgggttaacggtattaacgttacgttacgtacggttcgttccgttactttacgttcggttaaccggtacgtacccgggtaccctacccgggttacgttaccggttgtttaaccgtcggttttaccggggaccggggtaaccggtaaccgggaaaccggtttacgggtaacccggttaccgggttaacccggttacccgggttaaccggtaaccgttcccgggtaaccggttaaccggttaacccggttccccgggttaccccgttacccgggtttaccccgg

SEQ ID NO: 269209 - DNA, 696 bp, Homo sapiens
  misc_feature: GYAE6OF02GLYRE.29.28.C06.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
tcagatagagtactcacgaccggtgctcgatttagagctcacgtattgggtttggggggggtctcaggaggcagcgctctcaggacgtcaccaccatggcctgggctctgctcctcctcaccctctcactcagggcacgagggtcctgggcccagtctgtcctagactcagccctcccgtccgcgaccgggtctcgtggacagtcagtcacatctcctgcacgtggaacngctagtcgtacggttggtggttangactatcgtctccgtgtactacaaccaaccgaccccgacaaaccgtaccccaacttcctagttattactcggacgtaccgtacgtacgccgtaccctcggacgggttccctagtacttcgttacttttcgtggtacctctaacgtcgacggacaacgccgtcctaccgtcgccgttctcggtcgcctaccgtcgctacggaacgtgtacggtagtctacgtaacttacgttaccgtacgtccttaccgttactaaacgttcgtacggtaacgtacgtaaccgtaaacttacgtttaacgttttttacgtaacgggttttacggaaccgggtaacggtaaaccgtagtaccgtacgtacccggtaccgtaacgtacggtcgtacgttaccgttcggaccgtccgtaccccggttacccgtccggttaccctcccgttaacccg

SEQ ID NO: 269210 - DNA, 899 bp, Homo sapiens
  misc_feature: GYAE6OF02G49OS.29.28.C06.1.454.CMB.1.raw
  modified_base (222)..(222): a, c, t, g, unknown or other
  misc_feature (222)..(222): n is a, c, g, or t
  modified_base (259)..(259): a, c, t, g, unknown or other
  misc_feature (259)..(259): n is a, c, g, or t
tcagatagagtactcacgaccggtgctcgatttagagctcacgtattggggtttgggggggggtctcaggaggcagcgctctcaggacgtcaccaccatggcctgggctctgctcctcctcaccctcctcactcgagggcacgagggtcctcgggcccagtctgtcctgactcagccctccctccgcgaccgggtctccgtggacagtcagtccacatctcngcacgtcggaaccagcagtgtacggttggtacgttanagtacttagtcgttccgttccgttaggtaactaccaaaccctaacccgaccccggaacaaacccgtacccccaaacttcccttagtactttacgacggtaccgttcgaccgtaccggaccccgtaccccgtcgggaaccggggttcccctaggtaccgttccgtttacgtttccgacggttccctaaccgtagtttccggacggtaccctaaaccggcccggttacccttccgtaccgttaccgttccgtccggtacgggtcccttacgggaacggttccgtaacgggaactaggtacgggaccggttacgtacgttaacctttaacgttccgtaccgttacccttcccgttaagtaccgttacgtaccgggaaccgtaacggtaaaacccgtaaaccctttttaacggtttttaggtttttaaccggggtttaaccggggtttaacccggggggtaaacccgggtaaaccggtaacccgttaaaccggtttaccgggtttccccggtaaaccccgtttccgtaaccggttacgggtaaaccgttcccggttaacccggttaacggtaccccggggttcccctttcccccgggtaaccccccggttttacgggtaccccttaccccggttttcccccggg

SEQ ID NO: 269211 - DNA, 783 bp, Homo sapiens
  misc_feature: GYAE6OF02FQNOE.29.28.C06.1.454.CMB.1.raw
  modified_base (268)..(268): a, c, t, g, unknown or other
  misc_feature (268)..(268): n is a, c, g, or t
tcagatagagtactcacgaccggtgctcgatttagagctcacgtattggggtttgggggggggtctcaggaggcagcgctctcaggacgtcaccaccatggcctgggctctgctcctctcaccctctcactcgagggcacgagggtcctgggcccagtctgtcctgacctcagccctcccgtccggcgacccgggtctcccgtggacagtcacgtcacctatcctcctgctacgtcggaaccagctagtcgacggttggtcggttaancgaactagtgttacctccgttggtaactaccaaactaacccgaccccggacgtaaaaccgtacccccgtaaacccttaccgtaggttaactttacgtacggtaccggttaccgtaccttaccggccgtaccccttacggaaccggggttccctacgtacgttccgttaccgttttacggtggtcccttaccgtaacgtccgtacggaccaaaccgtaccggtcccctaccggtccgtaacccggttcctaccggtcgggtacctcggacggtaccgtacgacggtacgtacgggtacgtccgtacgtaacttacttaactccggtaccttccgtctaagtactcgagtacggaacctaaacgtacgttagttttacgttaccggtttacgggaacgggtacggtaacgtaccggtacgttaccggtacccttaccgtcgtaacggtacctaacgtcccgtacggtacgacccggttccggttaccccccggtcgtaccgttacccgttaccccgg

SEQ ID NO: 269212 - DNA, 624 bp, Homo sapiens
  misc_feature: GYAE6OF02HC760.29.28.C06.1.454.CMB.1.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (323)..(323): a, c, t, g, unknown or other
  misc_feature (323)..(323): n is a, c, g, or t
  modified_base (389)..(389): a, c, t, g, unknown or other
  misc_feature (389)..(389): n is a, c, g, or t
  modified_base (449)..(449): a, c, t, g, unknown or other
  misc_feature (449)..(449): n is a, c, g, or t
tcagatagagtactcacgaccggtgctcgatttagagctcacgtattgggtttgggggggggtctcaggaggcagcgctctcaggacgtcaccaccatggcctgggctctgctcctcctcaccctcctcactcagggcacagggtcctgggcccagtctgtcctgactcagccctccctccgcgaccgggtcctccgtggacngtcagtcaccatctctncactcggaaccagcagtgacggttggtggttatgactatgtcctcgtggtactacaaccaaccaccccggacaaaccgtaccccctaaactcctagtatttancgtaccgtcgactaccgccgacctcgtacggggtccctgacgtccgcttctcgtcgctaccagtcncggacactactcgccctccgacaccattcctcgcggtccctcggacgcgttaggaacgtntacgggtacggttactagtttacttactcgtctcgtacgtacttagttcgacggtcggcccacccgtgtacgtcgtacgttcgtccgtacgggaccggacggaacctacggccgtaccggtacccgttaggtaccgagtacgcctacggacggtcccggtccgtccccgttaccg

SEQ ID NO: 269213 - DNA, 802 bp, Homo sapiens
  misc_feature: GYAE6OF02HJ8I6.29.28.C06.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
tcagatagagtactcacgaccggtgctcgatttagagctcacgtattggggtttgggggggggtctcaggaggcagcgctctcaggacgtcaccaccatggcctgggctctgctcctctcaccctcctcactcagggcacgagggtcctgggcccagtctgtcctgacctcacgccctccccgtccgccggaccgggtcctccgtggacagtcagtcaccatcctcctnccatcggaaccngcagtcgtcgttggtggttangtactattcgtcttccgtaggtataccaaacaacccgaccccggacaaaccgtaccccaactctgtacttancgacgtcgacncgccgtccctaggtcgggtccctgtacttcgttcgtttcgcggtctacgtaacgttcgtacggaccaaccgtaccggtccccttacccgtcgtaccccggttccttcggtccgggtccctaccgacgggtaccgttaacggaaccgttaaggcgggtaaagggtccgttaacgttaacgtttaacgtttacccgtcggttacccttacccttcgttaagttgtccggtaaccggtcgaaacctaaacccgttaagttttacgttttacggttttaacggttcccgggggaacggggttaaacccgggaaccgttacccggttccggttacccgttaacccggttcgttacccggttaagtacccggtaaccggtccgaaacccgggttccgggttaccccgttccccccgggaccccggtttttacccggaccccgtttcccggtttaacccccggg

SEQ ID NO: 269214 - DNA, 613 bp, Homo sapiens
  misc_feature: GYAE6OF02I71JH.19.77.G11.1.454.CMB.1.raw
  modified_base (294)..(294): a, c, t, g, unknown or other
  misc_feature (294)..(294): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (610)..(613): a, c, t, g, unknown or other
  misc_feature (610)..(613): n is a, c, g, or t
tcagtactctcgtgcacgaccggtgctcgatttagctagtcactcaagggaaagggtgacatccctcactgtggctcacgttcggcggagggaccgaggtggagatcaaacgtaagtgcactatccgaatgctttttgtataaggttttgatttggagggttttgtgtttgagatatgaggtcaggtcaattccaaagagtaccagattctttcagaaagtcagatgagtaagggacagaaacttagttcatacttaaggaacagaccaagcgctagccaagttaagtgagganccaatacttcaaagttttcaagattttcgactgcgattacgggtacaggttatgtaatattaacgaagagaaaagttagaagttttagttaaaggggaaataattaaagacttaaagacgtagttaggaacttacgaaccttacgggaccaaaggggtaactaacggaacgtaggtaaacgtaagttaaacgtaaacgtagtagggactacgactacctaatacttgtacttactactccttaccgacctatacgtacgaacgacgtagacgtaactacgagcgggacagggacgaagacgacgagtagagnanannnn

SEQ ID NO: 269215 - DNA, 537 bp, Homo sapiens
  misc_feature: GYAE6OF02F75R8.19.77.G11.1.454.CMB.1.raw
  modified_base (313)..(313): a, c, t, g, unknown or other
  misc_feature (313)..(313): n is a, c, g, or t
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
  modified_base (435)..(435): a, c, t, g, unknown or other
  misc_feature (435)..(435): n is a, c, g, or t
  modified_base (476)..(476): a, c, t, g, unknown or other
  misc_feature (476)..(476): n is a, c, g, or t
  modified_base (528)..(529): a, c, t, g, unknown or other
  misc_feature (528)..(529): n is a, c, g, or t
  modified_base (531)..(537): a, c, t, g, unknown or other
  misc_feature (531)..(537): n is a, c, g, or t
tcagtactctcgtgcacgaccggtgctcgatttagctagtcactcaagggaaagggtgacatccctcactgtggctcacgttcggcggaggtaccgaggtggagatcaaacgtaagtgcactatccgaatgctttttgttataaggttttgatttggaggggttttgtgtttgagatatgaggtcaggtcaattccaaagagtaccagattctttcagaaagtcagatgagtaagggacagaaacttagttcatcttaaggaacagccaagcgctagccagttaagtgaggcatctcaattgcaagattttcnctgcatcggtcaggtttagngatattaacagaagaaaagngtatttttaggtaaaggggaaattaattaagactaaacacgttagtggaatccaacctttcggaccaagggcacgactgganaattaaacgaacttgtacggctgacacctatcttgtccttnactcttcccgcatctgaccagagagtactgagcggctggcaaggcacatagnngnnnnnnn

SEQ ID NO: 269216 - DNA, 745 bp, Homo sapiens
  misc_feature: GYAE6OF02IXMT7.19.77.G11.1.454.CMB.1.raw
  modified_base (320)..(320): a, c, t, g, unknown or other
  misc_feature (320)..(320): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
tcagtactctcgtgcacgaccggtgctcgatttagctagtcactcaagggaaagggtgacatccctcactgtggctcacgttcggcggagggaccgaggtggagatcaaacgtaagtgcactatccgaatgctttttgttataaggttttgatttggagggttttgtgtttgagatatgaggtcaggtcaattccaaagagtaccagattctttcagaaagtcagatgagtaagggacagaaacttagttcatacttaaggaacagccaagcgactagccaagttaagtgaggcatctacaattgacaaagtatttttcnctgacagtccggtnaggttagngattaattaanagaagaaaagtagtaatttttaggtaaaggggaaatttaaattaagacttaaacaacgttggtaggtaacttaccgtaacccgtttaccgggacccgaaaagggggtaccaacccggtaaacgttacggggaaagtaaacgtttaaaaaccggaaacgttgggttacgggaccttacggaccctaaacctaactttccgttacgtttacctttaccgtaactttacccgtttacccccgacctaaacttcccgtaaacggtaaccgaaccggtaaacggttacggttaaaccgttcgggaacgggtccggggggtaccttaacgggggaacccgtaaaaacggggcccggtaaaccgtaaagttaacgggctagacacgtacacgtgacacg

SEQ ID NO: 269217 - DNA, 643 bp, Homo sapiens
  misc_feature: GYAE6OF01CAMH3.10.21.B10.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
tcagcatagtagtgcacgaccggtgctcgatttagtgtcgtcgcaagaggtagggagggggaggaactgctcagttaggacccagagggaaccatggaagccccagctcgagcttctcttcctcctgcctactctggctcccgagacaccgaccggaggaaacttgtgttgaccacagtctccagcccacgctgtctttgctccagggaangccaccctntcctgcagggccaggtcagagtgttcgctacgttcgttaggtgtatcaacataaatccggccaggcctcccaggctcctacactactttgattgctttcaacgagggcccctggccgtcccgaggcctaggttcaggtcggctaggtcgggtctaggggactaggaccttcgacgtcctccacctatcagtcacgtcctaagacgtccgtagaacgtagttttgctagtttattactgttcagacagcgtacgcctacgtttacgggcggtacggtcgtcccgttacggtttccgggacgggacggggaacccaaaagtacggacgggtaaccgtaaaaccggtaacgttagggtacggaccgtacggaccctaacccgtacgttacccgttacggttaccctttccgtacgtttaccccccg

SEQ ID NO: 269218 - DNA, 523 bp, Homo sapiens
  misc_feature: GYAE6OF01CAAY2.10.21.B10.1.454.CMB.1.raw
  modified_base (205)..(205): a, c, t, g, unknown or other
  misc_feature (205)..(205): n is a, c, g, or t
  modified_base (254)..(254): a, c, t, g, unknown or other
  misc_feature (254)..(254): n is a, c, g, or t
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggnggtatcaacataaatccggcaggctcccaggctcctcatctttgatgctttcaacagggcccctggcgtcccaggcaggttcagtggcagtgggtctgggacagacttcactctcacatcagcagcctagagcctgaagtattttgctagtttattactgtcagcagcgtgcctacgtttcgggcggaggtcgcctacgtttcgggcggagggaccaaaagtacggaaggtacgaaacgaactggtggctgctaccatctgtcttctac

SEQ ID NO: 269219 - DNA, 622 bp, Homo sapiens
  misc_feature: GYAE6OF01DI7ET.10.21.B10.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagaggaggggggaactgctcagttaggacccagagggaaccatggaagccccagctcagcttctcttcctcctgctactctggctcccagacaccaccggagaaattgtgttgacacagtctccagccacgctgtctttgtctccgaggggaaanagcccaccctctcctgcgagggccagtcagagtgttcgcacgtttcggttagggtgtatacaacataaacgtccggcacggcctcccgaggcctccctcattcctttgattcgtactttcaacgacgggcccctggccgtcccaggctaggttcaggtgcgagtggtctgggacagtactttcactctcactatcagcagcctagacgccgtagaagtattttgacttaagttttactacgttgtcgacgtcagtcgtcgccttacgtttcgggacggtaggtcgtacctacggtttccgggacgggtaacgggaacctaaaagtaggtaacggtaccgtaaaacggacgttcgggtaggtccgttcgacccgtacctacgttccgttacgttacctttaccacgtttcccgtttccccg

SEQ ID NO: 269220 - DNA, 563 bp, Homo sapiens
  misc_feature: GYAE6OF01CTWMI.10.21.B10.1.454.CMB.1.raw
  modified_base (207)..(207): a, c, t, g, unknown or other
  misc_feature (207)..(207): n is a, c, g, or t
tcagcatagtagtgcacgaccggtgctcgatttagtgtcgtcgcaagagaggagggggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgtagggtgtatcaacataaatccggccaggctccaggctcctcatctttgatgctttcaacacgggcccctggccgtcccaggcaggttcagtggcaggtgggtctggggacagacttcactctcaccatcagcagcctagacgcctgaagtattttgctagtttattactgtcagcagcgtcgcctacgtttcggcgggtacggtcgtccgtacgtttcgggacggacgggaaccaaaagtacggacggtacgaaaccggtaacgttggtacggctacggaccaccgtatccgttagttccttcgtattccccg

SEQ ID NO: 269221 - DNA, 819 bp, Homo sapiens
  misc_feature: GYAE6OF01D0F8G.10.21.B10.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagaggagggggggaactgctcagttaggacccagagggaaccatggaagccccagctcagcttctcttcctcctgctactctggctccagactaccacggagaaattgtgttgacgcagtctcaggccacctgttctttgtctacgaaggggaaancgccaccctctcctgcgaggccagtcagtagtgtcggctcctacgtacgcccgtaggtaacccaaacgaacgtaaacccgtcggaccgaacggtccctaccccgaccggtacccccttacgtaacttaccgttaaggttcgggttacgacctaacgttaaccccgaaaacggaccggggtacccaacggttcggacctaaccgtaccccgacgtaccgtacggttacgaggttcggaccgtagggtgggtaccgtacggggaactacggtaccttaccgaccttctaccacctacgttcaataccgtacgtccgtaggtaaccgtccgttagaaacggttgttacgttcgtaccgttaagttttaccttacgtacgtaacctaaacgttacgttaccggtaccggttacgggtccggtaccccgggttacccggggtaccctttaaccggggtttccccgggacccggttaacggggtaaaccgttaacgggttacgtaaacgtaacgttaaacccggtaaaaaccggttcgtttacgggtacggtacccgttacgaacccgttaaccgtacgttaccgttacgtttaccttacccgttagttcccccttacccgg

SEQ ID NO: 269222 - DNA, 675 bp, Homo sapiens
  misc_feature: GYAE6OF01B3ABH.10.21.B10.1.454.CMB.1.raw
  modified_base (208)..(208): a, c, t, g, unknown or other
  misc_feature (208)..(208): n is a, c, g, or t
tcagcatagtagtgcacgaccggtgctcgatttagtgtcgtcgcaagagaggagggggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgccaccctctcctgcgagggccagtcagagtgttcgctacgtttcggttagggtgtatcaaactataaacgtcccggccgaggcctcccgaggccttcctctacttctttagacttcgtactttaccgaacgaccgggtcccctgggcccgtccccgaggtccgtaggttcgaggttcggaccgtagggttcgggtcgtaggggaactaggtaccttcacctcgtccaccgtactaccgagactacgaccgtaggtacgtccgtagtaagttacttttagacgttaagttttactcgtcgtacacgtctacgtcgtaccgaccttacggttcggacgggtacgtcgtacccgttacggttccgggaacgggtaacgggaaaccctaaaggtacggtaacggtaaccaaacggtacgtggtcggtcgtacgacctaaccgtgttacgtcgttactctacgtcccccg

SEQ ID NO: 269223 - DNA, 775 bp, Homo sapiens
  misc_feature: GYAE6OF01C79MP.10.21.B10.1.454.CMB.1.raw
  modified_base (207)..(207): a, c, t, g, unknown or other
  misc_feature (207)..(207): n is a, c, g, or t
tcagcatagtagtgcacgaccggtgctcgatttagtgtcgtcgcaagagaggaggggggaggaactgctcagttaggacccagagggaaccatggaacgccccagctcagcttctccttcctcctgctactctggcctcccagaccaccaccggaagaaattgtgtgaacacagtctccagccacgctgtctttgctcgagggaaancgccacctctcctgcagggccagtcagagtgttcgctacgttcggttaaggggtgtatacaacgaataaacgtccggccaggcctacccgaggcctcctatagttcttagattcgtctttacaacgtacgggccctggccgtcccgaggctaggttcgagtggctaggtcgggtcgtaggggactaggtacttcgaacttcctacaacctataccaaggacctaaggacccttaaggactaccccgtaggtaaaaggtttacttttggaccgtttaaagtttttaacgtttaaccgtggttaaccgacggttacctaacgggtccggttaaccggttccccgttaaacgggtttttccggggaaccggggttaacgggttaccgtaccgtttaacccgggttttccgggggaaacggggttaaaccgggaaaaccctaaaaaagggtaagggtaaacccggttaaaaacaaaaccgggtaaactttggggtacgggtaccgtaccgaaaccgtaaccccgtaaacgttttcccgttaggttacccttttccgaaaccttttcccccgg

SEQ ID NO: 269224 - DNA, 608 bp, Homo sapiens
  misc_feature: GYAE6OF01D5HGC.10.21.B10.1.454.CMB.1.raw
  modified_base (205)..(205): a, c, t, g, unknown or other
  misc_feature (205)..(205): n is a, c, g, or t
  modified_base (401)..(401): a, c, t, g, unknown or other
  misc_feature (401)..(401): n is a, c, g, or t
  modified_base (476)..(476): a, c, t, g, unknown or other
  misc_feature (476)..(476): n is a, c, g, or t
tcagcatagtagtgcacgaccggtgctcgatttagtgtcgtcgcaagagaggaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtcgttcgctacgtttcggttagggtgtatcaacataaactccggccacggcctcccaggcctcctcattctttgatgtcttttacaacgtacgggcccctgggccgtcccgacgggtcaggtttcaggtcggacaggtcgggtcgtggggactagtacttcactcncaccatcagcagcctagacgtccgtagaagttattttcggacttagtttaattacgtgtacacgtcacgtcgtcnccgtacggttcgggacggtggtcgtaccgttacggttcgggacgggtacggaactaaaggtacgacgggtacaaacggtacgttggtacggctacggaccaccgtacgttctagtttcctcgtcttaccccg

SEQ ID NO: 269225 - DNA, 794 bp, Homo sapiens
  misc_feature: GYAE6OF01BL5VJ.10.21.B10.1.454.CMB.1.raw
tcagcatagtagtgcacgaccggtgctcgatttagtgtcgtcgcaagagaggaggggggggagaggagcccagcactagaagtcggcggtgcctccattcggtgatcagcactgaacacagaggactcaccatggtagtttgggctgagtcgttgggtttttcctcgttgtcttacgttttaagagtatcgtccagtgtcagtatgcagtagtgggtggagtcggtgggggaggtcggtcgggtccgggtccggtcggggggtccctggacgtaccttcgttccgttgttcgtcggtccgttcgtaggtacttctattactttaagtaatcgtggtctagtcgtccgtcgggtcccgccgtacggttcccgacgggcccgacgggtcgtagggaaggttcggggtacgacgtaaggtaattaacgtaactaaagttagtaggtaactaagtaaacgtaaaagtttaaaaattacttaaacgtaagtacggtaacgttaccttaccgttaacggaacgggtcctacttaccaaccgtactaccctaccgaagtaaccgtaacctaaccttaaccgtaaagtaacgttaagttggttaacgttaacttaccgtaagtaacctaaacgtaccggaaccgtacggtaccgtaaggacggtaccgggaaccggtaaagggtaccggttacggggtttacgttttaaggtacgggttagggtaacgggttaaacgtaaacgttacccggttaaggtaccggtaaccttacgttacccgttaccggtttaggtttaccggg

SEQ ID NO: 269226 - DNA, 669 bp, Homo sapiens
  misc_feature: GYAE6OF01BZPWX.10.21.B10.1.454.CMB.1.raw
  modified_base (208)..(208): a, c, t, g, unknown or other
  misc_feature (208)..(208): n is a, c, g, or t
  modified_base (348)..(348): a, c, t, g, unknown or other
  misc_feature (348)..(348): n is a, c, g, or t
tcagcatagtagtgcacgaccggtgctcgatttagtgtcgtcgcaagagaggagggggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanacgccaccctctcctgcagggccagtcagagtcgttcgcctacgtttcggttaggggtgtatcgaaacaataaactcccggccaggcctcccgaggcctcctcatctttgatgtctttcaacgacggccctggccgtccnggcaggttcaggtggcgaggtgggtcgtgggacagtacttcactctacaccatcagcacgacctagacgtcctagtaagttatttgacttagtttacttacgtagtcagacagcgtcgaccgtacgtttcgggacggtacggtccgtaccgttaccggtttaccgggacggggtaacgggtaaacccgtaaaaggttacgggtaacgggtaaacccgtaaaaacgggtaaccggtttacgggtacgggtacccgtacgggtacctaaaccccgttacttacccggtttacgtttacccgtttacgtaccgtttaccccccg

SEQ ID NO: 269227 - DNA, 636 bp, Homo sapiens
  misc_feature: GYAE6OF01CY2VV.10.21.B10.1.454.CMB.1.raw
  modified_base (205)..(205): a, c, t, g, unknown or other
  misc_feature (205)..(205): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
tcagcatagtagtgcacgaccggtgctcgatttagtgtcgtcgcaagagaggaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangcccaccctctcctgcagggccagtcagagtgttcgcacttcggttagggtggtatcaacaataaactccggccaggctcccaggctcctcatctttgattgctttcaacgacgggcccctggccgtcccgaggctaggttcaggtggcaggtgggtcgtgggacagtacttcactcncacatcagcanccgtagacgacctagaagtattttgacttaaggttttacttaagttcgtactagacgtaggtccgttcgtaccgttacggtttccgggacgggtacgggttcgacccggttacgtttccggggacgggtaacgggtaaccgtaaaaaggtacgggaacgggtaaccaaacgggtaaacgttcgggtagggccttacggacccgtacctacgttaccgttccggttacttccgtcttaccccg

SEQ ID NO: 269228 - DNA, 702 bp, Homo sapiens
  misc_feature: GYAE6OF01EA7DB.10.21.B10.1.454.CMB.1.raw
  modified_base (203)..(203): a, c, t, g, unknown or other
  misc_feature (203)..(203): n is a, c, g, or t
  modified_base (306)..(306): a, c, t, g, unknown or other
  misc_feature (306)..(306): n is a, c, g, or t
  modified_base (387)..(387): a, c, t, g, unknown or other
  misc_feature (387)..(387): n is a, c, g, or t
tcagcatagtagtgcacgaccggtgctcgatttagtgtcgtcgcaagagaggagggggggaactgctcagttaggacccagagggaaccatggaagccccagctcagcttctcttcctcctgctactctggctcccagacaccaccggagaaattgtgttgacacagtctacagccacgctgtctttgtctccgaggggaaanacgcccaccctctcctgcgacgggccagtcagagttgttccgctacgttcggttagggtgtatacaacaataaacgtcccggccaggcctccgaggcctcctnattctttgatcgtctttacgaacgtacgggtcccctggtccgtacccgaggccgtaggttcaggtggactaggtgggtcgngggacagtactcactctacaccatcgagcacgccgtaagacgtccgtaagtaagttacgttttacgacgttaagttttaacttacttagtaccaggtccgtaacgtccggttacgtcccgttacggtttacggggccgggtaacggttcccggtaccgttacgggtttaccggggaacgggtaaaccggaaacctaaaagggtacggtaacgggtaaaccctaaaacgggtaccgttgggtaaccgggccgtacgaaccgtaaccctacgttccttaacggttccctttaaccgtccgttccccggttacccccg

SEQ ID NO: 269229 - DNA, 687 bp, Homo sapiens
  misc_feature: GYAE6OF01DA0VN.10.21.B10.1.454.CMB.1.raw
  modified_base (217)..(217): a, c, t, g, unknown or other
  misc_feature (217)..(217): n is a, c, g, or t
  modified_base (492)..(492): a, c, t, g, unknown or other
  misc_feature (492)..(492): n is a, c, g, or t
  modified_base (502)..(502): a, c, t, g, unknown or other
  misc_feature (502)..(502): n is a, c, g, or t
tcagcatagtagtgcacgaccggtgctcgatttagtgtcgtcgcaaggagagagggggagagccctggggaggaactgctcagttaggacccagagggaaccatggaagccccagctcagcttctcttcctctgctactctggctcccagacaccaccggagaaattgtgttgacacagtcctccagccacgctgtctttgtctccgaaggggaaancgccaccctctcctggcagggccagtcagtagtgttcgctacgtttcggttaggggtgtatacaaactaagtaaactccggcaacggcctaccccgacggtccccctctaacttctacgtgggtcgaccacgttacccaaacggaacgggtccaacgtcgggacctaacgtccccaaggtccctaagggtttcgaaggtcgggtactagggttcggggtctagggggacctaggtaccttcacctccgtacacctatccatccacgccgtggacncgtagaagtnttgttgtcttagttttactacttagtactaatacgtaccggtacggtcggtccgggtcccggtacccgggggtccttaccgggtttccggacccggttacgggaaccgtaaagggtacggtaagttaacgtaaccgtaaaaccggtacgtcgggttacggtactacggacctaaccgtgttaccg

SEQ ID NO: 269230 - DNA, 752 bp, Homo sapiens
  misc_feature: GYAE6OF01ESB10.10.21.B10.1.454.CMB.1.raw
tcagcatagtagtgcacgaccggtgctcgatttagtgtcgtcgcaagaggagagggggggagaggagcccagcactagaagtcggcggtgcctccattcggtgatcagcactgaacacagaggactcaccatggagtttgggctgatcttgggtttttcctcgttgcttacttttaagagtatgtccagtgtacagatgcagtagtggtggagttcggtgggggagtcggtggtcccgggccgtcggggggtccctgagtacttccgtccgttgttcgtgcgttcgtcggtattcgatttctttaagtaaacttcgtcggactagttcgttccgtcgggtccctacgtacggttccgacggaccgacgggtccgtagggtacgttggggtgacgtagtaactagtaaacaattagtagttaaataacgaaaagtttaaaaactagttaactagtacgggtaactaaccgttcccttaacgggaaacgggtcccttaacgtttacccaacccttaacgttacccgtaacccgaaacgtaaaacggtaacccttaaacgtttaaacccgaaaacgttaaaccgtaggttaacggtttacgtaattttaccgacgttaaaacaaccgtacgtacccgaacgtacccggttagaacgaacgaccggtaacggacggttacgggtttacttacgtttacgtgggtaagaaggtaaccttcgtacggtagccgtaaactccgttagtgttgttaccgg

SEQ ID NO: 269231 - DNA, 692 bp, Homo sapiens
  misc_feature: GYAE6OF01CRGET.10.21.B10.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (388)..(388): a, c, t, g, unknown or other
  misc_feature (388)..(388): n is a, c, g, or t
tcagcatagtagtgcacgaccggtgctcgatttagtgtcgtcgcaagagaggagggggggaactgctcagttaggacccagagggaaccatggaagccccagctcagcttctcttcctcctgctactctggctcccagacaccaccggagaaattgtgttgacacagtctccagccagctgtctttgtctcgaggggaangcccacctctcctgcgagggccagtcagngtgttcgctacgtttcggttaggggngttactacaaacaataaacgtccggaccaggcctacccgaggcctcctcattcgtttgattgtctttacgaaccgtcgggcccctggccgtcccgaggtcgtacggttccagggtcggctagggtgggttcgnggggacacggtactttcaacttctacaccgtaatccgaacggcacggtccctaggcgtaccgtagtaacgttattttgacgtttaagttttattaccgttgtaccgagacgtacgcggttcgccgttacggtttcgggcggtaagtccgtaccgtacggtttccgggacggttaacggaacctaaaaggtcggtaacgggtaaacctaaacgggtaaccgtgggttagggtaccttaccgggacctaaaccgttacgttacggtttacgttcctttaaccgttacctttcccgggttacccccg

SEQ ID NO: 269232 - DNA, 733 bp, Homo sapiens
  misc_feature: GYAE6OF01ESWAR.10.21.B10.1.454.CMB.1.raw
  modified_base (206)..(206): a, c, t, g, unknown or other
  misc_feature (206)..(206): n is a, c, g, or t
tcagcatagtagtgcacgaccggtgctcgatttagtgtcgtcgcaagagaggagggggggggagaactgctcagttaggacccagagggaaccatggaacgccccagctcagcttctcttcctcctgctactctggctccagacaccacggagaattgtgttagacacagtctccagccacgctgttctttgctaccgaggggaancgcccacctctcctgcgagggccagtcagagttcgttccgctacgtttcggttaagggtgttaactcgaaactaacttaaacgtcccggaccgtaggccctacccgacggtaccttcctactacttcgtttgacttcgtccttttacaacggtaccgggccctcggccgtacccgacggacgtaggttacgagtcggcgtacggtcgggtcgtacgggacgtacgtaacgttacgtactaccgtaccaacctagtaccgagccgtacgaccgttacggacgtaccgtaagtaaggttacgtttacgtacgtttaaattttaccgttagttaccgtacgtccgtaacgacggtacggtacccgtacgttaccggttacgggtacgggtaggtaccgtaccgttaccgggttttacgggacgggtaaacggtaacgtaaacgtaagggtaaccggaaacgtaaacggtaacgttacggacgttcgaccgacgacttacgttcgtagtttaccctagttccgttaccccg

SEQ ID NO: 269233 - DNA, 868 bp, Homo sapiens
  misc_feature: GYAE6OF01DF3D4.10.21.B10.1.454.CMB.1.raw
tcagcatagtagtgcacgaccggtgctcgatttagtgtcgtcgcaagagaggagggggggagaggacgcccagcactagaagtcggcggtgcctccattcggtgatcagcactgaacacgagaggactcaacctagtgggtagtttgggctggagtcgtttgggttttccctcgttgtcttacgttttaagagtatcgtcagtgtcgagatgcagtgtgggtggtacgtcggtgggggacggtcggtcgggtcccgggtccgggttcgggggtccctggacgtccgtccgttccgttgttccgtgtcgttcgtggtattctagtttacgtttaagtaactcgtaggtactacggtcgttccggtcggtccgtaccgtacggttccggacgggccgacgggtacgtagggtaaggtggggtcgaacgtagtaacttactaagtaagttagtagtaacgtaacgtaaacgttaaagttaaaagttaacttaacgtaagtacggtaaaccgttacccgtttacccgttaaacggggaaccgggttacccgttaaacgttacccctaacccgttaacgttaaccccgttacgtaaaccggtaacgttaaaacccgttaaaccgttaaacccggtaaaaaggttaaaccgttaagggttacggtttacgtttaacgttaccggttaacgtaaacctaaacggtacccgtaaccgtaccggtcccggtaaaggaacccgggttacggaaccgggtaaccggttaaccgggtacggttttaagtttaaccggtttaggttaacggggtaacggtaaagttaccggtaccggttaaggtcgtaaccgttacgttaaccggtacgttggtttaacgg

SEQ ID NO: 269234 - DNA, 638 bp, Homo sapiens
  misc_feature: GYAE6OF01B6F6D.10.21.B10.1.454.CMB.1.raw
  modified_base (476)..(476): a, c, t, g, unknown or other
  misc_feature (476)..(476): n is a, c, g, or t
  modified_base (520)..(520): a, c, t, g, unknown or other
  misc_feature (520)..(520): n is a, c, g, or t
tcagcatagtagtgcacgaccggtgctcgatttagtgtcgtcgcaagagaggagggggggggagaggagcccagcactagaagtcggcggtgcctccattcggtgatcagcactgaacacagaggactcaccagtggtagtttgggctgagtcgttgggttttcctcgttgtcttacttttaagagtatgtccagtgtacagatgcagagtgggtggaggttcggtggggggacggtcggtcgggtcccgggtccggtcggggggtccctggacgtactccgtccttgttctgtcgttcgtggtacttctaagttctttaagtaatctggctagttcgtccggtcgggtcccgtccgtacggtccgaggcccgagggtcgtagggtagtggggtcgacagtaatataactaaatacgtagagtagaactaaagttaaatatatagtaggatacctcgtagacggtcctatccactntcctacgagactaactaactacgaaacactagtagtagtacgtntaggaaactagtacgacctacgtcgacgacggacgaccgggtagtaacgtgggtttatttacgtaacggtggtacggtaaatacgtacgtgtacgtactacgtactcggtagttacgg

SEQ ID NO: 269235 - DNA, 836 bp, Homo sapiens
  misc_feature: GYAE6OF01A90TB.10.21.B10.1.454.CMB.1.raw
tcagcatagtagtgcacgaccggtgctcgatttagtgtcgtcgcaagaggagaggggggggagaggagcccagcactagaagtcggcggtgcctccattcggtgatcagcactgaacacagaggactcaccgatggagtttgggctgagtctgggttttcctcgttgtacttcttttaagagtatgtccagtgtcagatgcagagtgggtggagtcgtgggggaggcggtggtccggcgtgggggtccctgacgtactcgtccgttgttccgtggtccgttgtcggtactttctaagttccgtttaagttaaacttccgttagggcctaggttcgtccggtcggggttaccccgtccgtaacggtttcccgacgggtaccgacgggtaccgttagggtaacgtggggtcggacctaaggtaacgttaagtaactaaagttagttaggaagttaaggtaaccgtaaaaggtaaaacttagttaaacgtaggtagggaaacgtcccgttaccgttaacccgaaggggtacccttaacgttaccgtaactaaccggttacccttaaccggaaacggtaaccgggtaaaccttaacctttaaacccgaaacggtaaaacccttagggttaagggtttaccgttaacttaccggttagtaaaccggtaaacttaccggaacccgtacggtaacccgttagggaacccggtacgggtaaccggttaaccggggtacggttacgggttttaagtttacggaaccggttagggggtacggtaaaccttacgggttacgtacggggtactagtaacccgttacgttacggttaggttaacccggg

SEQ ID NO: 269236 - DNA, 832 bp, Homo sapiens
  misc_feature: GYAE6OF01BN6XK.10.21.B10.1.454.CMB.1.raw
  modified_base (406)..(406): a, c, t, g, unknown or other
  misc_feature (406)..(406): n is a, c, g, or t
tcagcatagtagtgcacgaccggtgctcgatttagtgtcgtcgcaagagaggagggggggaactgctcagttaggacccagagggaaccatggaagccccagctcagcttctcttcctcctgctactctggctcccagaccaccaccggataattgtgttgacacagtctaccacgccacgcttgttctttcgtcctaccgaaggggaaacacgcccaccctctccgtgacgacgggccagtacaggtacgttcgttccgcttacgtttcggttagggtgtatacgaactaagttaaacgtcccggaccaacggtccctacccgacggtccttcctactactttcgtttagtacgttcgtacctttacgaaccgtacccggggtccccttcgggtcccgtacccgnggtaccgtaggtttccgagggttcggcgtagggttcgggtaccgtcgggaactacggtacttctaccttccgtaccaacctacacgtaacggacctaacggtaccgtaacggtaccgtccgtttaaggtaaacgtttacgtttttagaacgttttaacgttttaacgtttaccgtacgttaccggtaacgttaccgtaacggttcggtaaccgttcccgttaacgggtttcccggggaaccggggttacgggttacccggttacccggttaccgggtttaccggggaacggtaaaccggtaaacgtaaaacggtacggtaaaccggttaaaccgaaacggtacggttcgggtaccggtacgttacgaaccgtaaacccgttgttaccgttacggttaaccttacccttacgttccccgtaaccccg

SEQ ID NO: 269237 - DNA, 864 bp, Homo sapiens
  misc_feature: GYAE6OF01C0D96.10.21.B10.1.454.CMB.1.raw
tcagcatagtagtgcacgaccggtgctcgatttagtgtcgtcgcaagagaggaggggggggagaggagcccagcactagaagtcggcggtgcctccattcggtgatcagcactgaacacagaggactcaccagtggagtttgggctgagtcgttgggttttcctcgttgcttacttttaagagatgtccagtgtcagatgcagatggtggagtcggtgggggaggcggttcgggtccggccggttcggggggtccctggacgtacctctccgttgttctgtccgttctggattctatttctttaagtaaatcgtaggctagttcggttcccgtcggggtcccgtaccgtacgggttcccgaacggtcccgaaggggtcgtagggtaaggttgggggtcgacgaaggtactaaactaacgtaaattagtaggtaacgttaacgaaacgttaaaaggttaaaacttaacgttaaacgttaaggtaacggtaacttacccttaccggttacggaaaccgggtacctactttaacccaaccgtacttacccgtaaccgaaaggtaaaccgtaaacccttaacgttaaacccgaaaaacggttaaacctagggttttacgggttttaaactacgttaaccgttaacggaaaacccttaaaacggttacccggaaacccgtccggttaaccggtacgggaaaacggtacccggggaaccgggtaaaaccgggttaaccgggtttaccgggggttttaatttttaaacccgttaacggggttaggggttaaacgggtaaaattaacccggtttcccgtaagggttaccgtaaacctacgtttaacccgtaccgggttttgtttaaaccggg

SEQ ID NO: 269238 - DNA, 696 bp, Homo sapiens
  misc_feature: GYAE6OF01APOKF.10.21.B10.1.454.CMB.1.raw
  modified_base (372)..(372): a, c, t, g, unknown or other
  misc_feature (372)..(372): n is a, c, g, or t
  modified_base (653)..(653): a, c, t, g, unknown or other
  misc_feature (653)..(653): n is a, c, g, or t
tcagcatagtagtgcacgaccggtgctcgatttagtgtcgtcgcaagagaggaggggggggagaggagcccagcactagaagtcggcggtgcctccattcggtgatcagcactgaacacagaggactcaccagtggtagtttgggctgagtcgttgggttttcctcgttgcttacttttaagagtatcgtcctagtcgtcagtacgtgctaaggtagttgggtggaggttcgggtgggggtacggtcggttcgggtcccgggtcgggttcggggggtccctaggacgtaccttccgttcgttgttcgtcgtcgtgtggtacttcgtagtttacttaagtaactcgtggtactagttcggtccgttcggtccncggtacggttcccgaggccgtacgggtgtacgggtagtcggggtagacgtaagtaagttacgtaaactaagttacgtagtaactaacggaaacttaaaagttaaaactacttaacgtagtacgaaccgttaccttccgttaacgggaacggttcctaacttccgactacttacgaacgtaagtaactaacctactaaccgaagtactgttagtactagtcgagtaacgtaatccggactagacgtagacgtacgccgtaaggtcgtacggtttattaacgnggtagaacggtatacgtcgtaggtcctagtatccgtgtgtacg

SEQ ID NO: 269239 - DNA, 728 bp, Homo sapiens
  misc_feature: GYAE6OF01CZ2MP.10.21.B10.1.454.CMB.1.raw
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
tcagcatagtagtgcacgaccggtgctcgatttagtgtcgtcgcaagagaggagggggggaactgctcagttaggacccagagggaaccatggaacgccccagctcagcttctcttccctcctgctactctggctcccagaccaccaccggagaaattgtgttgacacagtctccagccacgctgtctttgtctccgaaggggaaanacgcccaccctctcctgcgagggccagtcagngtcgtcgactacgttcggtagggtgtatacaactagtaaacgtccggaccacggcctacccgaggtcctcctntacttctttgattcgtctttaccgaacgccgggtcccctcggccgtacccgaggcgtaggttacgaggtcggcgtaggttcggtcgtagggacaggtacctttacgacctcctaccacctagtcgacgtccgacgtccgtaagaccgtaccgttaagtaacgtttagttttacgtacgtttaaggtttttaactccgttacgtacgacgtaccgacggtccgttaccgtacccttacgggtttccgggacggtacgggttcccgtacccgttacgggttaccggggaacgggtaacgggtaacctaaaaggttaccggaaacggttaaccgaaaaggtaccgttgggtacgtccgtaccggacctaaacccgttgttccggttacttacgttaccctacgtttcccccgtaccccg

SEQ ID NO: 269240 - DNA, 859 bp, Homo sapiens
  misc_feature: GYAE6OF01CMH1L.10.21.B10.1.454.CMB.1.raw
tcagcatagtagtgcacgaccggtgctcgatttagtgtcgtcgcaagagaggaggggggaactgctcagttaggacccagagggaaccagtggaacgccccagctcagcttctcttcctcctgctactcgtggcctcccagaccaccgaaccggagtaaattgtgtagacacagtcctcacgccacgcttgttctttcgtctaccggaaggggaaacacgccctaccctctccgtgacgacgggcctagtacgaggtagttcgttacgcttacgtttacggtaggggtacgtaactaacaaacgtaacgttaaacgtcccgggacctaacggtcccttacccgaggtcccttacctactagtttcgtttacgacgtttcgttaccgtttaaccgaaccggtcccggtccccgttacgggtcccgtacccggtagggtacccgttaagggttcgtacgggtacggaaccgttgggggtcggttaccggaagggaaccctacggttaaccgttttaccacccgtttcctaacccgtaacccgtagtaccggaacgacccgtacggtaccccgttaaggaacccgttaccgtaagggtttaaaccgttttgttttaccggtaacgttttaacgttttaaaccgtttcggtacgtacggtacgttaccgggtacgtttacccggtacgtttacccggttacgggtttccggggaacggtttaccgggtcccttaacccgggttaccgggttaccggggaaaccgggtaaccgttaaaccgtaaaggtccggtaaggtaaaccgaaacggtcgtgggtccacgttacgaccctagtcgttacttcgtactctaccgtcctaccg

SEQ ID NO: 269241 - DNA, 777 bp, Homo sapiens
  misc_feature: GYAE6OF01A90XO.10.21.B10.1.454.CMB.1.raw
  modified_base (166)..(166): a, c, t, g, unknown or other
  misc_feature (166)..(166): n is a, c, g, or t
  modified_base (205)..(205): a, c, t, g, unknown or other
  misc_feature (205)..(205): n is a, c, g, or t
  modified_base (269)..(269): a, c, t, g, unknown or other
  misc_feature (269)..(269): n is a, c, g, or t
tcagcatagtagtgcacgaccggtgctcgatttagtgtcgtcgcaagagaggagggggggaactgctcagttaggacccagagggaaccatggaagccccagctcagcttctcttcctcctgctactctggctcccagaccaccaccggagaattgtgttagacanagtctccagccacgtctgtctttgctacgaggggaaacncgcctacctctcctgccgagggcctagtcgaggtagtcgttcgacttacgttcggttaggggtntatacaactaataacgtccggacacggtcctacccgaggtcctcctacgttacttcgtttagaactcgttacctttacggaaccgtacccggggtccctcgggtcccgtaccggacgggtacgttacgggttaccgagggtacgggctacgggggttcgggtacggtacgggtaacgtacgttacctttccgtactccgtacaccgtacgtactcgaccggccacgtacggtaacctaccggtagtaactttcgtttacgtactttacgtttaataccggtacgtacgtacgacgttacgtcggtaccgtaccggtaccgggtttcgggaccgggttaccggtacggtaccggttaccgggtttacgggaaccgggtaacggtaaaccggtaaagtaccggggtaacgttaccggaaaaccggttaggtacggtacggtaccgtacgtaccggtaacgttccgtaacgggtttccctttagttacccgttccgttccccggttacccg

SEQ ID NO: 269242 - DNA, 633 bp, Homo sapiens
  misc_feature: GYAE6OF01BMPFR.10.21.B10.1.454.CMB.1.raw
  modified_base (208)..(208): a, c, t, g, unknown or other
  misc_feature (208)..(208): n is a, c, g, or t
tcagcatagtagtgcacgaccggtgctcgatttagtgtcgtcgcaagagaggaggggggaggaactgctcagttaggacccagagggaaccatggaagccccagctcagcttctcttcctcctgctactctggcctcccagaccaccgaccggagaaattgtgttgacacagtctccagccacgctgtctttgtctccgaggggaaancgccaccctctcctgccgacgggccctagtccaggtagttcgttccgctacgtttcggttagggtgtactcaacaattaaactccggccaaggcctcccgaggctcctcattcttgatgtctttcaacgacggccctggccgtcccgaggctaggttcaggtcggcgtaggtgggtctgggacagtaccttcactctcgacctatccagcaacgtcctagccgctagaatttacgtttgtacgttttattacgtgtacgaagtctacggtcgtacgcctacgtcggtcccttcggtccccgtttacccgttcccggtcccgttaacgggacccgtaaggtcgtaacttacgtaccgaaacggtacgtggttacgacgtcgtacctacgtactcgttacgttacctcctacgttcccgttaccccg

SEQ ID NO: 269243 - DNA, 932 bp, Homo sapiens
  misc_feature: GYAE6OF01BQWBT.10.21.B10.1.454.CMB.1.raw
  modified_base (205)..(205): a, c, t, g, unknown or other
  misc_feature (205)..(205): n is a, c, g, or t
tcagcatagtagtgcacgaccggtgctcgatttagtgtcgtcgcaagaggaggagggggggaactgctcagttaggacccagagggaaccatggaagccccagctcagcttctcttcctcctgctactctggctcccagacaccaccggagaaattgtgttgacacagtcctccagccacgctgtctttgtctccgaggggaaancgcccaccctctcctgccgagggccagtcagtagtgtccgctacgttcggtagggtagtatacaactaataaacgtccggaccaggcctacccgagcctcctctattctttgatcgtcctttacgaaccggaccggtcccctcggccgttcccgaggtcgtacggttcaggtggccagggttcgggtacgtacggggactacggtacctttccgaacttccgtaaccctaacctacgttaccgaacggtaccgtaaccggtacccttaaacgggccgttaacccgttaggggttaaaacggttttacggtttttttaccggggttaaccggtttttttaacgttaaaccgtttcgggtttaacccgtaaggttaacccgggtaacgggtccccgggtttaacccgggaccccggttaacggtttccccgggggtaccccgttttaccggggtttccccccggttttttacccccccgggtttaccgggggtaccccccggtttaaaaccggggggttaaacccccgttaaaagggggtttacccggtaaaaccgttaaacccggttaaaaccgggtaaaaaaccggtttaacccggggtttgggtaaccccggggttacccgttacccggtaaaccccgttaaaccccgttaaggttttccccgttttacgggttaaccccttttacccggttaaccccttttcccccgttacccccgggtaaaccc

SEQ ID NO: 269244 - DNA, 773 bp, Homo sapiens
  misc_feature: GYAE6OF01CBFEM.10.21.B10.1.454.CMB.1.raw
  modified_base (221)..(221): a, c, t, g, unknown or other
  misc_feature (221)..(221): n is a, c, g, or t
  modified_base (444)..(444): a, c, t, g, unknown or other
  misc_feature (444)..(444): n is a, c, g, or t
tcagcatagtagtgcacgaccggtgctcgatttagtgtcgtcgcaagagaggaggggggaactgctcagttaggacccagagggaaccatggaagccccagctcagcttctcttcctcctgctactctggctcccagaccaccaccggagtaaattgtgttcgacacagtcctaccagcccacgtccttgttcttttcgtccgtaccggaagggggaaacnccgtacccctacccgtcctccgtggccgaacggggccagtaccaggtacgttcgttccgacttacgtttcgggttaggggtagttaactacgaaaccgtaacgtaaaccgtccgggacctaacggtccctaccccgaggtccctcctccgtattctttgacttcgtactttaccgaaccgccggtcccgtggccctcccgaggtcgtacggttcgaggtcggngtacggtcggtcgtagggactagtacctcgactcgtaccacctagtcgagtccagtcctaaggcctacgttagaactttgtttacgacgtttaagtttaacttacgttcgtacgacgtacgtcgttccgtaccgccgttaccggttcgggacggtaacggtccgtacccgttacgggtaccgggaacggaaaccgggtaaacctaaagggaccggtaacggtaaaaccgtaaaccggtacggttacgggttaccggcgtaacccgtaacctacgttaaccgttccgtttacgttacctttaaccgtaccccgttccccggtttaacccc

SEQ ID NO: 269245 - DNA, 698 bp, Homo sapiens
  misc_feature: GYAE6OF01DZH6W.10.21.B10.1.454.CMB.1.raw
  modified_base (612)..(612): a, c, t, g, unknown or other
  misc_feature (612)..(612): n is a, c, g, or t
tcagcatagtagtgcacgaccggtgctcgatttagtgtcgtcgcaagagaggaggggggggagaggagcccagcactagaagtcggcggtgcctccattcggtgatcagcactgaacacagaggactcaccagtgggtagtttgggctgagtcttggggtttttcctcgttgcttacttttaagagatgtccagtgtcagatgacgagagtgggtgggaggttcggtgggggggagggccgggttcgggtccccggggtccgggttacggggggggttcccctgggtaacggtacccgttccgttccccgtttggttccgtggtcccggtttcgttgggtaactttcttaatttaccgttttaaggttaaaacttccgtggctagttcggtcccggttcggggtcccggacccgtacgggttcccgaacgggcccggaacgggtcgtacgggtaaggtcgggggtcggactaagtagtaactaacgtaatagtagaactagtaacaaagttaaaatattacgtagtacggagtacctcgttacgaacgggcctatcacctatacctacagacaactaataccaaagtactagtgtatactcgtagactaaanacgacagtcgaggagacggcgaggtacgtaggtgtttatcgtaaggtcggaaagtactacgtgtcgacgtatcgtacgttggtacg

SEQ ID NO: 269246 - DNA, 703 bp, Homo sapiens
  misc_feature: GYAE6OF01B24V2.10.21.B10.1.454.CMB.1.raw
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagacaccaccggagaaattgtgttgacacagtctccagccacgctgttctttgtctccgaggggaaagcgcccaccctctcctgcacgggccagtcagagttgttccgctacgttcggttaggggtggtatacaactaattaaacgtccggaccaggtcctcccgacggtccttccctctacttctttgattcgtcctttacgaaccgaccgggtccccgtggcccgtcccgaggcgtaggttcgaggtcggcgtaggtcgggtcgtgggactacgtacttcgactctcacctatcgacgcacgtccgtacgacgtccgtagtacgttatttacgactttaagtttacttacgttcgtcgacgtcgtagccggttcgacccgttacggtttcgggccgggtagggttccgtcccgttacgggtttccggggaacgggtaaccgggtaaaccgtaaacggttaacgggaaaccgggttaaccgaaaacgggttaccgtcgggtacgggtccgtaaccgtaccgtaacccgttacttccgttacggtttccttacccggttacccg

SEQ ID NO: 269247 - DNA, 1092 bp, Homo sapiens
  misc_feature: GYAE6OF01E0MHL.10.21.B10.1.454.CMB.1.raw
tcagcatagtagtgcacgaccggtgctcgatttagtgtcgtcgcaagagaggagggggggaactgctcagttaggacccagagggaaccatggaacgccccagctcagtcttctctttcctcctgccttactcgtacgcctacccagaccaaccgacggaataagttgttgttagacactacgtcctaccgacgcctacgtcgtcgttctttcgtaccgtacggaagggaaacgtccgaccctacccgtctccgacggaccgacgggacctaggtacgaacggttaggttccgtccgtacgttacggtttacgggttaagggttacgtaactaacgttaaacgaaaccgttaaccggtcccgggtaacctaaaccgggtccccttacccggaacgggtttcccttacccgttacggtattttacccggttttaaggaccgtttccggttaacccttttaaaccgggaaaccccgggtccccgggttacccccgggttaccgggtaccccggttaaccgggtaacggggtacccggtttaagggtttacccggtaaaggggtccgggaaccgggttttaccggggggttaacgggttaccggggtaaaccggggtaaaccgttaaccggtttaacccctttaacggttaaccccttttcccggaaacctttaaaacccggtaccggtacgaaacgggttaacccgtacggtaacccggttaaacggtacccgggttaaccgtttaacgggtaaacgttttttcggttaaccggtttaaacgtttaacggtttttacgaaccggttacgggttaccaaccggtacggtacccggggttaccggttaacgttacccgggtttaccgggttaacggggggtacccgggtaaccggttaccggttacccccggggtttaaggggttaccccgggggtaaaacggggtaaaccgttaaaaccggtaaaacggtaacggggttaaaccggggtaaaaccttaaaccgggtcgggtttaccggaggttaccgtaccggtaccgtaacgtttaccgtttctaaccggtttcccgttacgttaaccccgtccgttaacccgg

SEQ ID NO: 269248 - DNA, 882 bp, Homo sapiens
  misc_feature: GYAE6OF01DAD2Y.10.21.B10.1.454.CMB.1.raw
  modified_base (226)..(226): a, c, t, g, unknown or other
  misc_feature (226)..(226): n is a, c, g, or t
  modified_base (520)..(520): a, c, t, g, unknown or other
  misc_feature (520)..(520): n is a, c, g, or t
tcagcatagtagtgcacgaccggtgctcgattttagtgtcgtcgcaagagaggaggggggaactgctcagttacggacccaggagggaaccagtggaacgccccagctcacgtctttctccttcctcctgctactctgctccagaccaccgacggagtaattgtgttgacacagtctcgacgccgacgtcgttgttcgttttcgtaccgtaccggaaggggaaacncgtacccctaccctctccgtcgaccgacgggaccgtagtacgaggtagttcgttacgaccgtttacggtttcgggtttagggtgtaacctaacgaaaacgttaacgtaaaccggtcccggaccgtaaccggcccttacccggtacggtcctaccttacgtacgtttcgtttagtacgtttcgttaacctttaccggaaccggtcccggttcccggtacggtcccgtaccgacggttaccggtaggttacgtaggtcggtacggtgggtcggtcgtacgggaactcgtacgttcnccgtctaaccgacgtacgtacgacgtaccacggtaccgacgtcgtacgtaacgttagttacgtttacgttagttttaacgttacgtttacgtacgtacttacggtaccgtacggttacccgttccgttacccggttacggttaccggggtacgggtacggtttcccggttaaaccgggtttccccgggttaaggggtaacccgggttaaaaccgggttaaaccgtaaacggtttacgggtaaaccgtaaaacccggttaaagggttacggttaacgggacccgttccgttaaaccggtacccgttaccgtttattcccggtttacttacccgtttaaccgtttccgtaccccgttaccccgg

SEQ ID NO: 269249 - DNA, 751 bp, Homo sapiens
  misc_feature: GYAE6OF01AZAFA.10.21.B10.1.454.CMB.1.raw
  modified_base (255)..(255): a, c, t, g, unknown or other
  misc_feature (255)..(255): n is a, c, g, or t
tcagcatagtagtgcacgaccggtgctcgatttagtgtcgtcgcaagagagggggggagagccctgggggaggaactgctcagttaggacccagagggaaccatggaagccccagctcagcttctcttcctcctgctactctggcctcccagacaccaccggagaaattgtgttgacacagtctccagccacgcttgttctttgctccgaggggaaagcgcccaccctctcctgcgagggccagtcagtgtgtcnctacgttcggttagggtgtatacaacataacgtccggccacggcctcccgagtcctcctctacttctttcgattcgtacctttacgaacgtaccgggtccccgtggcccgtacccgacgggtccgtacgggttcaggtcggcgtacggggttgggtcggtaggggactacggtaaccttcgacctttccgtacctacccgtatccgagtccgaacggtcccgtaaggccgtaccgtagtaaacgtttgtttttacgacgtttaacgtttttaacttacgtcgttaccgacgttccgacgtccggttacgtccgttaaccggtttcgggggacgggttacgggttcccggtacccgttacggggtttacccggggacggggtaaaccggggtaaaaccctaaaagggttacgggtaaaccgggttaaacccgaaaacgggtacgttccgggtggtacccgtacggaccctaacgttacttccggttaaccgtttccg

SEQ ID NO: 269250 - DNA, 769 bp, Homo sapiens
  misc_feature: GYAE6OF01EYV0L.10.21.B10.1.454.CMB.1.raw
tcagcatagtagtgcacgaccggtgctcgatttagtgtcgtcgcaagagaggaggggggcctccattcggtgatcagcactgaacacagaggactcaccatggagtttgggctgagctgggttttcctcgttgcttcttttaagagtatgtccagtgtcagatgcagagtggtggagtcggtggggggaggcggtgggtccgggccggtcggggggtccctggacgactctcctgttcgtgcgtcgtgtattctattactttagtaactctggctgtcgtccgtcgggtcccgccgtacgggttcccgggccgacgggtcgtagggtaaggtggggtggcgaagtataactaactaattatagaatagaaactaaagtaaaaattattaacgtaagtaggtaactaccgttaccgttacggaaacgggtacctaacttaccaacctactaccacgtaacgaacgtaaactaacttacccgaaagtaaccgtagtggttataacgtacgtagaactaacgtaccgaacctacggtaccgtaaggaacggaccggaccgggtaacggtaccgggttaaggggtttacttttaacggtacggttaggggtaagggtaaacgttaacgttcggtaacggtagaccgttacgttacccggtacgtttaggtttacggtttacgggtaccgggttaccccggggtcccggggaaccggtaaccgggggtacccggttcggtaccccgtacccggtttcgttccccggtaccccgg

SEQ ID NO: 269251 - DNA, 702 bp, Homo sapiens
  misc_feature: GYAE6OF01AQQYG.10.21.B10.1.454.CMB.1.raw
  modified_base (358)..(358): a, c, t, g, unknown or other
  misc_feature (358)..(358): n is a, c, g, or t
  modified_base (656)..(656): a, c, t, g, unknown or other
  misc_feature (656)..(656): n is a, c, g, or t
tcagcatagtagtgcacgaccggtgctcgatttagtgtcgtcgcaagagaggaggggggaggaactgctcagttaggacccagagggaaccatggaagccccagctcagcttctccttcctcctgctactctggctccagacaccacggagaaattgtgttgacactagtcctccagccacgtcttgttctttgctaccggaaggggaaacacgcccaccctctccgtgcgaggccagtcagtgtcgttcgctacgtttggtagggtgtactacaacaataacgtccggaccgaggtcctaccgaggtcctcctctacttcgttagtacttcgtcttaccgaacgtccgggtacccgngggtaccgtccgaggtcgtacggtacgtagggtcggaccgaggttcggggtacgtacggggaactacgttacccgttactaacccgtcctaacccgaactactaccgacgacgtaccgtacctacgacgtaccgtagtaacgttatttacgactttaagtttactgtacgtactagtaacttgtacgagttcggtcgtccgttaccgttaccggttaaccttacggtttaccgggaacgtaaggtaaccgtaaggtaccgtaaataccggtaaaaccgtacggtacttgggcttaccncgtaacctccgttagttcccgttattaaccctcgtaaccgttcccc

SEQ ID NO: 269252 - DNA, 782 bp, Homo sapiens
  misc_feature: GYAE6OF01B92YK.10.21.B10.1.454.CMB.1.raw
tcagcatagtagtgcacgaccggtgctcgatttagtgtcgtcgcaagagaggaggggggcctccattcggtgatcagcactgaacacagaggactcaccatggagtttggctgagcttgggttttcctcgttgcttcttttaagagatgtccagtgtcagatgacagtagtgggtggaggtcggtggggggaggtcggtcgggtcccgggtccggttcggggggtccctggacgtaccttccttccgttgttcctggtccgttcgtggtacttctacttacgttttaaagtaacttcgtggtacctagttcggttcccggtcgggtccccgtaccgtacggttcccgaacggccccgtaacggggtcgtagggtaaggtggggtcggactaaggtaattactaacgtaattagtagaacttacgaaacgttaaaagttaaaaacttacttaacgtaaggtaggtaaccgtaaccgttacccgttaacggaaaccgggtcccgtaattcccaacctacttccgtaccgaagtaacgtaacctaacttaccgaaagtaacgtagttacggttatactcgtacgaactaacgtcgaaccctgccgtaggacgtacggaccggtaaggtaaccggtagggttttagttacgttacggtagggtaaggtaaactaacgttccgtaggttcggaccttacgtaccgtacgttgttagttacggtacgtaccgggtacccgggtacgtaacggggtacccgttacggtcccgtaccgttccgttcccgg

SEQ ID NO: 269253 - DNA, 936 bp, Homo sapiens
  misc_feature: GYAE6OF01D8MN7.10.21.B10.1.454.CMB.1.raw
  modified_base (220)..(220): a, c, t, g, unknown or other
  misc_feature (220)..(220): n is a, c, g, or t
tcagcatagtagtgcacgaccggtgctcgatttagtgtcgtcgcaagagaggagggggggaactgctcagttaggacccagagggaaccatggaacgccccagctcagtcttctcttcctcctgcttactctcggcctcccagaccaccgacggagtaattggtgttcgacacagtcctccagccacgtcttgttctttagtcctacggaaggggaaacncgccccaccctctccgagcgacgggccagtcgagtagttcgtcgacttacggtttcggttaggggtacgtactacaactaacgtaacgtcccggaccgacggtcccgtacccgaggtcccttccgtactactttccgtttagtactttccgtacctttaacgaaccggtccggggtcccgtcggaccgtcccgaggtcgtacggttacgtgggtcggtacggtaggggttcgggttaccggacggggtactaacggttaccctttaccgtacctttaccgacctaaacccgtagttacccggaacgtacccggtaaccggtaccgggttaacggtaccggtaaccggtttaaagggttaacgttttaaccggtttttaggtaaccgtttttaaacggtttttacgtttaaccgttcgggtttaacccgtaacggttcccgtaaccgggtttaccggtttacccggttacccgggtttaaacgggggtttcccggggtaacgggtttacccgggtttacccggtaccccgggggttttaaccgggttacccgggggaaaccggggttaaaacccgggtaaaaccggttaaaagggttaccggggaaaccggtaaccgtaaaaccgggtcggttacgggtaccgtacggtaacccgaccgttaacctcggtttacccttacgtttacccgttaccgtttcccgcccccgggtttaacc

SEQ ID NO: 269254 - DNA, 591 bp, Homo sapiens
  misc_feature: GYAE6OF01DFEIM.10.21.B10.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (340)..(340): a, c, t, g, unknown or other
  misc_feature (340)..(340): n is a, c, g, or t
tcagcatagtagtgcacgaccggtgctcgatttagtgtcgtcgcaagagaggagggggggaactgctcagttaggacccagagggaaccatggaagccccagctcagcttctcttcctcctgctactctggctcccagaccaccaaccggagaaattgtgttgacacagtctccagccacgctgtctttgctcgaggggaaanacgccaccctctcctgcagggccagtcagngtgtcnctacttcggtagggtgtactacaaacataaacgtccggacaggcctcccaggctcctcatctttgatcgtcttcaacgcgggccctggccgtcccgaggtntacggttcaggtcgcaggtggtcgtgggacaggacttcactctacactatcagcacgtctaagacgccgtagaagtatttacgtacgtaactttaagttacgtgtacgagtacgagtcgtcgtcctacggtttcggacgggtacggtcgtaccgtacgtttcgggacgggtaacggtaacgaaaagtacgaacggtacgaaagtacgtagtagcgtgacctacgactcgttacgtacttctctccgtcccg

SEQ ID NO: 269255 - DNA, 824 bp, Homo sapiens
  misc_feature: GYAE6OF01CYLI7.10.21.B10.1.454.CMB.1.raw
tcagcatagtagtgcacgaccggtgctcgatttagtgtcgtcgcaagagaggagggggcctccattcggtgatcagcactgaacacagagactcaccagtggtaggttggctgagtcgttcggtttccttcgttcgtcttacgtttaagagtagtcgtaccgtagtcgtacgagatgagagtaggtgggtacggaggtcgggtagggggtcggtcggtcgggtcccgggtccgggtcggggtccgtaggtacgtcctccgttcgttcgttcgtcgtacgtcgtaggtacttacttagttacgtttaagtaacgttcgtcggacttacggttccggtccggttccgggtacccgtaccggttaccggttcccggacgggtacccggtaccgggtgttagggaacgggtttgggacgtactagtaataacgtataagtatagactaagaaacgtaataaacgttataaggtacgaacgtacctacgttacgtaccggaacggtcctaagttacccaaagtaccgtacccgtaagaaaccgtaagtaaccctaaaacgtaaccgaagttaagtcgttagtacgtataacggactaaacgacgtaccgtacgacgtaaccgtagaacccggacggtacggtaaacggttaacgtttgggttaactttaaccggtagtaaacgggtagggtaactttaaaccgtcggacgttagaccgtaccgttacgtaaccggttggtaacgttacccgggtccggttaaacccgggcccggggtaaaccggttaacggtacttccccgggtaacttccccgtcgggttaacccccg

SEQ ID NO: 269256 - DNA, 836 bp, Homo sapiens
  misc_feature: GYAE6OF01CCXKN.10.21.B10.1.454.CMB.1.raw
  modified_base (737)..(737): a, c, t, g, unknown or other
  misc_feature (737)..(737): n is a, c, g, or t
tcagcatagtagtgcacgaccggtgctcgatttagtgtcgtcgcaagagaggagggggggagaggagcccagcactagaagtcggcggtgcctccattcggtgatcagcactgaacacagaggactcaccatggagttggctgagtcgttgggttttcctcgttgtcttacttttaagagtatgtccagtgtcagtatgcagagtgggtggagtggtgggggagtcggttcgggtccggcggttcgggggtccctagacgtcttctcgttcggttctcggtcgtaccgttggtactttcgtattactttaagtaacgtcgtaggtactagtcgttccgtacgggttccgccgtacggttcccacggtacccggtaacgggtcgtagggaacggttcggggtagacgtaacggttaataacgttaactaagttagtaggtaacttaacggtaactaaaagtttaaaacgttaattaaccgtaaggttacggaaacgtttacccgtttacgttaaccgggaaacgggttacccttaacttaccgtaaccctaggttaaccccgtaccgtaaaggtaccctaaacgtaaaccgttacccgaaaaacggtacttaaacggttcgggtaaatttaaccgaacggttaaccaaacggttaatcccgggaaacccgtacggtacccgtaagggaaaccccgtacggtaaccccgggacgggttaacgttaaaccgggggttttnttaaacggttcgggtttaaggggaacggtaaaacggtcgtttaaagtccggggttaaaccaacgtttaccgttaacggtcggtttaaagggttacccgg

SEQ ID NO: 269257 - DNA, 805 bp, Homo sapiens
  misc_feature: GYAE6OF01DTPQ9.10.21.B10.1.454.CMB.1.raw
  modified_base (234)..(234): a, c, t, g, unknown or other
  misc_feature (234)..(234): n is a, c, g, or t
tcagcatagtagtgcacgaccggtgctcgatttagtgtcgtcgcaaggagaggaggggggggagaggagcccagcactagaagtcggcggtgcctccattcggtgatcagcactgaacacagaggactcaccagtggtagtttgggctgagcgttgggtttccctcgttgcttacgttttaagagtactgtccagtgtcagtatcgcagtgtgggtggaggtcggtaggggggnggtccggttcgggtcccgggtccggtacggggggtccccttggaacgtccttccttccgttgttcgtcggcgttccgtggtacttcaagtttacctttaagtaaactcgtaggtctagttcgttccgtcgggttacccgaccgtaacgggttaccgaaccgggcccgtaaccggggtccgtagggtaacggttcggggtacggactaacggtaagttaacgtaacgtaatagtacgtaacgtacgaaacgtaaagttaaaacgttactaaccgttaaggtacggaacgttaccgtacccggtttacggaacggggttccctaacgtttacccaaccgtaacttacccgtaccgtaacggtaacgtaaacccttaacgttaccccgtaaaagtaacgttaaggtttcgggttaagtacgttcgtaagaacgtaaccgtcgaacccgtacgtccgtacggagtaccggaccggtacggtaccggttacggtttacgtttaccggttacgtgggttaacggtaagttaaaccgttccggtacgtggtacctaacttccggtcgttggtttacgg

SEQ ID NO: 269258 - DNA, 739 bp, Homo sapiens
  misc_feature: GYAE6OF01DU7SV.10.21.B10.1.454.CMB.1.raw
  modified_base (210)..(210): a, c, t, g, unknown or other
  misc_feature (210)..(210): n is a, c, g, or t
tcagcatagtagtgcacgaccggtgctcgatttagtgtcgtcgcaagagaggagggggggggaggaactgctcagttaggacccagagggaaccatggaagccccagctcagcttctcttcctcctgctactctggcctcccagacaccaccggagaattgtgttgacacagtctccagccacgctgtctttgtctaccgaggggaaacncgccctaccctctcctgccgacgggccagtcaggtacgtgttccgctacgtttcggttaggggtgtatcaacaattaaacgtccggccaggcctccaggcctcctcattctttgatgtcttttacgaacgtacgggcccgtcggccgtcccacggcgtacggttacaggtcggcgtacggtagggtcgtaggggacctagtaccttcaccgtcctaccacctactcgaacgtaccgacgtaccctaaggaccgtaccgttaggaaagttacgtttttcggactttagttttaacttacgttgttacctacggtcgacggtccggtacgtacccgttacggtttccggggacgggtacgggttccgtacccgttaccggttttaccggggacgggtaaccgggtaaaccgtaaaacggttacgggtaaacggtaccggtaaaacccggtacgttacgggtacgggtaccgttacggtacctaacccgtacgtttaccgttcgtttaccgttcccgtacgtttacccccgg

SEQ ID NO: 269259 - DNA, 799 bp, Homo sapiens
  misc_feature: GYAE6OF01C8M1E.10.21.B10.1.454.CMB.1.raw
tcagcatagtagtgcacgaccggtgctcgatttagtgtcgtcgcaagagaggaggggggagagccctgggggaggaactgctcagttaggacccagagggaaccatggaacgccccagctcagcttctcttcctcctgctctctggcctcccagaccaccaccggagtaaattgtgttgacacagtcctccacgccacgtcttgtcttttgtcctaccggaaggggaaacacgacccaccctctcctgacgacggccagtcaggtagtcgttcgcgtacgtttcggttagggtagtactacaaactaataacgtccggacgacggtccctccgacggtcctacctctattcgtttacgattcgtacctttacgaaccggtacgggtcccccgtgggcccgtaccggacggtacgttacggttcgaggtcggacggtgggttcgggtacgtacgggaactacgtacctttcaccttcctaccgactactcgacgacgaccgtctacgacgtcgtaaggtaacgtttagtttacgacgtttaagttttactacgttacgtacgtaacggtcgtacgggtaacgttccggtaacccgtttaccggggttttacggggaccgggtacggtttaccgtacccgggtttaaccgggtttaccgggggaaccgggtaaaaccggggtaaaccctaaaaacgggttaaccgggggaaccgtttaaaacccggggtaaaaccgttaacggtcgggttaaccggtccgttaaccggacccttaaacgtccggttacccgtttaacccgg

SEQ ID NO: 269260 - DNA, 901 bp, Homo sapiens
  misc_feature: GYAE6OF01AQVV9.10.21.B10.1.454.CMB.1.raw
  modified_base (215)..(215): a, c, t, g, unknown or other
  misc_feature (215)..(215): n is a, c, g, or t
  modified_base (481)..(481): a, c, t, g, unknown or other
  misc_feature (481)..(481): n is a, c, g, or t
  modified_base (596)..(596): a, c, t, g, unknown or other
  misc_feature (596)..(596): n is a, c, g, or t
tcagcatagtagtgcacgaccggtgctcgatttagtgtcgtcgcaagaggaggaggggggggggaggaactgctcagttaggacccaggagggaaccagtaggaacgccccagctccagcttctccttcctcctgcctactctcggtcctacccacgaccaccgaccggtaagtaacttgtgttacgacacgtcgtctccgaacgcctaccggtnttacgttccgtttacggctaaccgggaacggggaactaccggtcccctaacccggttccttccgcggaccggtacgggtaccctaggtccgtaaggccggtttcggtacctcgtaacgtttacgggttaggtacgtacgtaccaaactaacgtaaaccggtccggaacggtcgtacccaccggtgtacctccggtactctttaccgtggtactaccggtttacgttaccgaacgggtccgggtccctacgggtacccgttaccggnggtaacgttaccgggttacgggaggttccggtaaccggttcgggggttcgggttacccgtagggtaccgtaacctttccccgaaagtacccttcccgggtaaactaaacccggtnaaccggtaaacccggcttacccgggtaccgtaagtacccggtaccggttaacggttacgtttacggtttaccgtaacgttaacggttttactacggttacggtacgtaccggtacgtaccggtacggttccgtaccggttcgggtaccgggtacggttccggtaccgggtccttaccggggttacgaaccggggtaaacgtaaccgtaaggtaaccggaaccggtaagtaaccggtacggtacggaccggtcgttaaccggccttacggttacgccggttataacccgttctacccgttacccgg

SEQ ID NO: 269261 - DNA, 790 bp, Homo sapiens
  misc_feature: GYAE6OF01AW0MI.10.21.B10.1.454.CMB.1.raw
  modified_base (162)..(162): a, c, t, g, unknown or other
  misc_feature (162)..(162): n is a, c, g, or t
  modified_base (207)..(207): a, c, t, g, unknown or other
  misc_feature (207)..(207): n is a, c, g, or t
  modified_base (291)..(291): a, c, t, g, unknown or other
  misc_feature (291)..(291): n is a, c, g, or t
tcagcatagtagtgcacgaccggtgctcgatttagtgtcgtcgcaagagaggagggggggggaggaactgctcagttaggacccagagggaaccatggaagccccagctcagcttctcttcctcctgctactctggctcccagacaccaccggagaaattgngttgacacagtctccagccacgctgtctttgctccgaggggaaancgcctaccctctccgtgcgacgggccagtcagagtgttcgccagttcgttagggtcgtatcaacataaactccggccagggccncccgaggcctcctctagtctttgatcgtctttaccgaacgcgggtcccctcggccgtccccgaggcctaggttccaggtcggacgaggttcgggtcggttacggggctacggtaccttacgaccttcccgtccaacccgtatacccggagccgtaacgtcccgtaacggtaccggtacccttaagggtaacgttaacttttttacggaccgtttaaggtttttaaacctttaccgtttacgggtaccctaacgggaccgtacggtccccggttaggtccccgttaaccgggttttccggggaaccgggttaccgggttccggtaccccggttaccgggtttaccggggaaccgggtaaccggggtaaacctaaaacgggttaccggtaaaccgggtaaaccgaaaaccgggtacgtacgggttacgggtccttccgggtaacccgacccgtttaacgacccggtttccgttacccgttccgttaccccgtttaccccgg

SEQ ID NO: 269262 - DNA, 919 bp, Homo sapiens
  misc_feature: GYAE6OF01A3BII.10.21.B10.1.454.CMB.1.raw
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
tcagcatagtagtgcacgaccggtgctcgatttagtgtcgtcgcaagagaggaggggggaggaactgctcagttaggacccagagggaaccatggaacgccccagctcagtcttctcttcctcctgctactctggcctcccgagacacccacggagaattgtgttnacacngtctccacgcccacgtcttcgttcgttttcgtcgtaccggaaggggaaacgaccgtcccctaccccgttcgtcccgtcggaccgacggggcctacggtcgaaggtacggttgtccgccgttacggttttcggggttaggggttggtactacgtaaactaacgttaaaccgtcccggaccgtaccggtccctacccgtacggtccccttccctactacgtttacttgtacgttcgttacctttaccggaaccggtacccggggtccccgtcggggtaccccggtaccgacgggttaccgtacgggttaccggacgggtcgggtacggttagggttccggggttacgggtaaccggggaccgttaaccggttaccttaccgttaccctacctacccgtaccctacgtacgaccggtacgtaacccggtacgtacggtaccgttaacgtacggtttaacgttacgtttacgtaacgtttaacgttttaaccgttcgtacgtttaccggacgttaccggtaccgggttaccggttccgtcccgggtttaccgggttcggggtaaccggggtcggttacccgggtacccggttacccggggttaccgggggaaccgggtaaccgggaaaacggttaacgggtaaccggttaaaccgggtaacgtaaaccgggttacggtccgggttaacggtcgaacccgtacgttacgtaaccggttcgttaccgtccctttaaccgttcccgttaccccgg

SEQ ID NO: 269263 - DNA, 329 bp, Homo sapiens
  misc_feature: GYAE6OF02IJV3F.10.21.B10.1.454.CMB.1.raw
  modified_base (316)..(329): a, c, t, g, unknown or other
  misc_feature (316)..(329): n is a, c, g, or t
tcagcatagtagtgcacgaccggtgctcgatttagtgtcgtcgcaaggagagaggggagagtgttagagggggcacttctccctctaacactctcccctgttgaagctctttgtgacagacttcactctcaccatcagcagcctagagcctgaagattttgcagtttattactgtcagcagcgtgccactttcggcggaggtgccactttcggcgagggaccaaaatagaggtcaaacgaactgtggctgcaccatctgtcttcatcttccgccatctgacactactatgctgagcgggctggcaaggcgcatagnnnnnnnnnnnnnn

SEQ ID NO: 269264 - DNA, 598 bp, Homo sapiens
  misc_feature: GYAE6OF02FXTHI.10.21.B10.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagaggagaggggggaactgctcagttaggacccagagggaaccatggaagccccagctcagtcttctcttcctcctgctactctggctcccagacaccaccggagaaattgtgttgacacagtctccagccacgctgtctttgtctccaggggaaangccaccctctcctgcagggccagtcagagtgttcgcacttcgttagggtggtatcaacataaatccggccaggctcccaggctcctcatctttgatgctttcaacacgggcccctggccgtcccaggcaggttcagtggcagtggtctgggacagacttcactctcaccatcagcagcctagagcctgaagtattttgctagtttattactgtcagcagcgtgcctactttcgggcggtagggtcgcccgtacgtttcgggccgggtaacgggaaccctaaaaagtacggaagggttaccgaaaaccggtaaccgttcgggtacggtaccgttacggacccgtaacccgtaacgttccgttacgttaccgtttaccgtacttccctttacccccgg

SEQ ID NO: 269265 - DNA, 549 bp, Homo sapiens
  misc_feature: GYAE6OF02HA5YO.10.21.B10.1.454.CMB.1.raw
  modified_base (244)..(244): a, c, t, g, unknown or other
  misc_feature (244)..(244): n is a, c, g, or t
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagganctccttagcctggtaccaacagaaatatggccaggctcccaggctcctcatctatgaaacatccaatacgggccactgccatccctgccaggttcagtggcagtggtctgggacagacttcactctcatcatcagcgcctagacgcctgaagcttcgtgctagtttactacttgtcagcctaccgtaccgacgtcggacccctccccaacccttacgtttccgggacggacgggaccaagggtcggaagtacgtacgaaacgtacgtcggtacggtcgtacgccaccgtactcgtcgttcttacc

SEQ ID NO: 269266 - DNA, 552 bp, Homo sapiens
  misc_feature: GYAE6OF02GE0MB.10.21.B10.1.454.CMB.1.raw
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtgtatcaacataaatccggccaggctcccaggctcctcatctttgatgctttcaacagggcccctggcgtcccaggcaggttcagtggcagtgggtctgggacagacttcactctcaccatcagcagcctagngcctgaagtnttttgctagtttattactgtcagcagcgtcgcccgtacgtttcgggcggtaggtcgccgtacgtttcgggacggtaagggaaccaaagttaggaacggtaccgaaaacggtacgtggtacggcgttgaccaccgtagttcctggttcctactacg

SEQ ID NO: 269267 - DNA, 562 bp, Homo sapiens
  misc_feature: GYAE6OF02FT6X1.10.21.B10.1.454.CMB.1.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccacctctcctgcagggccagtcagagtgttcgcacttcgttagggtggtatcaacataaatccggccaggctcccaggctcctcatctttgatgtctttcaacgagggcccctggccgtcccaggcaggttcagtggcagtgggtctgggacagacttcactctcaccatcagcacgcctagacgcctagaagtattttgactagtttattacttgtcagcagcgtcgcctacgttcgggcggtaggtcgccttacgtttccgggacggtaacgggaacctaaagtacggaacggtaacgaaacgtaacgtggtacggacgtaggacctacctagttccgtgttacttactacg

SEQ ID NO: 269268 - DNA, 534 bp, Homo sapiens
  misc_feature: GYAE6OF02FVOSW.10.21.B10.1.454.CMB.1.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccacctctcctgcagggccagtcagagtgttcgcacttcgtagggtgtatcaacataaatccggcaggctcccagctcctcatctttgatgtctttcaacgacgggcccctggccgtcccaggctaggttcagtggcaggtgggtctgggacaggacttcacttctcaccatcagcagcctagagcctagaagtattttgacttaagttttattacgttgtcagcagtcgtgcctacgttcggcggtagtcgcctacgttcggacggacggaacaaagtagacgtacgaaacgtaactggtacgacgtgacacgtatcgtctctctac

SEQ ID NO: 269269 - DNA, 799 bp, Homo sapiens
  misc_feature: GYAE6OF02I4AMU.10.21.B10.1.454.CMB.1.raw
  modified_base (208)..(208): a, c, t, g, unknown or other
  misc_feature (208)..(208): n is a, c, g, or t
  modified_base (266)..(266): a, c, t, g, unknown or other
  misc_feature (266)..(266): n is a, c, g, or t
tcagcatagtagtgcacgaccggtgctcgatttagtgtcgtcgcaagagacgaggggggaactgcttcagttaggacccagagggaaccatggaagccccagctcagcttctcgttcctcctgctactctggctcccagtacaccaccggagaaatttcgagttgaccacgagtctccagccacgctgtcctttgctccgaggggaanggccacctctcctgcagggccagtccagagtcgttacgctaacgtttcggttaagggngttaactctaacgtattaaacgtccggctaacgggtcctaccgagggtaccttccgtactacgttccgtttagacgttacgcttttaccgaacgtacgggtcccctagggccgttaccccgaggtacctagggtttccaacgggttcggacgttacggtacgggttaccgtacgggggtaacctacggttaccgtttaccgaacgttccgttaccgtaaccgtacgtaccgtacgaccgtacggtccctaaggacgtccgttagaacgttacgtttcggacctttaggtttaactccggttacgtacgtaacgtcgtaacggtccgttaccgtacccgttacggtttaccggaccggtaagttccgtacccgttacgtttaccggggacgttaacggtaaacccgttaaaggtaccggtacggttaaccgaaccggttaccggttcggtaccggtaccctaggtaacccgttaccgttaacggtttccgtaccgttaccggtttaccgtaccgtttacccgttaacccccggg

SEQ ID NO: 269270 - DNA, 653 bp, Homo sapiens
  misc_feature: GYAE6OF02H1ATA.10.21.B10.1.454.CMB.1.raw
  modified_base (296)..(296): a, c, t, g, unknown or other
  misc_feature (296)..(296): n is a, c, g, or t
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgctacttcggttagggtggtatcaacataaactccggccaggctcccaggctcctnattccttgatgtctttacaacgcgggtcccctgggccgtcccgaggtctaagggttcaggtggactagggttcggggtcgtaggggacctaggtaacctttcgacttcctacgaaccctatcaacggtcctagaccctaggacgtcccgtagtaagttacgttttacgacgttagttttacttacgttcgttacacggtactagtcgtccgtaccgtaccgtttcgggacgggtacggttcgacccgttacgtttccgggacggtaacgggtaacctaaacgtagaacggttacgaaacggtaccgttggtacggtctacggacctaccgtacgttccgtgttaccgttataacccg

SEQ ID NO: 269271 - DNA, 397 bp, Homo sapiens
  misc_feature: GYAE6OF02F7P6V.10.21.B10.1.454.CMB.1.raw
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (342)..(342): a, c, t, g, unknown or other
  misc_feature (342)..(342): n is a, c, g, or t
  modified_base (344)..(345): a, c, t, g, unknown or other
  misc_feature (344)..(345): n is a, c, g, or t
  modified_base (348)..(348): a, c, t, g, unknown or other
  misc_feature (348)..(348): n is a, c, g, or t
  modified_base (350)..(397): a, c, t, g, unknown or other
  misc_feature (350)..(397): n is a, c, g, or t
tcagcatagtagtgcacgaccggtgctcgatttagtgtcgtcgcaagagaggaggggagagtgttagaggggggcacgttcctccctcgtaaaccactctaccccctgttgaagctctttgtgacagacttcactctcaccatcagcaggcctaagagcctgaagattttgcagtttattactgtcagtcagcgtggaccactttccggcggaggtgcctacgtttcggcggagggaccaaaatagaaggtacaaacgaactgtaggctgccacatactgtcttcatccttccgctatctgacnctactatcgctgaggcggctggacagccganatagnangnntgngnnnnnnnnnnnnnnnnnnnnnnnnnnnnnnnnnnnnnnnnnnnnnnnn

SEQ ID NO: 269272 - DNA, 361 bp, Homo sapiens
  misc_feature: GYAE6OF02H8QT8.10.21.B10.1.454.CMB.1.raw
  modified_base (327)..(327): a, c, t, g, unknown or other
  misc_feature (327)..(327): n is a, c, g, or t
  modified_base (331)..(361): a, c, t, g, unknown or other
  misc_feature (331)..(361): n is a, c, g, or t
tcagcatagtagtgcacgaccggtgctcgatttagtgtcgtcgcaaggaggagaggggagagtgttagaggggggcacttcgtccctctaacactcctcccctgttgaagctctttgtgacagacttcactctcaccatcagcagcctagagcctgaagatttttgcagtttattactgtctagcaggcgtgcccactttcggcggaggtgccgtactttcggcggagggaccaaaagtgaggtcaaacgactgtcggctgcaccatctgtcttcatcctccgccatctgacactactatgctgaggccgggctcggacaggccganatgnnnnnnnnnnnnnnnnnnnnnnnnnnnnnnn

SEQ ID NO: 269273 - DNA, 640 bp, Homo sapiens
  misc_feature: GYAE6OF02JVM6C.10.21.B10.1.454.CMB.1.raw
  modified_base (515)..(515): a, c, t, g, unknown or other
  misc_feature (515)..(515): n is a, c, g, or t
tcagcatagtagtgcacgaccggtgctcgatttagtgtcgtcgcagagagaggggggaggaggagcccagcactagaagtcggcggtgcctccattcggtgatcagcactgaacacagaggactcaccatggagttgggctgagctgggttttcctcgttgcttctttaagagtatgtccagtgtcagtatgcagatggtggagtcgtgggggagcggtggtccggccgtggggggtccctgagtactctcctgttctgtcgtctggattcgatcttagtaatctggtcatcgtcgtcggtcgccgtacgttccgacggccgacgggctagggaacgtgggtagggctaggactagtactaagtatagagtagaacgtaataaaatattaacgtagtaggacgtactaccgtttacgaacggtccgtacttaccgacctactcctacgtagtaacgactaactacctaaagtactacgtagttagtactaccgtagtaactaaacgtcgaaaccnggacccgtagaaccgacggtacccgaacgggtaccgtaccggggtttatttacggttaacgttggttacgggtaaagtaaccgttacccgtaggtaccggtataccgtacgtaccgttacgttag

SEQ ID NO: 269274 - DNA, 733 bp, Homo sapiens
  misc_feature: GYAE6OF02ID1VP.10.21.B10.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaaggaggagagggggggaggaactgctcagttaggacccagagggaaccatggaagccccagctcagcttctcttcctcctgctactctggctcccagcaccaccggagaaattgtgttgacacagtctccagccagctgtctttgctccgaggggaangccacctctcctgcagggcctagtcagagttgttcggctacttggttagggtggtaactcaaactataaacgtccggaccgaggtccacccgaggcctcctctacttcgtttgacttcgtactttacgaaacgtcggtccccgtggccgtacccgaggacgtacggttcaggtcggctagggtcgggtacgtcggggaactacgtacgttccaaccgtcctaccaacctacgtacaacgtcctaaccgtaccggtacgtacggtaccgttaaggaacgttagttttacgaccgttaaggtttttaacgttacgttaggttaacgacgtacggtaccggtacgtccgttaacccgtacggttttaccgggacggttaagggtccgtacccgtttacggggtttaccgggacggggtaaacggaaaccgtaaaggtaccgtaacgggtaccggtaaaacgtaggtttacggtacggtccgttacgaccgtacgtacgtttccgtaggtttaccctacgttaaccgttcccgg

SEQ ID NO: 269275 - DNA, 696 bp, Homo sapiens
  misc_feature: GYAE6OF02HWZ9A.10.21.B10.1.454.CMB.1.raw
  modified_base (207)..(207): a, c, t, g, unknown or other
  misc_feature (207)..(207): n is a, c, g, or t
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagacaccaccggagaaattgtgttgacacagtcctccacgccacgctgtctttgtctccgaggggaanacgcccaccctctcctgcgacgggccagtcaggagtcgttcgctacgttcggttagggtgtatacaaactaataaacgtccggacacggccctacccgacggtcctcctctattccgtttgacttcgtacctttaccgaaccgtaccggccccgttcggcccgtaccgagggcgtacggttcaggtcggacgtagggttcgggtcgtagggacctagtaccgttacacgttcctaccacctatcacgtcacgtcctaggacgtacctaggtaagttagtttagtacgttagttttaacttacttacgtacacgtcctacggtcgtaccgtccgttaccggtttcgggacggttacggtccgtaccggttaccgtttccggggacggtaaccggtaaacgtaaacgtacgggtaacggtaaccgtaaacggtacgttaggtacggtacgtacgaccctacgtacgttccgtacgttaccgttacgtcccg

SEQ ID NO: 269276 - DNA, 698 bp, Homo sapiens
  misc_feature: GYAE6OF02GC5NA.10.21.B10.1.454.CMB.1.raw
  modified_base (431)..(431): a, c, t, g, unknown or other
  misc_feature (431)..(431): n is a, c, g, or t
  modified_base (464)..(464): a, c, t, g, unknown or other
  misc_feature (464)..(464): n is a, c, g, or t
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagaccaccaccggagaaattgtgttgacacagtcctcagccacgctgtctttgtcctccgaaggggaaagcgcccaccctctccgtgcgacgggccagtcagagttcgttcgctaccgtttcggttagggtgtactacgaaactagtaaacgtccggtaccagggtcctacccgaagtccctccgtactactttcgtttgacttcgtctttacgaaaccgtccggtccccgtgccgtacccgaggctaggttcaggtcgcgtaggtggtcgtaggactacgtctcaccgtcnccaacctgtccaggtcctacggtcctaggtacncccggtaagtaacggtttatttacgaccgttaagttttacgttacgtcgttaacacggtccgtacgtccgtacgtaccgtttcggttaccggacggtacgtcgttaccgtacggtttcgggaccgggaagggttaactaaacggttcgtaacggtaaaccgtaaacggtacgtaggtaccggtaccgtaggtaccctaacgttcgttaccgtcggtttacctactttaccccgg

SEQ ID NO: 269277 - DNA, 801 bp, Homo sapiens
  misc_feature: GYAE6OF02IOM5D.10.21.B10.1.454.CMB.1.raw
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagacaccaccggaagaaattgtgttgacacagtcctcagccacgctgtctttgtctaccgaggggaaagacgcccacccttctcctgaccgagggcctagcgagagttgttcgctagttcggttagggtgtactacaactaacgtaaatccggccaggcctacccgaggtcctcctactattccttagacttcgtctttacgaacgccgggtccctggccgtccgaggtcgaggttcaggttcggacgtcggtacgggtcgtacggaacgtacggtaacgttcaccgttccgtacctacgtactacgacggacctaacggtcccgtaaagaccggtacgttaacggtaaggtttacgtttacggtaacgtttaaccgttttagtttaaccgtacgttcggtaagtccgttaacggtccggtacccggttaccgttaacggtttcccggggtaaccggtacggggttaccgtaccccggtttaaaccgggtttcccgggggaaaccggggttaaaaccgtaaaccggttaaaacgggtaacccggggttaaaggttaaacccgggaaacttaaccggggttaaacgggttcggaccccgttaaggtcccggttaaaccgcgttttaccccggttacgtttacccggttaccgtttaacccccg

SEQ ID NO: 269278 - DNA, 752 bp, Homo sapiens
  misc_feature: GYAE6OF02I59MK.10.21.B10.1.454.CMB.1.raw
  modified_base (207)..(207): a, c, t, g, unknown or other
  misc_feature (207)..(207): n is a, c, g, or t
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagacaccacggagaaattgtgttgacacagtctccagccacgctgttctttgtctccgaaggggaaancgcccaccctctccgtgccagggccagtcagagttcgttacgctacgttcgtagggtgtactcaactaataacgtccggccacggtcctacccgaggtcctccctctacgttctttgacttcgtactttacgaacgcggtcccctggccgtaccgtaggccgtaggttcaggtcgcgtagggttcggtcgtagggacacggtacttaccgaccgttccgttaccgaacctacgttcccgaacgtccgtaaccgtacccgttaaggaccgtacccgttaagggtaaactttacgttttacggaccgtttaaacgttttacgttacgttcgtacgaacggttccgtaagtcccggtccgtaacccgtttaccgttacggggaccggtaaggttcccgtaccggtttaccggtttaccgggggaccggtaaaccgggtaaaccttaaaggttccgggtaacggttaaaccggaaacggttaccgttaggggtccgaccgttacggacccgtacgttaccgttcgtacgttaccgttaccgttacccgg

SEQ ID NO: 269279 - DNA, 683 bp, Homo sapiens
  misc_feature: GYAE6OF02H2NOD.10.21.B10.1.454.CMB.1.raw
  modified_base (422)..(422): a, c, t, g, unknown or other
  misc_feature (422)..(422): n is a, c, g, or t
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagaccaccaccggaagaaattgtgttgacacagtctccagccacgctgtctttgtctccgaaggggaaagacgcccaccctctcctgcgacgggccagtcaggagttcgttcgctacgttcggttagggtggttataccaactaattaaacgtcccggaccaggtccctaccccgaggtccttccgttcgttactagttggtcgaccacgtacccgaacgaacgggccctacgttcggtacctcccgacgccgtaggttcgaggtcggctagggtcgggtcgngggaactaggtacgttccgcttcgtaccacctactacgacgtacgtacgtcgtacgcgtagtacgtagtaagttattttagttattttagttacgttgtacgtaagtaatagtagtagtcggtacgtccggtccttaccgtacgttcgtttacggaaccgtaacgggtaaccgttaacggttacggaactacgtaacgtaaccggtacgttggtacggtacgttacgtaccgtaccgtacgttccttacggttcttacccg

SEQ ID NO: 269280 - DNA, 777 bp, Homo sapiens
  misc_feature: GYAE6OF02H35T5.10.21.B10.1.454.CMB.1.raw
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
  modified_base (533)..(533): a, c, t, g, unknown or other
  misc_feature (533)..(533): n is a, c, g, or t
tcagcatagtagtgcacgaccggtgctcgatttagtgtcgtcgcaagagaggagggggggaggaactgctcagttaggacccagagggaaccatggaagccccagctcagcttctcttcctctgctactctggctcccagaccaccaccggagtaaattgtgttgacacagtcctccagccacgcttgttcttttgtcctaccggaaggggaaagacgcccacccctctccgtggcgacgggccacgtcgagagttcgttcgtcttagtttcggttagggtgtatacaaactaataaacgtccggaccgacggcctacccgaggtccttcctctattctttagtacttcgttacctttacaaccggtccgggccccgtcgggacccgttacccgaggtcgtacggttcgagggtgcgtagggtcggtagngggactacgtctacncctcacctaacacgtcgacgtaccgacgtaccgtagcgtaccgtaggttaatttacgtttagtacgtttaattttacgttaccggttntacgtaggacgtccggttacgtccggtaaccgttccggggttccggggacggttaccggtaccgttaccgggtttaccgggtttaccgggggaaacgggtaaaccgggttaaaacgtaagggttaaccgggtaaccgggtaaccggtaaacggttaccggttaggggtaccggtacgttaacccggtacctaaccggttaccttaccggttttccgtttaccctttccggttacccgttccccg

SEQ ID NO: 269281 - DNA, 678 bp, Homo sapiens
  misc_feature: GYAE6OF02IIC8G.10.21.B10.1.454.CMB.1.raw
  modified_base (207)..(207): a, c, t, g, unknown or other
  misc_feature (207)..(207): n is a, c, g, or t
tcagcatagtagtgcacgaccggtgctcgatttagtgtcgtcgcaagagagagaggggggaggaactgctcagttaggacccagagggaaccatggaagccccagctcagcttctcttcctcctgctactctggctcccagacaccaccggagaaatttgtgttgacacagtctccagccacgctgtctttgtctccgaggggaaancgccaccctctcctgccagggcccagttcagacgttgtcgctacttcggttagggtgtactcaaacataaactccggccaggcctcccgaggtctccgtctattctttgattcgtcctttacgaacgtccgggccctacggccgtaccccgaggcctaggttcaggtcggcgtagggtgggtcgtaggggactaggttaccttcgaccttcctacctaaccgacttccacggtccaacgtcccgtaagtaccggtaccttaggtaacgtttaacgtttcgtaccgtttaacgtttttaacgtttaacgttacgttacgtaacgtcgtacgtaccgtcgtaccgttaccggtttcgggacgggtacggtcgtaccgttacggtttccgggacggtaacggaaacctaagtacggacggtaacgaacgtacgtggtacgtcgtacgacgactacgttctcgttcttacgtccg

SEQ ID NO: 269282 - DNA, 876 bp, Homo sapiens
  misc_feature: GYAE6OF02FMRN5.10.21.B10.1.454.CMB.1.raw
tcagcatagtagtgcacgaccggtgctcgatttagtgtcgtcgcaaggagagagggggggaactgctcagttaggacccagagggaaccatggaagccccagctcagcttctcttcctcctgctactctggctccagacaccaccggagaaattgtgttgacacagtctccagccacgctgtctttgtcctccgaggggtaacacgccaccctctacctgaccgagggccacgtccagtacgttcggttacgctacgtttacggttaggggttagtacttacgaaactagttaaaacgtcccgggaccaagggtcccctacccgaacgggtcccctacccttacgtacgtttaccgttttaggtaactttcgggtacccttttaacggaaaccgtacccgggggttccccctacggggttaccccgtacccggtaacggggtccgttaacggggtttacccgtaggggttacgggccgttaacggggttccggggttaccggttaggggaaaccccttacgggtaacctttcccgtaacgttacccgtacctaaacccggtacgttaacccaccgggtaacccgtacgtaacccgggtaacggtaacccgttacccggttaaggttaaaccggtttacgtttttacggaacctttttagggtttaccttaccggttacgttaccgtaaggtccgtaacggttcccggtacggtaccctttacggggttacccgggtacgggttagttacccggcccgtttacgggttgggaaccgtaacggaacgttaagacgggtaacgtacaacgtaacgtgggtaccacggttacgaccgtacgttatcccggttgttaacctcggtaccttcccgtaacccg

SEQ ID NO: 269283 - DNA, 847 bp, Homo sapiens
  misc_feature: GYAE6OF02HH0P3.10.21.B10.1.454.CMB.1.raw
  modified_base (815)..(815): a, c, t, g, unknown or other
  misc_feature (815)..(815): n is a, c, g, or t
tcagcatagtagtgcacgaccggtgctcgatttagtgtcgtcgcaaggagagaggggggaggaactgctcagttaggacccagagggaaccatggaagccccagctcagcttctcttcctcctgctactctggctccagacaccaccggagaaattgtgttgacacagtctccacgccacgtctgtctttgtctccgaagggaaagacgcccacccgttctccgtagcgtacgggcctagtcagtagtcgttcgctacgttcggttagggtagtactacgaaactataaacgtcccggaccgaggtcccttacccgaggtccttcctacctaactttcgtttagacgttcgtcctttaaccgaaccggtcccggggtaccccttcgggtcccgtacccgtacgggtaccggttaggtttaccgacgggtcggtacgttacggggttaccgggtcgtaacggggtaaccgtagttacccgttacctaccgttacctacccgaacgttaactccgtaacgtacccgtaaccgtacccgtaacgggtacccgttcccggtaaaggtaaacgtttacgtttttaccggaaacgtttttacggttttaaccgttaacgttcggttaaaccgacggttaacggccggttacccgttacggtacccggtttccggggttaccggggtaccggttaacgggtccgttaacccggtttacgggttacccgggaacgggtaaccggtaaaaccgtaagggtaacccggtaggtaaccgaacgggttaacgaccggggttacacgttaccgtactacccggtttanccggtttatacccgtttacaccgtttaccccg

SEQ ID NO: 269284 - DNA, 134 bp, Homo sapiens
  misc_feature: GYAE6OF01EIUDF.15.25.C03.1.454.CMB.1.raw
  modified_base (129)..(134): a, c, t, g, unknown or other
  misc_feature (129)..(134): n is a, c, g, or t
tcagtctacgtagccacgaccggtgctcgatttagtagtgtagatttgggtttgggcacagcggccctgggctgcctggtcaaggactacttccgctacgtagactgagcggctggcaaggcgcatagnnnnnn

SEQ ID NO: 269285 - DNA, 175 bp, Homo sapiens
  misc_feature: GYAE6OF01BONDO.15.25.C03.1.454.CMB.1.raw
  modified_base (173)..(175): a, c, t, g, unknown or other
  misc_feature (173)..(175): n is a, c, g, or t
tcagtctacgtagccacgaccggtgctcgatttagtagtgtagatttgggtttgggggaagaggaagactgacggtcccccaggagttcaggtgctgggcaaagcggccctgggctgcctggtcaaggactacttccgctacgtagactgagcgggctggcaaggcgcatagnnn

SEQ ID NO: 269286 - DNA, 439 bp, Homo sapiens
  misc_feature: GYAE6OF01DD3LN.36.45.E01.1.454.CMB.1.raw
  modified_base (429)..(433): a, c, t, g, unknown or other
  misc_feature (429)..(433): n is a, c, g, or t
tcagtacgctgtctcacgaccggtgctcgatttagtgagtcagtaagggaaagggctggagtgggtctcaagtattgctggtagtggtagtactacatactacacagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagcctccaccaagggcccatcggtcttcccctggcgccctgctccaggagcacctccgagagcacagcggccctgggctgcctggtcaaggactacttccagacagcgtactgagcgggctggcaaggcgcatagnnnnntttttt

SEQ ID NO: 269287 - DNA, 446 bp, Homo sapiens
  misc_feature: GYAE6OF01A7P6D.36.45.E01.1.454.CMB.1.raw
  modified_base (439)..(446): a, c, t, g, unknown or other
  misc_feature (439)..(446): n is a, c, g, or t
tcagtacgctgtctcacgaccggtgctcgatttagtgagtcagtaagggaaaggggctggagtgggtctcaagtattgctggtagtggtagtactacatactacacagactccgtgaagggccggttcaccatctccagagacaattccaagaacacgatgtatctgcaaatgaacagtctgagagccgaagacgcggccgtatatcactgtgcgaaattccccgggagggggcagtggctggtactgcaagggcactttgagtcctggggccagggaaccctggtcaccgtgtcctcagcctccaccaagggcccatcggtccttccccctggccgcccctgcctccaggacgcacctccgagagcacagcggccctgggctgcctggtcaaggctacttccagacagcgtactgagcgggctggcaaggcgcatagnnnnnnnn

SEQ ID NO: 269288 - DNA, 526 bp, Homo sapiens
  misc_feature: GYAE6OF01EK6W0.36.45.E01.1.454.CMB.1.raw
  modified_base (358)..(358): a, c, t, g, unknown or other
  misc_feature (358)..(358): n is a, c, g, or t
  modified_base (496)..(526): a, c, t, g, unknown or other
  misc_feature (496)..(526): n is a, c, g, or t
tcagtacgctgtctcacgaccggtgctcgattttagtgagtcagtaagggaaagggggctggagtgggtctcaagtattgctggtagtggtagtacctacatactacacagactccgtgaagggcccggttcaccatctccagagacaattccaagaacacgatgtatctgcaaatgaacagtctgagagccgaagacggcggccgtatatcactgtgacgaaacgttccccggggagggggcaggtggctggtactgcaagggcactttgagtccgtggggccacggggaaccctggtccaccgtcgtcctcacgcccctccaccaacggggcccctagtccggtcccttcccccgnggccgcccgtgcctccgaggacgccaccgtccgagacgccacgaggccggcccgtgggcctgccgtggtcaaggtacctacttccaagacacgcgtactggacggcgggctgggacgaacgggtccacgtaagtacgnnnnnnnnnnnnnnnnnnnnnnnnnnnnnnn

SEQ ID NO: 269289 - DNA, 522 bp, Homo sapiens
  misc_feature: GYAE6OF01BRWJ9.36.45.E01.1.454.CMB.1.raw
  modified_base (500)..(522): a, c, t, g, unknown or other
  misc_feature (500)..(522): n is a, c, g, or t
tcagtacgctgtctcacgaccggtgctcgatttagtgagtcagtaagggaaaggggctggagtgggtctcaagtattgctggtagtggtagtactacatactacacagactccgtgaagggccggttcaccatctccagagacaattccaagaacacgatgtatctgcaaatgaacagtctgagagccgaagacgcggccgtatatcactgtgcgaaattccccggggaggggcagtggctggtactgcaagggcactttgagtccgtggggccacgggaaccctggtccaccgtgtcctcacgccctccaccgaacgggcccagtccggtccttcccccgtggccgcccctgcctccgaggacgccaccctccgacgagccacgacggccggcccgtgggctcgcccgtgggtaccaaacgggtacccttaccgttacccgacgaccgacggtccgtacgtaggacggcggggcgtacgggcgaagggccgcagtacgnnnnnnnnnnnnnnnnnnnnnnn

SEQ ID NO: 269290 - DNA, 530 bp, Homo sapiens
  misc_feature: GYAE6OF01BGUOI.36.45.E01.1.454.CMB.1.raw
  modified_base (509)..(530): a, c, t, g, unknown or other
  misc_feature (509)..(530): n is a, c, g, or t
tcagtacgctgtctcacgaccggtgctcgatttagtgagtcagtaagggaaaggggctggagtgggtctcaagtattgctggtagtggtagtactacatactacacagactccgtgaagggccggttcaccatctccagagacaattccaagaacacgatgtatctgcaaatgaacagtctgagagccgaagacgcggccgtatatcactgtgcgaaattccccggggaggggcagtggctggtactgcaagggcacttgagtccgtggggccagggaaccctggtccaccgtgtcctcagccctccaccgaacgggcccacgtccggtcccttcccccgtggccctacccctccctaccctaaacgacgccacccgtcggtcgggggaccaccgacggcccggtccctggggcctcggtccgtcgggtaccgaaggtaccttacctacccgaagaccacggccgtacgtggacggccgggcgtcgggaccgaagggccgactaagtgnnnnnnnnnnnnnnnnnnnnnn

SEQ ID NO: 269291 - DNA, 657 bp, Homo sapiens
  misc_feature: GYAE6OF01ANREJ.36.45.E01.1.454.CMB.1.raw
  modified_base (249)..(249): a, c, t, g, unknown or other
  misc_feature (249)..(249): n is a, c, g, or t
  modified_base (568)..(568): a, c, t, g, unknown or other
  misc_feature (568)..(568): n is a, c, g, or t
  modified_base (575)..(575): a, c, t, g, unknown or other
  misc_feature (575)..(575): n is a, c, g, or t
  modified_base (591)..(591): a, c, t, g, unknown or other
  misc_feature (591)..(591): n is a, c, g, or t
  modified_base (646)..(646): a, c, t, g, unknown or other
  misc_feature (646)..(646): n is a, c, g, or t
tcagtacgctgtctcacgaccggtgctcgatttagtgagtcagtaagggaaagggcgtggagtggtctcaagtattgctggtagtggtagtactacatactacacagactccgtgaagggccgttcaccatctccagagacaattccaaagaacacgatgtactctgacaaatgaacagtctgagagccgaagacgcgccgtatatcacgtgtgacgaaacgttcccggggagggcagtggctggtacngacgaaggctaacgtttgagtccgtggggaccgacggaacccttggtccaccgtgtccgtacacgtcccctccgaaccgaacgggtccccaagttcccggtcctttacccccgtggcccgtacccttcgccgtacccgaacggactcccgaacccgtaccggaagaaccgcgtaaccgacggtcccggcccggtgggaccttcggacccgttaggaccgaaaggtaccttaacccgttacgacgtacgacggtacgtacgtacggtaacggcgggtacgtacgggacgaacgggtacgacccgtaagacgtcagtacgngctacanacgactacgatacganacgtacgtactacgtacgacgacgtacgtagtacgcgacgtagtacgtacgacancgacgtcgtcg

SEQ ID NO: 269292 - DNA, 441 bp, Homo sapiens
  misc_feature: GYAE6OF02I5JOA.36.45.E01.1.454.CMB.1.raw
  modified_base (433)..(441): a, c, t, g, unknown or other
  misc_feature (433)..(441): n is a, c, g, or t
tcagtacgctgtctcacgaccggtgctcgatttagtgagtcagtaagggaaaggggctggagtgggtctcaagtattgctggtagtggtagtactacatactacacagactccgtgaagggccggttcaccatctccagagacaattccaagaacacgatgtatctgcaaatgaacagtctgagagccgaagacgcggccgtatatcactgtgcgaaattccccgggagggggcagtggctggtactgcaagggcactttgagtcctggggccaggggaaccctggtcaccgtgtcctcagcctccaccaagggcccatcggtcttcccctggcgccctgctccaggagcacctccgagagcacagcggccctgggctgcctggtcaaggctacttcagacagcgtactgagcgggctggcaaggcgcatagnnnnnnnnn

SEQ ID NO: 269293 - DNA, 493 bp, Homo sapiens
  misc_feature: GYAE6OF02G88A0.36.45.E01.1.454.CMB.1.raw
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
  modified_base (358)..(358): a, c, t, g, unknown or other
  misc_feature (358)..(358): n is a, c, g, or t
  modified_base (417)..(417): a, c, t, g, unknown or other
  misc_feature (417)..(417): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
  modified_base (465)..(493): a, c, t, g, unknown or other
  misc_feature (465)..(493): n is a, c, g, or t
tcagtacgctgtctcacgaccggtgctcgatttagtgagtcagtaagggaaaggggctggagtgggtctcaagtattgctggtagtggtagtactacatactacacagactccgtgaagggccggttcaccatctccagagacaattccaagaacacgatgtatctgcaaatgaacagtctgagagccgaagacgcggccgtatatcactgtgcgaaattccccgggagggggcagtggctggtactgcaagggcactttgagtccgtggggccagggaaccctggtcaccgtgtccctnagccctccaccgaacgggcccatccggtcctcccccgnggccgccctgcctccaggcnccacctcgagcgcacagccggccctgggctcgcctggtcaaggtcctactccgagaccngcgtactggacggcgggctgggacgaaggtccgactagtagcngcngnnnnnnnnnnnnnnnnnnnnnnnnnnnnn

SEQ ID NO: 269294 - DNA, 616 bp, Homo sapiens
  misc_feature: GYAE6OF02IPC8U.36.45.E01.1.454.CMB.1.raw
  modified_base (412)..(412): a, c, t, g, unknown or other
  misc_feature (412)..(412): n is a, c, g, or t
  modified_base (538)..(538): a, c, t, g, unknown or other
  misc_feature (538)..(538): n is a, c, g, or t
  modified_base (586)..(616): a, c, t, g, unknown or other
  misc_feature (586)..(616): n is a, c, g, or t
tcagtacgctgtctcacgaccggtgctcgatttagtgagtcagtaagggaaaggggctggagtgggtctcaagtattgctggtagtggtagtactacatactacacagactccgtgaagggccggttcaccatctccagagacaattccaagaacacgatgtatctgcaaatgaacagtctgagagccgaagacgcggccgtatatcactgtgcgaaacgttccccggggaggggcaggtggctggtactgcgaagggctacgtttgagttccgtgggggcccaaggggaaccccttgggtccacccggttgtccctcgacggcccctccgaacccgaacggggccccctaggttcccggttccctttccccccgtgggccccgtccccgttcgcccgttcccgagggaccncccgaaccccgtccggagacgaccaacgtaccggtcccgtaccccgttggggcccttcgggccccttaggggtacccgaaagggtaccctttaccgttacccacgtaacgaccgtacgttaaccgnggaacggcgggtaccgtgggacccgaaagggtccgactaacgtagcgnnnnnnnnnnnnnnnnnnnnnnnnnnnnnnn

SEQ ID NO: 269295 - DNA, 662 bp, Homo sapiens
  misc_feature: GYAE6OF01CDDR8.43.21.B10.1.454.CMB.1.raw
tcagtgtgagtagtcacgaccggtgctcgatttagtgtcgtcgcaagagaggagggggatgctttctgagagtcatggatctcatgtgacaaagaaaatgaagcacctgtgttcttcctctgctggtggcgctccagatgggtcctgtcccagctgcagctgcaggaggtcgggcccaggactgggtagaacgtccttcggacgaccctgtccctcacctgcctactgtctcgtggtcgctcatcagcagctagttacttacttcgtggggctggacctccgccgacgccccgagggacgggctaggagtggagttgggacttacttaaccgacgtaggtcgggacgacctaaccgtaacctaacccgaaaccccgttacccgtaacgaaaaacggtccggaacggacctaaacctaacgttacgtacccggtaaacgaccgtaaccgtaaccgaaacgtaacctaaactttcctacccgtaggaactcgtaggactcctcgtagtaccgacccgtaccgacaacgaccgacgggtctacggttacttacgttacgtggtacgaccggaccgggccccaggccgcgtaggttcggttacgttttagagttcgttcctttagacttaggtcggtacggggacctaaagggtactaggtaccgg

SEQ ID NO: 269296 - DNA, 702 bp, Homo sapiens
  misc_feature: GYAE6OF01BEX9Y.43.21.B10.1.454.CMB.1.raw
  modified_base (624)..(624): a, c, t, g, unknown or other
  misc_feature (624)..(624): n is a, c, g, or t
  modified_base (690)..(690): a, c, t, g, unknown or other
  misc_feature (690)..(690): n is a, c, g, or t
tcagtgtgagtagtcacgaccggtgctcgatttagtgtcgtcgcaagagaggagggggatgctttctgagagtcatggatctcatgtgacaaagaaaatgaagcacctgtggttccttcctcctgcgtgggtcggccggcctcccgagtacgtcgggtcctcgtcccagctgcagctgcgaggacgtcgggcccaggactggtagacgtccgttacggactaccctcgtcccctcacgtgcctacttcgtcctcgtggtcgacctccatcacgtcagctacttaccttacgttcgtggggctaggacctccgaccgacggacccccggagggggacgggtcgtgggaggtagggtacgttggggtaacttacgtttaccgacggtaggtacgggacgacctaaccgtaacgtaacccgaaccccgttccctaaacgtaaaacggtcgaacggacctaacctaacgttaaccgtaccggtaacgaacctaaccggttaaccaaaacggtaaccctaacgtttccgtaccctaaggtaactacgtaggtacctcgttcgacggtaccgccgaccgtacgaccggtaccgtacggtctcgttactagtacgtcgcgacgtccggccngccgcgtaggttggttcgtttcgattcggtcttaggtattcggtacggggtcggaacgtaacggtntaagggttcccg

SEQ ID NO: 269297 - DNA, 772 bp, Homo sapiens
  misc_feature: GYAE6OF01ECG9I.43.21.B10.1.454.CMB.1.raw
  modified_base (760)..(760): a, c, t, g, unknown or other
  misc_feature (760)..(760): n is a, c, g, or t
  modified_base (764)..(764): a, c, t, g, unknown or other
  misc_feature (764)..(764): n is a, c, g, or t
  modified_base (769)..(769): a, c, t, g, unknown or other
  misc_feature (769)..(769): n is a, c, g, or t
tcagtgtgagtagtcacgaccggtgctcgatttagtgtcgtcgcaagagaggagggggagagggaaccatcggaaaccccagcgcagcttctccttcctcctgctactctggcctacccgaaggggaaagacgacctacctttctcctgacgaggtccagtcaggtagttaccttaaccaacgtacttaccttacgaccgtgtaaccagtacaacgaacctcggccgaagtccacccgagtccttccgtactaacgtaccgtttacgggcaccagttcccgaaggaccggacgggtcccacgtaggaccaccggtccctaaggaccgtaggtttcgaggtcggacgtaggtcgggtacgaggactagttacctacgaccttccgacctaaccgttagaccgtacgaccggacgttacccggaaagttgtaacgtttagttcgagttacggtttataacttcgtagtacagtacgaagtttacgtaggtaccaccgtttaccggaacttaccgacccggtttacccggtacggaaaccgggtaacgggtaccgtaccggttaacggtaaccgggtaaacggttaaccggttaaaccgttaaccggttacggtaaccgttacgtaaccggtacctacgttcggtaaccttcgttacctaccgttacctaccgtcccgtactacttacgtacgtaactacctaacgtaccgacgtacggacgggtacggtacgcggtaacggtccgtagaacgttcgagcgtncganagtgncgc

SEQ ID NO: 269298 - DNA, 787 bp, Homo sapiens
  misc_feature: GYAE6OF01DEMAI.43.21.B10.1.454.CMB.1.raw
  modified_base (719)..(719): a, c, t, g, unknown or other
  misc_feature (719)..(719): n is a, c, g, or t
tcagtgtgagtagtcacgaccggtgctcgatttagtgtcgtcgcaagagaggagggggatgctttctgagagtcatggatctcatgtgacaaagaaaatgaagcacctgttggttcttcctctgctggtggcgctccagatggtcctgtccagctgcagctggcgagggtcggtccgggccaaggcgtgggtagaacggtccgttacgggacctaccccttcgtcccctacaccgtcgctacttcgtccttcggtcgggtcgcctaccagtaccgaacgcaacggtcctaacgtttacctttacggttcgggtggggtacgtcggacgtccccgacccggaccgggtacccccggggaagggggtaacggggtcgtaggggtacggttagggttagggtttagggtacgtttaaacgttaccggaagcgggtacggacgaccctaaacctaccgtaaccccacccgttaaccaacggaaacgtcggacgtacctaacgacttacgaccgtagaacctaccgtaaccaacgtaacccttacgttccgtaacctaggtactcgttagaccgtccgttacgaccgggtccgaccccgcggtacgaacgccgttaccgtcgtttaacgttacgtttaaccgtgggtacgacccggggtaccgtacccggggcccgacgggttccgtggtacgggtttttagtccggtttaagttaccgggttnttacgggtttacgtacgttacgggtttaggggaaccccgggtagtaaacgggcctttacggggtcccg

SEQ ID NO: 269299 - DNA, 752 bp, Homo sapiens
  misc_feature: GYAE6OF01EYA0P.43.21.B10.1.454.CMB.1.raw
tcagtgtgagtagtcacgaccggtgctcgatttagtgtcgtcgcaaagagagagggggatgctttctgagagtcatggatctcatgtgcaaagaaaatgaagcacctgtggtttcttcctcctgcgtggtggcggctcccagagttgggtcctgtcccagctgcagctgcgagggacggtccgggacccagggtacgtgggtgaacgtcccgttacgggaccgtaccccttgtccccctcgaccctgacctctcgttcctcgtgggtcgcctccatcagcacgctacgttacctttcgttcggtgggtctcggtaccgtccccgaccgtacccggaccccggagggggacggtgaggtaggtgggtaggttacgggtaactttacgttaacgacgtagggttcggacgtaccctaaccgttaaccgtaacccgtaaccccgttaccctaaaccgtaaaaggtacggaaccggaccctaaccgtaaacttaccggtaccggtaacgaacccgtaaccgtaacctaaaccggaaacccttaacttccccgtaacgtacggaacgtacgtgacgttcctcgtcggtccgacccgtccgacgtaacgaccgaccgtctacgttacttacgttcgtacgtaccgccggacccggtccgacgtcggacgttcggttacggtttcgtttcggtacttcgttcgtttagagtttcgggtacgggtaccgggaaaccgtagggtaacgttaggttacccgg

SEQ ID NO: 269300 - DNA, 753 bp, Homo sapiens
  misc_feature: GYAE6OF01DN8K3.43.21.B10.1.454.CMB.1.raw
  modified_base (562)..(562): a, c, t, g, unknown or other
  misc_feature (562)..(562): n is a, c, g, or t
  modified_base (620)..(620): a, c, t, g, unknown or other
  misc_feature (620)..(620): n is a, c, g, or t
  modified_base (629)..(629): a, c, t, g, unknown or other
  misc_feature (629)..(629): n is a, c, g, or t
  modified_base (736)..(736): a, c, t, g, unknown or other
  misc_feature (736)..(736): n is a, c, g, or t
  modified_base (740)..(740): a, c, t, g, unknown or other
  misc_feature (740)..(740): n is a, c, g, or t
  modified_base (745)..(745): a, c, t, g, unknown or other
  misc_feature (745)..(745): n is a, c, g, or t
  modified_base (750)..(753): a, c, t, g, unknown or other
  misc_feature (750)..(753): n is a, c, g, or t
tcagtgtgagtagtcacgaccggtgctcgatttagtgtcgtcgcaagagaggagggggagagggaaccatcggaaacccagcgcagcttctcttcctcctgctactcgtcggccgtaccgaaggggaaacgacgccctaccttctcccgtggacgacggtccagacgaacgaccgtaccctaaaccgaaacgtaacttaccgtacggtccgtacggtaacctaactacgaaacgtaaaccgtcggaccgaacggtcctaccggacgtcctcctacgactacgtacggtcactacctacgaggaccgcgggaccagtccgacctaaccgtacccgaagtacgtacggttaccgacggtcggacgtacgggttggggtacggtacgggtaaacgtaccggttaccttccggtacctacgtacccgttaaccggtccgtaacggaaccggtaacggtaccggtacggaacccgtttaaggtaaccgtttagtttaccggtagtatttacggttaccttaaagtcgtaacgacggttagtaacggtaaggtacggtcaccgtaacnccgtaactaccgtaccgacgaaacgtacggacgtacgtagacggtaacgtaactacgngtacgcgtntacggctacgtcgtcttacgtcctacgtacgtccgtaactctaacgtctaacgtacctacgctaacggtcgtacggacggtcgaccgaacggtcgaccggattacgntacngacgntcgannnn

SEQ ID NO: 269301 - DNA, 746 bp, Homo sapiens
  misc_feature: GYAE6OF01BNEW6.43.21.B10.1.454.CMB.1.raw
  modified_base (730)..(730): a, c, t, g, unknown or other
  misc_feature (730)..(730): n is a, c, g, or t
  modified_base (735)..(735): a, c, t, g, unknown or other
  misc_feature (735)..(735): n is a, c, g, or t
  modified_base (738)..(739): a, c, t, g, unknown or other
  misc_feature (738)..(739): n is a, c, g, or t
  modified_base (745)..(745): a, c, t, g, unknown or other
  misc_feature (745)..(745): n is a, c, g, or t
tcagtgtgagtagtcacgaccggtgctcgatttagtgtcgtcgcaagagaggagggggagagggaaccatggaaacccagcgcagcttctcttcctcctgctactctggctcccgaaggggaagacgccctaccgttctccctgcacggtccagtcgagagttccttaaccaaccgtactacgttacgccgtcgtacatacacgaaccgtcggcgacggtcctccgagcctcctctacgtctacggtcacactaccgagccgacggccacgtgaccacgtacccgagactggtcgaggtggacgtaggtcggtacggtaggaacacgtaccttaccgaccttaccgtaccgtaccgtcgacgacgacgtacggacggtaccgtaagtaagttactttcgacgttacgttagttacgttctacgtacgtacgtagtacgttacggtacgtacgtacctaccgtaccgtacgtaccgtaccggtaccggaaccggtaacggaacgtaccgtacggtacggtaacgttaaccggttaacgtacggttcgggtacgtaccgtaccgtaccgttaccgttacgtaccgttaccgttaccttaccgttaccgttacccgttaccctacccgttaaccgttaccgtaacgtacccgttaaccgtaccgtaaccgtacggtacggtaccggttacgggtaccggtccggacgtaaccggtacgtaacgtcgtaacgtnacgtnacnnctgcgng

SEQ ID NO: 269302 - DNA, 526 bp, Homo sapiens
  misc_feature: GYAE6OF02IWUHG.43.21.B10.1.454.CMB.1.raw
  modified_base (264)..(264): a, c, t, g, unknown or other
  misc_feature (264)..(264): n is a, c, g, or t
  modified_base (488)..(488): a, c, t, g, unknown or other
  misc_feature (488)..(488): n is a, c, g, or t
  modified_base (516)..(516): a, c, t, g, unknown or other
  misc_feature (516)..(516): n is a, c, g, or t
  modified_base (518)..(521): a, c, t, g, unknown or other
  misc_feature (518)..(521): n is a, c, g, or t
  modified_base (523)..(524): a, c, t, g, unknown or other
  misc_feature (523)..(524): n is a, c, g, or t
tcagtgtgagtagtcacgaccggtgctcgatttagtgtcgtcgcaagaggaggacgggggaagagggaacccatgggaaaccccagccgcagcttctcttcctcctgctactctggctcccaggggaaagagccacctttctcctgcaggtccagtcagagtcttaccaacgactacttagcctggtaccatcagaaacctggccaggctcccaggctccgtcatctacggtgcatccagcagggccacgtggcatcccagacnggttcagtggcaggtgggtctgggacagacgttcacgtcttcaccgtcaagcgagacgtggaccctggaagatttttgactaggtagtattaactgtcaagcagtatggtagctcaccgatcaccttcggaccaaagggacacgactaggagattaaaccggaactgtacggctggccacagtctgtcttcatccttcccgcatctagaactactcaactctgnggacgggtctaggcgaaggcgcgatagntnnnngnncg

SEQ ID NO: 269303 - DNA, 826 bp, Homo sapiens
  misc_feature: GYAE6OF02FH4MA.43.21.B10.1.454.CMB.1.raw
tcagtgtgagtagtcacgaccggtgctcgatttagtgtcgtcgcaagtaggagagggggagagggaaccatggaaacccagccgcagcttctcttcctcctgctactctggctcccaggggaagacgccaccttctcctgcaggttccagtccagagtcttaccaacgtactacttagcctggtaccatcagaaacctggccaggctccagctctcatctacggtgctatccagtccacgggtccacgtcggctactaccccagacctaggtttccaggttaggcgtaggttgggtccgttaggggaccaaggtaccctttaccggaaccgttcctaccctaaaccggttccgaacgaccgtaacgtaccgtaccgggtaaccccgttaggaaaacggtactttttaggacccttaggttacggttaacttttaaccgtcgtttacgaacggtcctaacggttaacgttggactacggtacctaccgtaacccgtacttacccgtaaaccggtttccggaaccgaaacggggtaccctaaccggtaccgttacgggaacgttaaaccgttaacccgtaaacgtcgggttaacggtacccttacggacccgttaaccgtacctttacggttaccgttacccttaccgtaaccgtttccccgttaccccgtacgttaaccgtaccgtttaacggtaaaccgtttccctaaacccgtaaccgttacgtaaccgggtacgggttaccccgggtcgttaaccgggaacccggttaacgggacccgtaacgttacggtaacggtctacggacccttagctacggtacgtccg

SEQ ID NO: 269304 - DNA, 542 bp, Homo sapiens
  misc_feature: GYAE6OF01CK2W8.16.49.E05.1.454.CMB.1.raw
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataaccttgtctcctggtaccagcagcacccagacaaacgcccccaaactcatgatttatgaggacaataagcggccctcgaggagtttctaatcgcttctctggctccacgtctggctaacacggcctcccgtgacaatctcctcggcctccaggctggaggacgaggctgattatctgctgctcatattcaagttcgtgtctactatcgtcttttgggcggtacgggtaccgtaaggtcggacccgttccgttaggtccacggtaccccgaacggtccgtccggtccccccgg

SEQ ID NO: 269305 - DNA, 540 bp, Homo sapiens
  misc_feature: GYAE6OF01E2Z2O.16.49.E05.1.454.CMB.1.raw
  modified_base (307)..(307): a, c, t, g, unknown or other
  misc_feature (307)..(307): n is a, c, g, or t
  modified_base (448)..(448): a, c, t, g, unknown or other
  misc_feature (448)..(448): n is a, c, g, or t
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctcctggtaccagcagcacccagacaaacgcccccaaatcatgatttangagggcaaataagcggccctcaggtagtttctaatcgctttctctggctccacgtctggcaacacggcctccctgacaatctctgcctcaggctgaggacgaggctgattattactgctgctactatacttcaagttcgtntactacttatgttcgtttttgggcgggtacgggactaagggtcgtacccggtcctagggtccacggaccccaaggtccctggtaccccccgg

SEQ ID NO: 269306 - DNA, 522 bp, Homo sapiens
  misc_feature: GYAE6OF01AJF00.16.49.E05.1.454.CMB.1.raw
  modified_base (344)..(344): a, c, t, g, unknown or other
  misc_feature (344)..(344): n is a, c, g, or t
  modified_base (383)..(383): a, c, t, g, unknown or other
  misc_feature (383)..(383): n is a, c, g, or t
  modified_base (416)..(416): a, c, t, g, unknown or other
  misc_feature (416)..(416): n is a, c, g, or t
tcagtgtactactccacgaccggtgctcgatttagagcgactagcaacacacaaaggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataacttgtctcctggtacagcagcaccagacaacgccccaaactcatcgatttatgagggcaataagcggccctcaggtagtttctaatcgctttcnctggcctccacgtctggcaacacgcctcctgacatctcnggcctcagctgaggacgagctgtattattactnctcgctacatattacagtccgttgctactagtgttccgttttgggcggtacggacgtaaggtcgtaccgtacgtaggtacacgtacccaggtccctcggtcccccg

SEQ ID NO: 269307 - DNA, 542 bp, Homo sapiens
  misc_feature: GYAE6OF01DTJEH.16.49.E05.1.454.CMB.1.raw
  modified_base (306)..(306): a, c, t, g, unknown or other
  misc_feature (306)..(306): n is a, c, g, or t
  modified_base (470)..(470): a, c, t, g, unknown or other
  misc_feature (470)..(470): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataaccttgtctcctggtaccagcagcaccagacaaacgcccccaaatcatgatttangagggcaagtaagcggccctgaggtagtttctaatcgcttctctggcctccacgtctcggcaaaccgacggccctcccgtagacctaatcctctcggccctccgacggcgtggacggacggaggtctgtatttattacgtgtctgctcattattcaagttcgtntctactgttgtcgttttgggcggtaggtacgaggtcgaccgtcgtaggtccacgcccgacggctcgtccccg

SEQ ID NO: 269308 - DNA, 539 bp, Homo sapiens
  misc_feature: GYAE6OF01AZBMG.16.49.E05.1.454.CMB.1.raw
  modified_base (327)..(327): a, c, t, g, unknown or other
  misc_feature (327)..(327): n is a, c, g, or t
  modified_base (370)..(370): a, c, t, g, unknown or other
  misc_feature (370)..(370): n is a, c, g, or t
  modified_base (426)..(426): a, c, t, g, unknown or other
  misc_feature (426)..(426): n is a, c, g, or t
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataaccttgtctcctggtaccagcagcacccagacaaacgcccccaaactcatgatttatgagggcaataagcggccctnaggtagtttctaatcgcttctctcggctccacgtctggcaacncggcctccctgacaatctcgtcgcctccgagctgaggacgaggctgtattattacngtctgctctattatacaagttccgtgtccactagttgtcgttttagggccggtagggaccaagggtcgacccgttcgtacggtccacgaccccgaaggtcctccggtcccccg

SEQ ID NO: 269309 - DNA, 733 bp, Homo sapiens
  misc_feature: GYAE6OF01DI2O9.16.49.E05.1.454.CMB.1.raw
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcacatcctctgcacgtaggagcggactagtgtagttgggtttaggggttaactaaccgttgtcctcgtacggtaccagcacgaccacccgaagaacctaaaccgacccccaaactctagtagtaatttagaggaggactaaagtaacggccggtacccctagtaaggtacgttttactaaacgttcgtaccgttttctcgtcggtacctccgtaacgttccgtcggaacctaaaccgtccggtccccttacccgtagtaaacctaacggttccttaccggtaccggtccccttaccggacggttaccgtagggaacgggaaccgtacgggtccttaagggttaaacttttaacgttacgtacggtccgttcgtacccttaggtaaactttacggtttaaccgtaaggttccgttacgtactaaccttaggtttcggtttcggttttacggggacgggtaaccgtaaggacggttcgtacccggtacgtacgtacgaacccgaccgtacgtccccgcccggttacccg

SEQ ID NO: 269310 - DNA, 663 bp, Homo sapiens
  misc_feature: GYAE6OF01DZQ0S.16.49.E05.1.454.CMB.1.raw
  modified_base (276)..(276): a, c, t, g, unknown or other
  misc_feature (276)..(276): n is a, c, g, or t
  modified_base (313)..(313): a, c, t, g, unknown or other
  misc_feature (313)..(313): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctggtctctggtcagtcgatcaccatctcctgcacgtggaacgcggcagtgagttggttaggggttataaccgttgtcctccgtggtaccngcagccaccagaacaacgaccccaaatcatgatttanaggagggacaagtaacgccggtccctacgaggtagtttactaatcgtactttctcgtcggtcctaccgtaccggtcgtacggaccaaaccgtcccgggtcccttaccccgtagaacctaacttcccgtaccgttccgggtcccttacccgacggtcgtaggaacgggtacggacggtcttagtaagtttacttacgttcgtcgtcgtacttactaattacgttacgaacgtttcgtgttacctacttagttcggttcgttttagggacgggtaacgggtaaccgtagggttaccgacccggttaccgtacggtaccgaccggacccgacggtccctcccggtacccccgg

SEQ ID NO: 269311 - DNA, 533 bp, Homo sapiens
  misc_feature: GYAE6OF01BR2WO.16.49.E05.1.454.CMB.1.raw
  modified_base (304)..(304): a, c, t, g, unknown or other
  misc_feature (304)..(304): n is a, c, g, or t
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
tcagtgtactactccacgaccggtgctcgatttagagcgactagcaacacacaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctcctggtaccagcagcacccagacaaacgcccccaaatcatgatttangaggcaataagcggccctcgaggtatttctaatcgtcttctctggctccacgtctggcaacncgcctcctgacatcnctgcctcagctgagacgaggtctagtattacttactgctcgctcgtattattactaagttcgtgtactacttagttgttcgttttgggacggtacgggtacctaagggtcgtacccgtcgtacggtcacggacccaggccgtccgtcccccg

SEQ ID NO: 269312 - DNA, 694 bp, Homo sapiens
  misc_feature: GYAE6OF01D5IXY.16.49.E05.1.454.CMB.1.raw
  modified_base (269)..(269): a, c, t, g, unknown or other
  misc_feature (269)..(269): n is a, c, g, or t
  modified_base (305)..(305): a, c, t, g, unknown or other
  misc_feature (305)..(305): n is a, c, g, or t
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcacgtggaagcggcagtgatggttggggttataacgttgtctctggtaccngcagcaccagacaacgccccaaatcgatgatttagnggaggcaagtaacgcggaccctacgaggtacgttttacaacgtcgtcttctcgtcgggtccctccgtaaccgttcgttacggaccaaacgtacccgggtccctacccgttagaacctaactccgttcgttaccggtccccttacccggacgggtccgtacgggaacggaacgggacggtccgttagtaacgttttatttaacgtcgtcctcggtacctacctaagttaacgttttacgaaacgttcggttacgtaccttaacgttagttcggttcggtttttagggaccggggtaacgggttaacgaaacgggttcgtaacccgggttccgtttaacgggtccgtaacccgtacccgggtaaacgggtcctccccgggttaccccccgg

SEQ ID NO: 269313 - DNA, 685 bp, Homo sapiens
  misc_feature: GYAE6OF01C1PVJ.16.49.E05.1.454.CMB.1.raw
  modified_base (314)..(314): a, c, t, g, unknown or other
  misc_feature (314)..(314): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcacatctcctgcactggaagcggcagtgagttggttggggttaataccttgtctcctggtaccagcagccaaccagaaccaaacgcccccaaactcatgtatttagnggaacggacaaagtaacggccgtaccctagtacggtagtttacctaacgtccgtactttcgtcgttcggtaccttcccgacgttccgtacgggacccaaaccgtaccggttcccctacccgtaggaaccctaacgttccttaccgttcggaccctacccgaggtctaacgggacgggacgaggtcttagtaatttacgttaacgtgtcttgcttactatttacgttcaacgttcggttagtcctacgtttagttcggttacggttttacgggacggggtaaccgggtaccgttaagggttccgaacccgggtttaccgtacgggtacccaaccggtacccggtaaccggtcccgttcccggtaccccccgg

SEQ ID NO: 269314 - DNA, 624 bp, Homo sapiens
  misc_feature: GYAE6OF01BX4SA.16.49.E05.1.454.CMB.1.raw
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggtcagtcgatcaccatctctgcactggaagcggcagtgatggttggggttataaccttgtctcctggtaccagcagcaccagacaaacgcccccaaatcatgatttataggaggacaagtagcggtcctcaggtatttactaatcgtcttctcgtgcctccgacgtctacggacaacgacccggtccttcccgtagaacctaacgttcctcgtaccggtccttccgacggtcgtaggacggacgtaaggctagtactttagtactgcctgctactattacgttacaacgttccttgtacctacgttattcggtttccgttttcgggaccgggtaacgggtaacccgtaaacgggttccgaaccccggtttacgtacgggttaccaaccgggtacccccgtaacgggtcccgttacccggtacccccccg

SEQ ID NO: 269315 - DNA, 714 bp, Homo sapiens
  misc_feature: GYAE6OF01CHT5U.16.49.E05.1.454.CMB.1.raw
  modified_base (321)..(321): a, c, t, g, unknown or other
  misc_feature (321)..(321): n is a, c, g, or t
tcagtgtactactccacgaccggtgctcgatttagagcgactagcaacacgacaaagggggggtcacaagaggcagcgctctcgggacgtctccaccatggcctggctctgctgctcctcactctcctcactcaggactacgagggtcctgggcccagtcctcgccctgacctcacgtcctgcctacggtcgtcgtcgggtcctccgtggtcaggtcgactcaccatcctctagcacgtaggaacgcggcagtgagttgggttaggggttactaccgttcgtctccgtacggtaccagcacgcaccagacaaccgcccaancatagtattacgaggtacgacaagtacgccgtacctgacggtacgttactacgtcgtcttacggtcgtcggccttaccgacgttccgacgactaacgccgtcctacctacaccgtacgtcgttccgcggtaccctacggtcgacgtaacgggacggcgtacggttctaggtacttacggttactcgttacgcgttcctacgttacgtttacgttaccgggtaggttacgtaccgttacgttaacgttacggtttcggttaccggggttttagggaacccgggggttaaccgggtaacccgtaacggggtttacccgtacccggtttaggtaaacccgtccggtaaacccgtacccgggttaacccggtcccgtttaccccgggtaccccccgg

SEQ ID NO: 269316 - DNA, 536 bp, Homo sapiens
  misc_feature: GYAE6OF01AZ2M8.16.49.E05.1.454.CMB.1.raw
  modified_base (306)..(306): a, c, t, g, unknown or other
  misc_feature (306)..(306): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (448)..(448): a, c, t, g, unknown or other
  misc_feature (448)..(448): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataaccttgtctctggtaccagcagcacccagacaaacgcccccaaatcatgatttangaggcaatagcgccctgaggtagtttctaatcgcttctctggcctcacgtctgcaacncgcctccngacatctctcggcctcgagctgacggacgaggctagattattactgctgctcattattcaagttcgtgtctacgtntcgttcgttttgggacggtacgggtaaccgtagggtcgtacccgtcgtacggtccgacggacccgaacggtccgtccggtccccccgg

SEQ ID NO: 269317 - DNA, 670 bp, Homo sapiens
  misc_feature: GYAE6OF01BXZD2.16.49.E05.1.454.CMB.1.raw
tcagtgtactactccacgaccggtgctcgatttagagcgactagcaacacacgaaaggggggggtcacaagaggcagcgctctcgggacgtctccaccatggcctgggctctgctgctcctcactctcctcactcagggcacagggtcctgggcccagtctgccctgactcagcctgcctcgtgtctgggtctcctggacagtcgatccgacatctcctgccactggaaccaactagttgacgttggacgtattattaactttgtctccgtaggtaaccaacgaaccacccaggacctaaccgacccccaaacgtcactctactttatagtaactcctacgtaacgccggtcccctaggtaacgggttacctacgttaacgtccgttacgttctcgtacgtcctactacgtcgtacgaccaacgtcccgtccgtccgtacgtaccgttcttaccggtccgtcctacgacggtacgtacgggacggtacggtcgtacgtagttaacttaacgttccgtacgtacctaacgtacttaagtaacggtaagtacggtacgtacgacgtactacgttacgtacgttcggtacgggaccggtagaccgtacgtcgtaccgtaccggttcgaccgcgtaccgtaccgtacgtacccgtccgtccccgttcgtacccg

SEQ ID NO: 269318 - DNA, 594 bp, Homo sapiens
  misc_feature: GYAE6OF01A9XCR.16.49.E05.1.454.CMB.1.raw
  modified_base (330)..(330): a, c, t, g, unknown or other
  misc_feature (330)..(330): n is a, c, g, or t
  modified_base (390)..(390): a, c, t, g, unknown or other
  misc_feature (390)..(390): n is a, c, g, or t
tcagtgtactactccacgaccggtgctcgatttagagcgactagcaacacacaaagggggggtcacaagaggcagtgctctcgggacgtctccaccatggcctgggctctgctgctcctcactctcctcactcaggacacagggtcctgggcccagtctgccctgactcagcctgccctccgtgtctgggtctcctggtcagtcgatcaccatctcctgcactggaagcggcagtgatggttggggttataaccttgtctcctggtaccagcagcacccagacaaacgcccccaaactcatgatttatgagggcaataacgcggaccctnaggtatttctaatccgacttctctggcctccgacgtcgtcggacaacgaccggcctcccngacaactctcttcggcctccgaggtctggaaggacgaggtctagatttactacgtgccttgctactattacttacgaacggttctcgtactacttagtcgttcgttttgggaccgggtacgggtaacccggtaagggtccggtaacccggtcccgttaggtacccaccggaccccgtaacgggcccgtacccggtcccccccgg

SEQ ID NO: 269319 - DNA, 651 bp, Homo sapiens
  misc_feature: GYAE6OF01EASLE.16.49.E05.1.454.CMB.1.raw
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
tcagtgtactactccacgaccggtgctcgatttagagcgactagcaacacacgaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggtcagtcgatcaccatctctgcacgtggagcgntagngtagtggttgggttactaccgttgtctcgtggtacngcacgcaccgagaaccaaaccgcccccaatcatcgtaatttagaggaggactaagtacggccgtcctgagtagtttacactccgtcttacgtcgtcgcctccgacgtcgtacgacctacgccgtcctaccgtacgactacgtctccgtacgtcccgacgtacggtacgtacgggacggacgtacggtcttaacgttacgttattaccgcggtcgttacgcttaacagtttacgttaacgtaccgttggtactccttagttcggtttcgtttacggtttacggggacgggtaccgggtacggtaaccggtcggttaccccgtcgggttaccggtcccgtaacccgggtaccccgacgggttccccgtcccccggttaccccg

SEQ ID NO: 269320 - DNA, 756 bp, Homo sapiens
  misc_feature: GYAE6OF01EGNZ7.16.49.E05.1.454.CMB.1.raw
  modified_base (211)..(212): a, c, t, g, unknown or other
  misc_feature (211)..(212): n is a, c, g, or t
  modified_base (268)..(268): a, c, t, g, unknown or other
  misc_feature (268)..(268): n is a, c, g, or t
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggtcaggtcaatccnnccatctcctcgcgacgtcgacgcgcgtagtgtagttggttagggttacgttacttntctcgtccgtacgtacgacgacgacgaccgaccaaacgtaaccgaaaccccgtaaccgtaactaacgtaacgtttaacgttccgtaacggtacggtaacggtaacggtaaccggtaccggcccgttaccgtaacggtaacggttttaccgtttaacgttaccgttccgtttaccgtttccgttacggtcctttcccgtaccggtaccgtacggtaccgtaacccgtaccggtacccgttaccccgttacccgtaccgtaaccgttaccgttacccgttacggtacccgtacccgaacggtcccgtacgggtacggtaacggaacggtaccgtccggtaacgtttacgttaacgttcgtacgtacgtaccttactacgttacttacgtaacgttacgttacgttacgtacgttacgttcgttcgtttacggtacggtcggtaccgtacggtacgtaccgtaccgtacggtccgtccggtacccgtacgg

SEQ ID NO: 269321 - DNA, 696 bp, Homo sapiens
  misc_feature: GYAE6OF01DTKO1.16.49.E05.1.454.CMB.1.raw
  modified_base (316)..(316): a, c, t, g, unknown or other
  misc_feature (316)..(316): n is a, c, g, or t
tcagtgtactactccacgaccggtgctcgatttagagcgactagcaacacacgaaaggggggggtcacaagaggcagcgctctcgggacgtctccaccatggcctgggctctgctgcctcctcactctcctcactcaggacacagggtcctgggcccagtctgccctgactcagcctgcctccgtgtctgggtctcctggtcagtcgatccaccatcctcctgcactggaagcggcagtgattggttggggttataccgttgtctctggtaccagcagccaccagaccaaacgcccccaaactcatcgtatttagnggacgggacaaagtaacggccggtcccctagacgggttattttacctaacgttccgtactttctcgtcgggtcctacccgtaaccgttcgtacgggaccaaccggacccgggtccccttacccgtagaacctaacgttacctccgtcggtaccctccgacggacgtaggacggacggtaggtctagtaatttacttacgtcgtcgttcgcttactactttagttacgtaaacgttcgttacgtacctacgttagttacggttcggtttttacggggaccgggtacgggtaacccgttaacgggttaccggtaacccggttaccggtacggttaccgtaacccgtaccccggtaacggttcccgtccccggtaccccccgg

SEQ ID NO: 269322 - DNA, 655 bp, Homo sapiens
  misc_feature: GYAE6OF01C6U1A.16.49.E05.1.454.CMB.1.raw
  modified_base (320)..(320): a, c, t, g, unknown or other
  misc_feature (320)..(320): n is a, c, g, or t
  modified_base (367)..(367): a, c, t, g, unknown or other
  misc_feature (367)..(367): n is a, c, g, or t
  modified_base (479)..(479): a, c, t, g, unknown or other
  misc_feature (479)..(479): n is a, c, g, or t
tcagtgtactactccacgaccggtgctcgatttagagcgactagcaacacacgaaaggggggggtcacaagaggcagcgctctcgggacgtctccaccatggcctgggctctgctgctcctcactctcctcactcaggacacagggtccctgggcccagtctgccctgactcagccctgccctccgtgtctggtctcctggtcagtcatcaccatcctccagcactggagcggacagtgagttggttaggggttaataccgttgtctccgtaggtaccagcacgacacccagacaaaccgaccccaaatcatgtatttanggaggacaatacgacggtccctagacgtagtttcaactcgtacttcncgtgtactcacgtcgtagacaaccgtacggaccctcccgtagaactaacttccttacgcgtaccctacccgagtaccgaggagaccgaggtctagtattactacgtcggtcngtctagtattacgttaacgaagttccgtagttaccacgtttacgttggtttaccgttttaggggaccgggtaaacgggtacccgggttaaagggttcccgtaacccgggttaacccgtaacggttaccgaacccgggacccctaacgggttcccgtaccccggttaacccccccgg

SEQ ID NO: 269323 - DNA, 728 bp, Homo sapiens
  misc_feature: GYAE6OF01CF4I5.16.49.E05.1.454.CMB.1.raw
  modified_base (235)..(235): a, c, t, g, unknown or other
  misc_feature (235)..(235): n is a, c, g, or t
tcagtgtactactccacgaccggtgctcgatttagagcgactagcaacacacgaaaggggggggtcacaagaggcagcgctctcgggacgtctccaccatggcctgggctctgctgctcctcactctcctcactcaggacacagggtcctgggcccagtctgccctgactcagcctgcctcgtgtctggtctcctgtcagtcgatcacatctcctgcacgtggaagcggcagtgngtggttagggttactacgttgtcctcgtcggtaccagcagaccacccgaagaaccaaaccgaccccctaaacgtacagttacgtaagttttacgtacgggaagggtactaaagtaacggcccggtaccctacggtacggttaacgtttacttaacgtccgttacctttcctcgtcggtcctacccgtacgttcgtacggaccaaccggtcccgtcccttacccgtagtaacctacttaccgtccgtccggtcccgtaccgacggtacgtacggaacgggtacgacggtacgttagtaactttacgttactcggtctcgtccttaactaactttacgttaacgtagttcgtacgttaccttaacgttagtttcggtttcggttttagggaccggggttaaacgggtaaccggttaacgggtaccgttaacccggttacccggttacggtaaccggtacccggtaccgaccgggttcccgtaccccggtccccgg

SEQ ID NO: 269324 - DNA, 737 bp, Homo sapiens
  misc_feature: GYAE6OF01DX303.16.49.E05.1.454.CMB.1.raw
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatcctcctgcactggaacgcggcagtgatggttaggggttataaccttgtctctggtaccagcagccaccagacaaccgaccccaaactcatgtatttacgtggagggacaaagtaacggccggtaccctacgtaggtacgtttactaactccgtactttcgtcgtcggctaccgtaccgttcgtcgggacctaaccgacccggtccctacccgtagtacctaactccttaccgtcgggtcccttacccgaggtcgttacggaacggggaccggtagggtaccgtttaggtaaacttttacgttttaaccgtcggttaccgttacgtaccgttacctaaagtttacgtttaccgtaaacgggtttccgttacgttacctaacgtttacgttcggtttacggtttttgggggaaccgggtaacggggtaacccggtaacgggttcccggtaaccccggttaccgggttaacggtaccccggaccggtaccccgtaacggggtcccgttcccccgggtacccccccgg

SEQ ID NO: 269325 - DNA, 644 bp, Homo sapiens
  misc_feature: GYAE6OF01COLEU.16.49.E05.1.454.CMB.1.raw
  modified_base (238)..(238): a, c, t, g, unknown or other
  misc_feature (238)..(238): n is a, c, g, or t
  modified_base (282)..(282): a, c, t, g, unknown or other
  misc_feature (282)..(282): n is a, c, g, or t
  modified_base (320)..(320): a, c, t, g, unknown or other
  misc_feature (320)..(320): n is a, c, g, or t
  modified_base (431)..(431): a, c, t, g, unknown or other
  misc_feature (431)..(431): n is a, c, g, or t
tcagtgtactactccacgaccggtgctcgatttagagcgactagcaacacacgaaagggggggtcacaagaggcagcgctctcgggacgtctccaccatggcctgggctctgctgctcctcactctcctcactcaggacacagggtcctgggcccagtctgccctgactcagccctgcctccgtgtcctgggtctccgtggtcagtcgatcacatctcgtgacacgtggaacgcggtnagtgagttcggttaggggttacttacgttcgtctctaggtaccnggcacgccaccagaaccaaaccgtaccccaaactcatntatttagcggagaccaatacggccgacctgaacggttactttactaacgtcgtctttctcgtcggtaccctccgtgtaccgtcgaccgaaaccgtccggtccctaccgganactaacttctacgtcgacccgtcgagtcgtaggacggcgaggctagtacttactacgtgctagtcctatagtacttacgtacgtcgttacgtactacgtttagtcggtttacggttttcgggaccgggtaacggtaccggtaaggttcccggtaacccgttacggtaacccggtacgtaccgtacccggaacgtcccgtcccggttccccggg

SEQ ID NO: 269326 - DNA, 869 bp, Homo sapiens
  misc_feature: GYAE6OF01AQRJR.16.49.E05.1.454.CMB.1.raw
tcagtgtactactccacgaccggtgctcgatttagagcgactagcaacacacgaaaggggggggtcacaagaggcagcgctctcgggacgtctccaccatggcctgggctctgctgctcctcactctcctcactcaggacacagggtcctgggcccagtctcgccctgactcagcctgcctccgtgtcgtggtctccgtggtcagtcgatcaccatcctcctgcacgtggaacgcggcaggtgtagttggttacgggggttaacttaaccgttcgttccgttacccgttcggttaacccgaggtccgaacgaccaaccccaaacggaaaccgaaaacccgacccccctaaaacgtcctagttacgtaattttacgaggaacggggacctaaaggtaacggtccccgggtacccctaggtaacgggttaactttttaccgaaacgtttccgttccgttttacgttcccggttaccggtacccgtttacccggtacggttaccggttaccggaacccgttaaaccccggtaccccgggtacccccttaccccgtaacgaaacccgttaaaccttcccgtttccgttacccggccccttaacccggtacggtaccggttacgggaaccgggaaccggtaccggtacgttaaggtttaacttttacggttaccttcggttcttcggtacccttaacttaagtttaccgttacgtaacggtttcggttaaccgtagttaacctttggtttacggtttccgggtttaacgggtccgggtaaccgggttaaccggtaacggttcccggtaccggttaccgttaacgggtcccgtaacggtacccccggtaagggtcccgttccccggtacccccgg

SEQ ID NO: 269327 - DNA, 646 bp, Homo sapiens
  misc_feature: GYAE6OF01D8A0Y.16.49.E05.1.454.CMB.1.raw
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctcgtgtctgggtctcctggtcagtcgatcacctatctcctgcacgtggaagcggcaggtgagttggttagggggttataaccgttgtcctccgtggtaccagtcagccaccctagaaccaaaccgaccccctaaactcatgtatttagaggtaggactaagtaacgcggaccctgaggtacgtttacaattcgtactttctcgtggcctccgtacgtcgtacgctaaccgaccggtccctaccgtagaactacttcctacgtcgtcccgtccgacgggtcgtacggtacggaccgtaggtaccttagtaacttttcgtacttcggtcgtcgtcgttactattaccttgtaacggttcgtacgtctaacgttcgttcggttgtttcgggacggtacgggtaccgtagggtccgtaacccgttcgtaccggtcaaccggtcccgtaacggtcccgttccggtaccccccgg

SEQ ID NO: 269328 - DNA, 664 bp, Homo sapiens
  misc_feature: GYAE6OF01DAQZ9.16.49.E05.1.454.CMB.1.raw
  modified_base (338)..(338): a, c, t, g, unknown or other
  misc_feature (338)..(338): n is a, c, g, or t
  modified_base (436)..(436): a, c, t, g, unknown or other
  misc_feature (436)..(436): n is a, c, g, or t
tcagtgtactactccacgaccggtgctcgatttagagcgactagcaacacacgaaaggggggggtcacaagaggcagcgctctcgggacgtctccaccatggcctgggctctgctgctcctcactctcctcactcaggacacgagggtcctgggcccagtctcgccctgactcagcctgcctcgtgtcgtgggtctccgtgtcagtcgactcaccatcctcctgcacgtaggagcggcagtgagttggttaggggttaactaccgttgtcctccgttcggtaccagtcacgaccaacccaaggaaccaaaccgacccccaaactcattgtactttagnggaacggactaaagtacggccggtcctagtacggttacgtttactacgtcgtcttctcgtcggcctaccgtcgtcgtcgaccacgtccgtcctcgtanactactctcgtcgcctcgacgtcgaggacggacgaggtcttacgtaacgtttacttacgtcgtccgtgtccgttaactacgttacgttactacgttcgttactaccgttagtttacgtttcggtttcggtttacggggacgggtaacgggtaaccggttacggttaccggttacccggtacgttacggtaccgtaccgtaccgtaccggtccgttcccggtaccccgg

SEQ ID NO: 269329 - DNA, 752 bp, Homo sapiens
  misc_feature: GYAE6OF01DKPE8.16.49.E05.1.454.CMB.1.raw
tcagtgtactactccacgaccggtgctcgatttagagcgactagcaacacacgaaagggggggtcacaagaggcagcgctctcgggacgtctccaccatggcctgggctctgctgctcctcactctcctcactcaggacacagggtcctgggcccagtctgccctgactcagcctgcctccgtgtcgtgggtcctccgtggtcagtcgactcaccatcctcctgactacgtggaacgcggacaggtgagttgggttaggggttaactaccgttgtcctcgtcggtaccagcacgaccaccaacgaaccaaaccgaccccctaaactcagttacgtaatttaggaggaacgggtactaaaacggttaccggacccggtccccgttacggtaacgggttacgttttactaacgtccgttaccgtttcgtccgtcgggtacccttaccgtaccggttcgtacgggaaccctaaaccggtaccgggtcccccttaccggttacgaaccttacgttcccgttaccggtcggtacccctaccgtaggtaccgtacgggacggtacggtagtacgttagtactttacttacgtcgtcgtcgtccgtattaagttacgttacgtacgttaccgttacttacgtaacgttcgtttacggttcggtttacggggaccgggtaacgggtaaccggtacggttaccgggtacccgttacggtacggtccgaccgacccggtacgtccggttaccccgtccccgg

SEQ ID NO: 269330 - DNA, 719 bp, Homo sapiens
  misc_feature: GYAE6OF01B867U.16.49.E05.1.454.CMB.1.raw
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatcctcctgcacgtgggacgcggctagtgagttggttaggggttactaaccgttgtccttccgtaggtaccagcacgccacccgagaaccaaaccgaccccccaaactcatagtagtttagtaggagggactaaagtaacggccggtccctacgtaacgggttacgtttactaacgtccgtcctttcgtcgtcgtccctacctacgttcgtccggaccaaccgtcccggtccctcccgtagacctaacttccgtacgttccggcccgtacggacggtcgtacgggaacgggacggtacggtcgttacgttaactttacgtttaccgtcgttccgtagtacccttacgttaattaccgttaccgtaaggtttcgttacgttactacgttagtttcggttcgggttttagggaccgggtaacgggtaaccggtaacggggttacccgtacccggttacgtaccgggtaccgaccggtacccggtacgttcccggtaccccggttcccccg

SEQ ID NO: 269331 - DNA, 751 bp, Homo sapiens
  misc_feature: GYAE6OF01CEF6O.16.49.E05.1.454.CMB.1.raw
  modified_base (232)..(232): a, c, t, g, unknown or other
  misc_feature (232)..(232): n is a, c, g, or t
  modified_base (322)..(322): a, c, t, g, unknown or other
  misc_feature (322)..(322): n is a, c, g, or t
tcagtgtactactccacgaccggtgctcgatttagagcgactagcaacacacgaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggcagtcatcacatctcctgcacgtggaagcggnagtgagttggttaggggttaactaaccgttgtctccgtcggtaccagcagccaccagaccaaaccgaccccaaactcatagtatttacgnggtacggacaaagtacgccggtccctacgtaggttacgtttacctaacgtccgttcctttcgtacgttcggtcccttacccgacggttccgtcggacctaaaccggacccgggtcccttacccgtacgtaaccttaaccgttccgtttaccgtcccggtaccccgttacccggacgggtaccggttacgggaaccgggtaacgggtacggtccgttaacggtttaacttttacgtttaacgtcggttaccttacggttcttacgtaactttaccgtttaaccggtacggtttcgtaccggttcccttaaaggttcggtttacggttttcggttttacggggacgggtaacggggtaacccgtaagggttcccggtaaccgttacggtaccgtacggaccgaacccggtacggtccgtcccggtccccgg

SEQ ID NO: 269332 - DNA, 719 bp, Homo sapiens
  misc_feature: GYAE6OF01BWFFN.16.49.E05.1.454.CMB.1.raw
tcagtgtactactccacgaccggtgctcgatttagagcgactagcaacacacgaaaggggggggtcacaagaggcagcgctctcgggacatctccaccatggcctgggctctgctgctcctcaccctcctcactcagggcacgacggggtcctgggccctagtctcgccctgactcgagcctgcctcgtgtctggtctcgtggacagtcgatctactactcttcttcgtacgtccgtacgttggactcgacgtacggtagtcgggtaacggttttagttaagtttaacttaagttcgttcgtccttaccgtaacggtaaccctaacgtaccgtacccgaaggaacccaaaaccccggtccccaaattacacggtttaagttaagtttacgacgggtacgtacgttaaacggtaccgttccccgggtaccttaaggggttacggtttactaacttccgttccttcggtcggtccgtccgttaaccggtacgttcgggtaccgaaccgtacgtcccggtacccttcgacgactcggtaccctcggtcggtactaccggacggtcgacgggaacggtacggggtagttacttagttacgacgtacgactacgagtactaagtagacgtagtcgaacgtcgtactcgtacgtacgtcggttccggggacgtaggcacggtcgtactacccggtcgttacgaccgccgacgtccgtctaccccg

SEQ ID NO: 269333 - DNA, 796 bp, Homo sapiens
  misc_feature: GYAE6OF01CUL9B.16.49.E05.1.454.CMB.1.raw
tcagtgtactactccacgaccggtgctcgatttagagcgactagcaacacacgaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatcctcctgcacgtggaagcggcagtgagttgggttaggggttattaaccgttgtctccgtacggtaccagcacgccaacccagaaccaaacgacccccaaatcatagtatttagaggagggacaaacgtaacggccggtaccctacgtaacggtaacgttttacctaagttccggtacttttccgtaccgtcgggtccctttacccgtacccggttacgtacgggtacccaaaacccggtccccggtaccccttacccgtacggaaacccttaaacgttcccgttaccgtccgggtacccccgttaccggtaaccggggtaccggtaacgggggggtaaccgggtacggttaccggtttaacggttaacgtttttaacgtttaccgttacggtccgttaccggtacctttaaccgtaacgtttaacgtttaccgtaaacgtttcggttaccgttacgtacgtttaacggttggttttaccggtttccggggtacgggtaaccgggtaaccggtaacgggtttacgcccggttacgtcgggtacctacggaccctacgggtcccgtcccgtccccggttaccgg

SEQ ID NO: 269334 - DNA, 792 bp, Homo sapiens
  misc_feature: GYAE6OF01CNEWQ.16.49.E05.1.454.CMB.1.raw
tcagtgtactactccacgaccggtgctcgatttagagcgactagcaacacacgaaaggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggtcagtcgatcacctatcctcctgcacgtggaacgcgcgagtgagttgggtttaggggttaacttaaccgttgtcctaccgttcggtaccagcacgacccaaccgagaacccaaaaccggaccccccaaaactcaacttgttaatttagagggacggacaagtaaccggccggacctggtaggttactttacctaatccgtactttcgtccgtggtcctccgtacgtcgtacggacaaccggtaccgtccctaccgtcgtaacctacttccgtaccggtccggtaccctaccggtacggtcgtaacgggacgggtacggacgggtccttaagggttaactttaacgtttcgtaccgtcgttacgtacgttaccttaagtttaaccgttagttaacggtttccgttacgtttaccgtaaccgtttaggtttccggttttacggggttttttaccgggaaccggggttaacccgggggttaaccggtaaacccgggttcccggttaaaccccgggttacgggttaacggttaacccgtaacccggggtaaccccgtaaccggggttcccccgttccccgggttaaccccccccgg

SEQ ID NO: 269335 - DNA, 773 bp, Homo sapiens
  misc_feature: GYAE6OF01CT2B2.16.49.E05.1.454.CMB.1.raw
  modified_base (224)..(224): a, c, t, g, unknown or other
  misc_feature (224)..(224): n is a, c, g, or t
  modified_base (328)..(328): a, c, t, g, unknown or other
  misc_feature (328)..(328): n is a, c, g, or t
tcagtgtactactccacgaccggtgctcgatttagagcgactagcaacacacgaaaggggggggtcacaagaggcagcgctctcgggacgtctccaccatggcctgggctctgctgcctcctcactctcctcactcaggacacagggtccgtgggccccagtctcgccctgactcagcctgcctccgtgtctgggtctccgtggtcagtcgatcacatctctgnacgtggagcgcagtgagttggttgggttaataccgttgtcctcgtcggtacagacacgaccaccgaacaaccaaacccgaccccctaaatcagtagtatttaanaggtaaggaacaaacgtacggccgtacccgtaggaacgttagtttacctaacggttcctccgtttcgtcgtcgtacccgtccgtaaccgttcgaccggtaaccaaccgtacccgggttacccctaccgtaaggtaacctaaaccttccgttaccggtccggtaccctacccggtaacggtccgtaacgggacgggaaccgtacgggtaccgttaacgtaactttaacgttcgtacgtaccgttctaaccgttaccgttaacgttaacgttacccgtaagttcccgttagttacccgttagtttaccgttcggtttaccgggtttacgggaccggggttaaccgggtaacccgttaaggggttacccgttaaccccggtacggttaaccggttacccggaacccggtaaccccggtaacggtcccgtaccccggttaccccccggg

SEQ ID NO: 269336 - DNA, 599 bp, Homo sapiens
  misc_feature: GYAE6OF01A9MPY.16.49.E05.1.454.CMB.1.raw
  modified_base (482)..(482): a, c, t, g, unknown or other
  misc_feature (482)..(482): n is a, c, g, or t
tcagtgtactactccacgaccggtgctcgatttagagcgactagcaacacacgaaaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggtcagtcgatcaccatcctcctgccacgtgggaacgccggcaggtgagttgggttaggggttactaaccgttgtctccgtgtaccagcacgccaccagaaccaaaccgacccctaactctagtgtatttagaggaggactaacgtacggccggtaccctagtaggttacgtttactaatccgtacttctacgtcgtctcctacgtcgtcgacaccgccggcctacctacgactactccgtacgtcgccttacgcgtgaggacggacgtgtctagtattactcgtntcgtgtctactatacgtacgtagttatcgtactacgtcgttggttcgttagggacggacgtacggtaacggtcgtaccgttcgacggtacaccgtacgacggtcccgtccgtccccg

SEQ ID NO: 269337 - DNA, 717 bp, Homo sapiens
  misc_feature: GYAE6OF01AZ79N.16.49.E05.1.454.CMB.1.raw
  modified_base (517)..(517): a, c, t, g, unknown or other
  misc_feature (517)..(517): n is a, c, g, or t
tcagtgtactactccacgaccggtgctcgatttagagcgactagcaacacgacgaaaggggggggtcacaagaggcagcgctctcgggacgtctccaccatggcctgggctctgctgctcctcactctcctcactcaggacacgagggtcctgggcccagtctgccctgactcagcctgcctcgtgtcgtggtctccgtggtcagtcgactccgacctatcctcctgcctacgtagggaacgccggtacaggtgtagttgggtttacgggttaacttacgttcgttcctcgtacggtaccacgacgacgaccaacccgaaggaaaccaacccgaccccctaatctatagttaactttagagggaacgacgaacgtacggccgtacctagtacgttaacgtttacgtaacgtccgtctttacgcgtcggtacctccgtacgtcgtacgaccaaccgtccgtacccgtaccgagactactccgtaccgtaccgtccgtacgcgtacgaggtacggacgngttacgttagtaacgtttacgtacgtcgttaccgtagtaacctagtttaccgttagttaaccggtaggttaccgttaccttacgtacgttaccggtttacggttacgggtttacgggaaccgggttaaccgtacggtacggttaccggtaccgttaccggtacgaccgtaccaccggttacgtccccgttccgtccccgg

SEQ ID NO: 269338 - DNA, 662 bp, Homo sapiens
  misc_feature: GYAE6OF01E1PE0.16.49.E05.1.454.CMB.1.raw
  modified_base (275)..(275): a, c, t, g, unknown or other
  misc_feature (275)..(275): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctcgggcccagtctgccctgactcagcctgcctccgtgtctggtctcctggtcagtcgatcacatcctcctgcactggaacgcgcagtgattggttaggggttactaaccgttgtctccgtggtaccngcacgccaccagacctaacgacccccaacgtcagtgtatttaagtcggagggtactaagtaacgccgggtacctacgaagggtactttactaacgttccgtcttcgtacgtggtcctccgacgtcgtacggacaaaccgtcggtccctaccgtacgtacctaacgtcctcgtccgaccgttcccgaggtccgtaggacggacgacgggtcttagacgttttactacgtagtctagaccttacgattaacgttcgtaagttccgtgtacccgttaacttgttcgttaccggttttaggggacgggtaccgggaaccggttaacgggtccgtaaccggttacccgtacgtaccgacgtacccgtaacggtcccggtcccgtacccccgg

SEQ ID NO: 269339 - DNA, 722 bp, Homo sapiens
  misc_feature: GYAE6OF01BVSK3.16.49.E05.1.454.CMB.1.raw
  modified_base (132)..(132): a, c, t, g, unknown or other
  misc_feature (132)..(132): n is a, c, g, or t
  modified_base (237)..(237): a, c, t, g, unknown or other
  misc_feature (237)..(237): n is a, c, g, or t
  modified_base (441)..(441): a, c, t, g, unknown or other
  misc_feature (441)..(441): n is a, c, g, or t
tcagtgtactactccacgaccggtgctcgatttagagcgactagcaacacgacgaaaggggggtcacaagaggcagcgctcgtcgggactctccacatggcctgggctctgctgctcctcactctcctcacncgacggacacgtacgggtcctcggaccagtctcgccctagacctcgagcctgaccttcggtgtacgtgggtcctccgtaggtcaggtcactacaccattccgcgngtacagacggacgcgacgtaggtagtaggttggggtttaccgggttaacttaaccgtttgtaccgtcgtaaggtaccaggacgaccgaccgttaacccgaagaacccttaaacccgaaccctaaatcgtaattagtaacgttagcggtaaacgagaacggtacgccggttaccagttaaggttaacgttttaccaaattccgtntttcccggtttaacggcccttacgaaccgttcgaacgaccacgtccgtaccctagaaccgtacctacgtacgttccgacgtcgtaccgtacggtatacggagacgagacttagtcttagtactgacgttacgcctagtacttagtagtaacggttctaacggtacttcgtacggttatttaccgggttacggaaccggttacggtaacggttacgtcgggtaacccccgtagttaacggtccccaacgggttaaccgaagggtccccgtcggttacccccg

SEQ ID NO: 269340 - DNA, 751 bp, Homo sapiens
  misc_feature: GYAE6OF01BG38W.16.49.E05.1.454.CMB.1.raw
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggactccagcaggtgacgttggtagttataattatgtctcctaggtaccacagtacccaggacaacgacccccaaactcactgtactttataggagtactagtaactcggaccctcgtacgggtttactacgtcgtacttctcgtcggtacctcccgtacgtccgtcggacaaccgtaccggtcccttacccgtcgaaccgtaacttcccgttccggtccggtaccccgttacccgacgggtcgtacggggttaacggacccgggtacgggtaccgtttaggtaaacgttttaaccttaccgttggtccctttacgggacctttcgtaactttacgttaccgttaacggttaccggtttactacgttaccgttaagtttccggttttaccgggttttacggggaccggggttaaaccgggaccggtttaacgggtaccggttaccccgggttacgttaaccgggtacgtacccgggtacccggttaaaccgggtcccgttaccccgggtccccccggtttaacccggg

SEQ ID NO: 269341 - DNA, 630 bp, Homo sapiens
  misc_feature: GYAE6OF01B9OEA.16.49.E05.1.454.CMB.1.raw
  modified_base (137)..(137): a, c, t, g, unknown or other
  misc_feature (137)..(137): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (357)..(357): a, c, t, g, unknown or other
  misc_feature (357)..(357): n is a, c, g, or t
  modified_base (410)..(410): a, c, t, g, unknown or other
  misc_feature (410)..(410): n is a, c, g, or t
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
  modified_base (508)..(508): a, c, t, g, unknown or other
  misc_feature (508)..(508): n is a, c, g, or t
  modified_base (537)..(537): a, c, t, g, unknown or other
  misc_feature (537)..(537): n is a, c, g, or t
  modified_base (593)..(593): a, c, t, g, unknown or other
  misc_feature (593)..(593): n is a, c, g, or t
  modified_base (601)..(601): a, c, t, g, unknown or other
  misc_feature (601)..(601): n is a, c, g, or t
tcagtgtactactccacgaccggtgctcgatttagagcgactagcaacacacgaaaggggggggtcacaagaggcagcgctcgtcgggacgtctccaaccatggcctgggctctgctgctcctcactctcctcactnaggacacgagggtcctgggcccagtcctgtcctgactcagcctgcctcgtgtcgtggtctccgtggtcagtcgatcacctatctcncgactacgnggaagcggataggtagtagttaggggttagggttaacttaccgttgttcctacgtacggtaacagacgtaccgaccaaccgaagaaacccaaccgtaacccctaagtctaagtacttattacggnggtaacgaactaagacggtccggtcctaaggtacgttagttactaacgtcgtntttacgacggtacgtcctaccgacgtacgacgaccacgtaccgtctacagactactcgcgttacgctagcngtagagtangtactatacgttacacgnacttcagtactaacttaagtcgtacggtntacctagaacttggtacggttcgttagggacggtacgaagttcggactaccggttntaaaccgnggtaaccacgtacgccgtccgtaccccgg

SEQ ID NO: 269342 - DNA, 771 bp, Homo sapiens
  misc_feature: GYAE6OF01C3U5A.16.49.E05.1.454.CMB.1.raw
  modified_base (380)..(380): a, c, t, g, unknown or other
  misc_feature (380)..(380): n is a, c, g, or t
tcagtgtactactccacgaccggtgctcgatttagagcgactagcaacacacgaaaggggggggtcacaagaggcagcgctctcgggacgtctccacatggcctgggctctgctgctcctcactctcctcactcgaggacacgacgggtccgtcgggcccagtctcgccctgactcagcctgcctcgtgtcgtcgggtctccgtggtcagttcgatacactatctctgcacgtgggaagccgagagtggtaagttgggttaggggtaacttaaccgttcgtcgtccggtagtaacgacgcgaacgaccaacccgaaggtaaaccaaaacccggaccccctaaaagtcgtaagtcgtaaatttaggacggaaccgggtaanaaaaggtaaccggtccccggtaccgtaacgtacggggttaaactttaccgtaaagttcccggttactttcggtaccgttacggaccttaccgtaacgttccgacggtaacaaaccggttccgtcctaaccggttactacgtaacgttcctcgtaccggtaccgttacggaaccggtacgtagggaaccgggtaacggttaacgggtactaacgtttaacgtttaacgtaacgttcggtaccgtacgtaaccgtacgttaactacgttaaccgtaagttccgttacgactttaactggttacgttacggttttgggaaccggtagaccggtaaggtccgtaccggtacgttacggcccgttaaacggaccgtacgggtctcccggtacccgg

SEQ ID NO: 269343 - DNA, 885 bp, Homo sapiens
  misc_feature: GYAE6OF01CA0JA.16.49.E05.1.454.CMB.1.raw
  modified_base (146)..(146): a, c, t, g, unknown or other
  misc_feature (146)..(146): n is a, c, g, or t
  modified_base (247)..(247): a, c, t, g, unknown or other
  misc_feature (247)..(247): n is a, c, g, or t
  modified_base (357)..(357): a, c, t, g, unknown or other
  misc_feature (357)..(357): n is a, c, g, or t
tcagtgtactactccacgaccggtgctcgatttagagcgactagcaacacacgaaagggggggtcacaagaggcagcgctcgtcgggacgtctccaccatggcctgggctctgctgcctcctcactctcctcactcgaggacacgnggtcctcgggccctagtctcgccctgtacctcacgtccctgtcccgtcgttcgtcgtggtcctccgtggtctaggtccgatccacctacgttccttaccgngtaccgtacgacgggacggtccgggacgtaggtaggttacgggtttaggggttaaccggttttaaacttaacccgggttttctacccgttacccggttacggtaaccccnggtaccgaccgaaccccgtaacccggaaaccgaaacccgtaaaaaccccccgtaacccccggaataccttaaggttaaccgtttagtttaacgggcggaaacgggtacttaaaggtaccccggccgttacccgttaggtaacggttttaccgttaacttaccgtccggtttcctttaacgtcccggttacgtaccccgtttacgtacccggtgtacccgaaccggttcccgtaacccggtcccctacgttagaacctccgtttccgtaccgtccgtaccccgtaggaccgtacggtacgaacgggtcttacggttacttagttacgttctaaccgtcggttactaccggttacttaaggttaacttaccgttaacgttccgttacgttaccggttacttacggttttcgttaccggggtttcttaacgggggaaccgttccgggtaacggtaccggtaccggtacccggttaacggttcccgtagggtaccccgtaacggtccgtaccccgggtccttaacccccggg

SEQ ID NO: 269344 - DNA, 637 bp, Homo sapiens
  misc_feature: GYAE6OF01D86VQ.16.49.E05.1.454.CMB.1.raw
  modified_base (176)..(176): a, c, t, g, unknown or other
  misc_feature (176)..(176): n is a, c, g, or t
  modified_base (356)..(356): a, c, t, g, unknown or other
  misc_feature (356)..(356): n is a, c, g, or t
tcagtgtactactccacgaccggtgctcgatttagagcgactagcaacacacgaaaggggggggtcacaagaggcagcgctctcgggacgtctccaccatggcctgggctctgctgctcctcactctcctcactcaggacacagggtcctcgggcccagtcctgcccctgacctcngcctcgcctccgtgtcgtgggtctcgtggtcagtcgatcaccatctcctgcacgtggaagcggcagtcggtagttggttaggggttaataaccgttgtccgtctggtaccagcacgaccacagaaccaaaccgaccccaagtcatcgtattagcggaggtacaaagtacgcggcctacgngttacgttactaactcgtcttacgtcgtacgtctacgtcgtcgtacggaccaacgccgtccctaccgtagaactactacgttcgtccgtacctcggacggtacgtaggacggacgtagcttagtaactttatacgtgtacgttcgtacaacgttattacttaacggtaagttccgtagtacctacgttagttcgttccggtttagggccggaaacgggttaactaggttacccgaccgttacgacgttcgaaccggaaccgtacgccgttcccggtccccg

SEQ ID NO: 269345 - DNA, 743 bp, Homo sapiens
  misc_feature: GYAE6OF01BZI8K.16.49.E05.1.454.CMB.1.raw
  modified_base (186)..(186): a, c, t, g, unknown or other
  misc_feature (186)..(186): n is a, c, g, or t
  modified_base (727)..(727): a, c, t, g, unknown or other
  misc_feature (727)..(727): n is a, c, g, or t
tcagtgtactactccacgaccggtgctcgatttagagcgactagcaacacacgaaaggggggggtcacaagaggcagcgctctcgggacgtctccaccatcggcctgggctctgctcgtcctcctcactctccctcactcgacggacgacgacgggtccgtcgggcccagtctcgccctcgactcngcctcgccgtccgtgtcggttcggtctccgtggtcacgtacgtactccaacctcttccgtcctccgtacgacgtacgggacgtcgggactaggtagttacggtttacggggtttacgggtttaacttaaccgtttcgttccgttccggttacgaccgacgccgacgtaccccgaaccaaacggaaacctaacccgaaccccgtaacttacgtatcgttaaagttacgagggacggtaactaacgtaccggccggtacgtagtaccggtttattaacgtacgtcttacggttctcgtctacccgtcttcggcgtacacctccgacccgtcgtcgactacgtctaccgttccgtaccgtccgaggtccggtacgacgggtaccgggtagtacggttacgttaccgttagttacgtcgttcgtcctacgtcttacttcgttacgtacgttacgttacgtcgtactttgtacggttagtttccgggtaggacggggttaacgtgggtacgtacgtccggttacgtacgtcgacggtaccggtccnccggtcccgttaccgg

SEQ ID NO: 269346 - DNA, 721 bp, Homo sapiens
  misc_feature: GYAE6OF01CS86M.16.49.E05.1.454.CMB.1.raw
  modified_base (385)..(385): a, c, t, g, unknown or other
  misc_feature (385)..(385): n is a, c, g, or t
  modified_base (406)..(406): a, c, t, g, unknown or other
  misc_feature (406)..(406): n is a, c, g, or t
  modified_base (493)..(493): a, c, t, g, unknown or other
  misc_feature (493)..(493): n is a, c, g, or t
  modified_base (572)..(572): a, c, t, g, unknown or other
  misc_feature (572)..(572): n is a, c, g, or t
tcagtgtactactccacgaccggtgctcgatttagagcgactagcaacacacgaaaggggggggtcacaaggaggcagcgctcgtcgggacgtctccaccatggcctgggctctgctgcctcctcactctcctcacgtcgaggacaacgcgggttccgcgggccctagttcctcgccctgacctcacgcctcgcccgtccgtgtccgtgggtcctccgtggtacaggtctactaccacattccgtacctgacagtgggaacgcggatagtacggtaggtttggtaacggggtttaactaaccgttcgtctacggtcgtaaccgagccgacgaccaaccgaacgtaaccgaaccctaaccccaaatcaatatattacgaggtaganaagacgcgaccgtagaggttnttaccaagtcgtctacgcgtcaccgtcctagtccgaggacctaaccgcggtaccccgagtacctaactccgtacgtccgtaacccgngtacggtacggtaacgacggtacggtaccgtctttacgggtaaatttaccgttaggtcttacgtccgtaaaccgttttnaaccgttttatccgtaaaggttcggttataccctaagtttccggttacgttgggttaacgggaccgggtaaccgggttacgacggtacggttaaccccggcgttacgggaaccctaccgacccgttaaccggcccgtccgtacccccgg

SEQ ID NO: 269347 - DNA, 810 bp, Homo sapiens
  misc_feature: GYAE6OF01EGQN1.16.49.E05.1.454.CMB.1.raw
  modified_base (120)..(120): a, c, t, g, unknown or other
  misc_feature (120)..(120): n is a, c, g, or t
  modified_base (162)..(162): a, c, t, g, unknown or other
  misc_feature (162)..(162): n is a, c, g, or t
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
  modified_base (664)..(664): a, c, t, g, unknown or other
  misc_feature (664)..(664): n is a, c, g, or t
  modified_base (714)..(714): a, c, t, g, unknown or other
  misc_feature (714)..(714): n is a, c, g, or t
tcagtgtactactccacgaccggtgctcgatttagagcgactagcaacacacaaagggggggtcacaagaggcagcgctctcgggacgtctccaccatggcctgggctctgctgcctccncactctcctcactcacggacacgtagggtcctggcccagtcncgtcctgactcacgctcgcctccgtgtcgtcggtcctctgcacgtcgactcactactcctctgactacgtaggacgcgtgtagtgnggttaggttacgggttactacgttctccgtacgtcggtaccgngtaccgacgaccctaaaccgaaacgaacccgtaaaccccggtaaccccttaaacgtacgttaacgttagttaaacgttttaccgggagggtaacggtaacgtaaaacggttacccggtaacccggtccgttaaacggttaaggtttaccgttttaaccgtaaaccggtttcctttaccggtttaacgtcccggtttaccggtacccgttaccggttacgtaccggtaaacccgggtacccaaaccggttcccccgggttcccctaaccggttacgtaaaccgtttcctccggttaacccggtcggtaaccccgttagtaccgggttaccgggagacccgggttacgtacgtacgttaacttacggttaccgtntaaccgctacggtctacttagttcggtactaccgggttctacgtacgttnttacggtcgtttaggtacccggggtcgaaacggttggacccgttaggcccttaggaccgtaccgtaacccgacggttccgccccggtcccgttcgg

SEQ ID NO: 269348 - DNA, 511 bp, Homo sapiens
  misc_feature: GYAE6OF02FUBK0.16.49.E05.1.454.CMB.1.raw
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagttcgtgtcactatgtctttttggcggtagggacctaaggtcgaccgtctaggtcagcccaaggctcgtcccccg

SEQ ID NO: 269349 - DNA, 509 bp, Homo sapiens
  misc_feature: GYAE6OF02GUUAA.16.49.E05.1.454.CMB.1.raw
  modified_base (324)..(324): a, c, t, g, unknown or other
  misc_feature (324)..(324): n is a, c, g, or t
tcagtgtactactccacgaccggtgctcgatttagagcgactagcaacacacaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaatcatgatttatgagggcaataagcggccctnaggagttcaatcgcttctctggctccacgtctggcaacacggcctcctgacaatctctggcctcaggctgaggcgaggctgattatactgctgctcatattcaagttcgtgtcacttatgtctttttgggcggtagggtaccaaggtcgaccgttccgtaggtcagcccaaggtcctgtcccccg

SEQ ID NO: 269350 - DNA, 507 bp, Homo sapiens
  misc_feature: GYAE6OF02HY4E5.16.49.E05.1.454.CMB.1.raw
  modified_base (360)..(360): a, c, t, g, unknown or other
  misc_feature (360)..(360): n is a, c, g, or t
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctctggtaccagcagcacccagacaaagcccccaaatcatgattatgaggcaataagcggcctcaggatttctaatcgcttctctggctccagtctggcaacncggcctcctgacatctctgcctcagctgaggacgaggctgattattactgctgctcatattcaagtcgtgtcactatgtctttttggcggtaggacctaagggtcgtaccgtcgtaggtcacgtacccgaaggtcctacgtcccccg

SEQ ID NO: 269351 - DNA, 508 bp, Homo sapiens
  misc_feature: GYAE6OF02FUDR8.16.49.E05.1.454.CMB.1.raw
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaacgccccaaactcatgatttangagggcaataagcggcctcgaggagtttcaatcgctttctctggctcacgtctggcaacncggcctcctgacatctctcgcctcaggctgacggacgaggctgtattattactgctgctcattattcaagttcgtgtcatatgtcttttgggcgtgggacctaagggtcaccgtctacggtcacgcccaggcctcgtccccg

SEQ ID NO: 269352 - DNA, 528 bp, Homo sapiens
  misc_feature: GYAE6OF02I2FA1.16.49.E05.1.454.CMB.1.raw
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctcctggtaccagcagcacccagacaaagcccccaaaatcatgatttatgagggcaaataagcggccctcaggagttttacaatcgctttctctcggctccacgtctggcaacacggcctcctgacaatctctggcctcgagctgagacgaggctagattatactgctgctacatattcaagttctgtcaacttattcgtctttttggcggtacggaacctaaggtcgtaaccgtcgtaggtcgacgcccgtaaggccttcggacccccg

SEQ ID NO: 269353 - DNA, 508 bp, Homo sapiens
  misc_feature: GYAE6OF02GU8TH.16.49.E05.1.454.CMB.1.raw
  modified_base (226)..(226): a, c, t, g, unknown or other
  misc_feature (226)..(226): n is a, c, g, or t
  modified_base (408)..(408): a, c, t, g, unknown or other
  misc_feature (408)..(408): n is a, c, g, or t
tcagtgtactactccacgaccggtgctcgatttagagcgactagcaacacacaaaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaancggcagtgatggttgggggttataaccttgtctcctggtaccagcagcacccagacaaacgcccccaaactcatgatttatgagggcaataagcggccctcgaggtagtttctaatcgcttctctggctccacgtctgcaacacggcctcctgacaatctctcggcctcaggctgaggacgnggctgattacttactgctgctacattatcagtctgtcactatgtctttggcggtaggacagggtcgaccgttctacggtcagcccgaggcctcgtccccg

SEQ ID NO: 269354 - DNA, 518 bp, Homo sapiens
  misc_feature: GYAE6OF02HNTOJ.16.49.E05.1.454.CMB.1.raw
  modified_base (369)..(369): a, c, t, g, unknown or other
  misc_feature (369)..(369): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctcctggtaccagcagcacccagacaaagccccccaaactcatgatttatgagggcaataagcggccctcaggtatttctaatcgcttctctggctcacgtctggcaacncggcctccctgacaatctctggcctccgagctgaggacgaggctgatttatactgctgctcatattcaagttcgtgtctattgtgttcgttttgggcggtagggacctaggtcgtaccgtcgtaggtcacgccgaacggctcgtccccg

SEQ ID NO: 269355 - DNA, 584 bp, Homo sapiens
  misc_feature: GYAE6OF02HUJNG.16.49.E05.1.454.CMB.1.raw
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctcctggtaccagcagcacccagacaaacgacccccaaatcatgtattatgaagtctctaagccggtccctcgaggggtatactaatcgcttctctggctcaagtctcgacaacgacgtcctccctcgtaccgtctacgtcggtcctccagactgaggatgaggtcgtagtattacttacgtgaccctactactaataagtagaagttacgttacctaccgtcttggttcgggtttacggcgggtaacgggtaccaaggtccgtacgtacccgttacgtacggtcctacggacccgtaacgggccttaccggcccccgttaccgg

SEQ ID NO: 269356 - DNA, 654 bp, Homo sapiens
  misc_feature: GYAE6OF02IP9VH.16.49.E05.1.454.CMB.1.raw
  modified_base (313)..(313): a, c, t, g, unknown or other
  misc_feature (313)..(313): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggtcagtcgatcaccatcctcctgcacgtggaagcggcagtgagttggttagggggttataaccgttgtcctccgtaggtaccagcagcaccagacaaacgccccaaatcatgattanggaggcaagtaacgccgcctgaggtattctaatcgctttctcgtgtctcctacgttcgtcggaccaaccgaccggtcccctacccgtagaacctaacttcccgttcgtaccgggtccccttacccgagggtccgtagggaacgggaaccggtagggtctttaggtaacttttaccgtttacgtcggtaccttcgtccttatacgtttacttaccgtaacggttcgttagtacctaacgtttagttacgtttcgtttttcgggacgggtaacgggtaaccgtaagggttccggacccgttcgtacggtccgaccgtcccgaacggtcccgtaccgtcccccg

SEQ ID NO: 269357 - DNA, 728 bp, Homo sapiens
  misc_feature: GYAE6OF02G22Y3.16.49.E05.1.454.CMB.1.raw
  modified_base (212)..(212): a, c, t, g, unknown or other
  misc_feature (212)..(212): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggaaacagggtcctgggcccagtctgccctgactcagcctgcctccgtgtctgggtctccgtggtcagtcgatcacntctcctgcatggagcgcagtgagtggttaggggttactaaccgttgtctccgtggtaccagcacgcacccagaccaaacgaccccaatcatgtattagtggaggtacaagtaagccggccctcgaggtagtttactaatccgtcttctcgtcggtctccgacgttcgtacggacctaaccgccggtccccttacccgtacgtaacctaacgttccgttaccgtccggtcccctacccggacggttccgtacgggaacggaaccgggtacggtccgttagtaactttacgttacgtcgtcttacggtccttacctacgttacgtttacgttaacggttccgtttacgttaccgtaaccgttacgtttacgtttccggtttttacgggacggggttaacgggtaaacccggttaaccggggttacggttaaccccggttaccgggtttaacgggtacccgtaaccgggtaccccggtaaccgggttccccgttacccggtacccccccggtttccggg

SEQ ID NO: 269358 - DNA, 689 bp, Homo sapiens
  misc_feature: GYAE6OF02JSLBI.16.49.E05.1.454.CMB.1.raw
  modified_base (302)..(302): a, c, t, g, unknown or other
  misc_feature (302)..(302): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggagcggcagtgatggttggggttataaccttgtctcctggtaccagcagcaccagacaacgccccaatcatgtattangaggcaagtacgcggcctgaggtacgtttacaacgttcgtactttctcgtacggtcctacccgtacgttccgtaggacccaaacgtacccggtcccctcccgtacgaacctaacttccgtaccgtccgggaccctaccgtaggccgttaggaaccgggtacggacgggttccttaggttaacgtttaaccgttacgtcggtaccttagtcctacgttaactacgtttacgtaacggttccgttgtaacccacgtttagttcggtttaccgtttttaggggaccggttaacgggtaccgttaaacgggttcccggtaacccggtttcccggttaacgggttcccgaaccggtaccccgtaacgggtccccgtcccggttaccccccgg

SEQ ID NO: 269359 - DNA, 551 bp, Homo sapiens
  misc_feature: GYAE6OF02F0QBU.16.49.E05.1.454.CMB.1.raw
  modified_base (310)..(310): a, c, t, g, unknown or other
  misc_feature (310)..(310): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgattggttgggggttataaccttgtctcctggtaccagcagcacccagacaaacgcccccaaactcatgatttangagggcaataagcgcctcagtattctaatcgcttctctggctccacgtctcggcaacgacggcctccctgacaatctctcggccttcgaggtcctggacggacgtaggctgattattatcgtctgctactatttactacgtaacgttcgtgtacctacgttattgttcgtttttggcggtacgggtacctaagggtcgtacccgtcgttacggtctacggacccaggtcctccgtcccccg

SEQ ID NO: 269360 - DNA, 545 bp, Homo sapiens
  misc_feature: GYAE6OF02GDLQF.16.49.E05.1.454.CMB.1.raw
  modified_base (412)..(412): a, c, t, g, unknown or other
  misc_feature (412)..(412): n is a, c, g, or t
  modified_base (442)..(442): a, c, t, g, unknown or other
  misc_feature (442)..(442): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgtcctgactcagcctgcctccgtgtctgggtctcctggtcagtcgatcaccatctcctgcactggaagcggcagtgatgttgggggttataacttgtctcctggtaccagcagcaccagaacaaacgccccaaactcatgattagtgagggcaagtaagccggccctcgaggtacgtttctaatcgtcttctcgtggtcctccgacgtcgtggacaacgccggccctcctgactaactctctcggcctccgngcgtggacggacgaggctgtattatactcncgtcgtctctactattcaagttcgtctacacttatgttcgttttggcggtaggacctaggtcgaccgttcgtacggtcgacgacccgaggtcctccgtccccg

SEQ ID NO: 269361 - DNA, 537 bp, Homo sapiens
  misc_feature: GYAE6OF02GXR2H.16.49.E05.1.454.CMB.1.raw
  modified_base (377)..(377): a, c, t, g, unknown or other
  misc_feature (377)..(377): n is a, c, g, or t
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgattggttgggggttataaccttgtctcctggtaccagcagcacccagacaaacgcccccaaatcatgatttatgagggcaataagcggccctcaggagtttctaatcgcttctctggctcacgtctggcaacacggcctccngacaatctctcggcctccaggctgacggacgagtctgattatactgctgctacatacttcaagttcgtagtctactatagttcgttttacgggcggtaacggaacctaagggtccgtaccgttccgtaggtcacgacccgaacggtcctacggtcccccg

SEQ ID NO: 269362 - DNA, 530 bp, Homo sapiens
  misc_feature: GYAE6OF02JFJPG.16.49.E05.1.454.CMB.1.raw
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctcctggtaccagcagcacccagacaaagcccccaaatcatgattatgagggcaataagcgcctcaggagtttcaatcgcttctctggctcacgtctggcaacacgcctcctgacatcnctcgcctcgngctgaggacgagctgattactactgcttgctcatattcaagttcgtgtctactattgttcgttttgggcgggtaacgggtaccgtaagggtcgaccgttccgtacggtccgacgaccccgtaaggtccgtcccgtcccccgg

SEQ ID NO: 269363 - DNA, 569 bp, Homo sapiens
  misc_feature: GYAE6OF02GJUCV.16.49.E05.1.454.CMB.1.raw
  modified_base (305)..(305): a, c, t, g, unknown or other
  misc_feature (305)..(305): n is a, c, g, or t
  modified_base (327)..(327): a, c, t, g, unknown or other
  misc_feature (327)..(327): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctctggtaccagcagcaccagacaaacgcccccaaatcatgattanaaggcaataagcgcctcaggtntttcaatcgtcttctctggctccacgtctcggcaacgccggtcctccctagactaactctacgtcgcctcgacggctggacggacgcggcttagtatttacttacgtcgtctggtcttactagttacttacgtaagttcgttacgttcctattactgttcgttttagggcggagggtaccgaaggttcgaccggttccgtacggtacgacggacccgtaggccgttaccgcccccgttacgg

SEQ ID NO: 269364 - DNA, 606 bp, Homo sapiens
  misc_feature: GYAE6OF02IDG6W.16.49.E05.1.454.CMB.1.raw
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatcctcctgcacgtggaagcggcagtgagtggttagggggttataaccttgtctcctggtaccagcagcaccagaccaaacgcccccaaatcatcgtatttangagggcaataacgcggcctcgaggtagttnaagtcgtctttctctggctcacgtctggacacaccgcctcctgacctaatcctcgtggccctcgaggctagacggacgaggctagactttagttactgacgtgctatattacttcgtaacgttcgttagtcctacgttagttcggttcgtttttagggaccgggtaacgggtaacccgtaaggggttacccgtacccggttaccggttacggtaccgtaaccggtacccggtaacgggtcccgtacccggttaccccccggg

SEQ ID NO: 269365 - DNA, 547 bp, Homo sapiens
  misc_feature: GYAE6OF02H3VWD.16.49.E05.1.454.CMB.1.raw
  modified_base (305)..(305): a, c, t, g, unknown or other
  misc_feature (305)..(305): n is a, c, g, or t
tcagtgtactactccacgaccggtgctcgatttagagcgactagcaacacacaaaggggggggtcacaagaggcagcgctctcgggacgtctccaccatggcctgggctctgctgctctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctcctggtaccagcagcaccagacaaagcccccaaatcatgatttangaggacaataagcggcctgaggtatttctaatcgctttctctggcctcacgtctggcaacgacggcctcctgacaactctctcggcctcgagctgacggacgaggctgattattactgctgctacattacttacgagttcgtgtctattagttcgttcgttttggacgggtacgggtaccgtaagggtccgtaccggttccgttacggtcgaccgtacccgaaggtcctaccggtacccccg

SEQ ID NO: 269366 - DNA, 587 bp, Homo sapiens
  misc_feature: GYAE6OF02FIQMR.16.49.E05.1.454.CMB.1.raw
  modified_base (185)..(185): a, c, t, g, unknown or other
  misc_feature (185)..(185): n is a, c, g, or t
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (461)..(461): a, c, t, g, unknown or other
  misc_feature (461)..(461): n is a, c, g, or t
tcagtgtactactccacgaccggtgctcgatttagagcgactagcaacgtacgacaaagggggggtcacaagaggcagcgctctcgggacgtctccaccatggcctgggctctgctgctcctcactctcctcactcgaggacacaggtcctgggcccagtctgccctgactcagcctgcctcgtntctcggtctcctggtcagtcgatcacntctcngcactggancggcngtgatggttggggttanaccgttgtctcctggtaccagcagcacccagacaacgccccaaatcatgatttagngaggacaagtaacgcggccctacgagtagtttactaagtcgtctttcctcgttggccttaccacgttcgtacggccaaaccgccggtccctaccctgaacctaatcctcgtcggcccttccgaggtcctaggacggacgacggtctagtattactcngctcgctatatacgttcgaacgttcgtcgtcattagtgtttcgtttacgggccgggtaaagggtaccgtaaggtccgtacccgttacgtacggtaccaccgtacccgacgtccacccggttccccg

SEQ ID NO: 269367 - DNA, 706 bp, Homo sapiens
  misc_feature: GYAE6OF02GUM92.16.49.E05.1.454.CMB.1.raw
  modified_base (236)..(236): a, c, t, g, unknown or other
  misc_feature (236)..(236): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtnatggttggggtatactgtctctggtacagcagcaccagacaaacgcccccaaatcatagtatttagaggacggacaagtaaacgccggaccctagaaggtagtttactaatccgtactttctccgtaggtcctaccgtacgtactacggaccaaaccgtacccggtcccttacccgtacgaacctaacttccgttacgtaccggtcccttacccgaggtacgtaggaaccgggtaccggaagggttctacggtaattttaacgttacgtacgtccgttagccttaaccgtacttacttaacggtaacgtttcggttacgtacttaacgttagttacgttttaccggtttttacgggaccgggttaacggggtaaccgtaagggttacccggtaacccgtttacggtacccggttacgaacccggttaaccccggtaaccgggttaccgttacccccggttaaccccccgg

SEQ ID NO: 269368 - DNA, 721 bp, Homo sapiens
  misc_feature: GYAE6OF02FZB45.16.49.E05.1.454.CMB.1.raw
tcagtgtactactccacgaccggtgctcgatttagagcgactagcaacacacaaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcacatctctgcacgtggagcggcagtgatggttggggttataaccgttgtactccgtgtaccagcacgaccacccagaacaaacgacccccaaactcaatgtatttagacggacgggactaagtaacgccggtaccctacgaggtacgtttacaactccgtctttctcgtcggtcctaccgtacgtcgtcgaccgaaaccgtaccggtcccctcccgtaggaacctaacttccgttaccgtccgggtaccctacccggtaacgggtaccgttagggaacggggtaccgggtacgggttaccgtaggttaatttaaccttaaccgttcgtccgttacgtccttacgtactttaacgttacgttaacggttccgtttacgtacttacttacgttggtttccgttttacgggggaccgggtaacgggtaaccggtaaacgggttacccggtacccggtttaacggtaccggtaccgaccggtacccgtaacgggtcccctacccggtaccccccgg

SEQ ID NO: 269369 - DNA, 805 bp, Homo sapiens
  misc_feature: GYAE6OF02I0WX3.16.49.E05.1.454.CMB.1.raw
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcgtggtcagtcgatcaccatcctcctgcacgtggaacggtccggcagtgagttgggttaggggttataaccttgtcgtccgttagtaccgagaccacgccaccgacgaaccaaaccgaccccccaaactcgaatacgtaatttacgtggaacgggtactaaacgtaccggtccggtacccgtaggacgttacgtttacctaacgtccgtctttaccgttcgtccgtcttaccgtaccgttccgtaggacccaaccgtacccggtacccgtttacccgtaacgaaccctaacgttaccgtaccgttccggaccccgttaccgacgggtacccgttagggaccgggtaacggtacggttaccgttggttaaacgttttacttaaccgttccgtactcgttccttacttacgtttaacgtacgtaacggtttccgttacgttaccttaacgttacggtttcggtttacgggttttacgggtaccgggggttaaccgggtaaacccgggttaaaccggggttcccggttaaccccggttttaccgggtaaccggttaccggtaaccccggttaccggtaaacccgggtcccccgttaaccccgggttcccccccgg

SEQ ID NO: 269370 - DNA, 678 bp, Homo sapiens
  misc_feature: GYAE6OF02JWN8J.16.49.E05.1.454.CMB.1.raw
  modified_base (358)..(358): a, c, t, g, unknown or other
  misc_feature (358)..(358): n is a, c, g, or t
  modified_base (549)..(549): a, c, t, g, unknown or other
  misc_feature (549)..(549): n is a, c, g, or t
tcagtgtactactccacgaccggtgctcgatttagagcgactagcaacacacaaaggggggggtcacgaagaggcagcgctctcgggacgtctccaccatggcctgggctctgctgctcctcactctcctcactcaggacacagggtcctgggcccagttctcgccctgactcagcctgcctcgtgtctggtcctcctggtcagtcgactcacctatctcctggctactagggacgcggactaggttgagttggggttttagggggttacttaaccgttcgtccgttccgtacggttaccaggcacgccaaccgaacgaaccgaaaccgaaccccaaactacgaagttgttaatttanacggagggtacaaacggtaacgcccggtcctacggtaggttaacgttttactaacgttccgtacctttcgtccgtcggttcctaccgtacgtcgtacggtaaccaccgtaccgtccctacggtacacgtactctacgtccgacctacgacggtcgtaggacggtacgagtacgtatacgtttactacgtcncgtactctagtacttacgttaagttacgtgtactactacgtcgtttgtacggtttcggacgggtaacgaaccggtagccggttacgtacggtcgaaccggtgacccgtacggtcccgtcccgtacccgg

SEQ ID NO: 269371 - DNA, 730 bp, Homo sapiens
  misc_feature: GYAE6OF02G1G6G.16.49.E05.1.454.CMB.1.raw
  modified_base (219)..(219): a, c, t, g, unknown or other
  misc_feature (219)..(219): n is a, c, g, or t
  modified_base (288)..(288): a, c, t, g, unknown or other
  misc_feature (288)..(288): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctcgccctgactcagcctgcctccgtgtcgtgggtcctccgtggtctagtcgatccaaccntcctcctgctacgtagggagcggcagtgagttgggttaggggttactaacgtttgtctccgtggtaccnggcacgccacctagaaccaaccgaccccctaaatctactacgtatttagcggaacggtacaaagtacggccggtaccctacgtacggttaacgtttactaacgtcgtccttcgtcggtcggtactacccgtaggtctcggaccaaaccgtcccggtcctaccctagactaacttccgttacggtccgccctaccgtacggtacgtacgggaacgggacgtacggtcgttaacggttacttaacgttacgttcggtcgttaccgtacgttacttaacgttaacgttccgtaaacggttccgttaacggttaccttaacgttaggttccgttttacgggttttacgggacgggtaaccggtaaccggttaacggtccggtaacccgtttccgtaacgggtaccgtaccggtacccggtaacggttcccgtcccggttaccccgg

SEQ ID NO: 269372 - DNA, 527 bp, Homo sapiens
  misc_feature: GYAE6OF02GZRHR.16.49.E05.1.454.CMB.1.raw
  modified_base (400)..(400): a, c, t, g, unknown or other
  misc_feature (400)..(400): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttatgagtcagtaatcggccctcgagggtttcaatcgcttctctggtctcaagtctacggcaacacggccctcctcgaccatctcgtcgggctcgnggctggaggacggagggttgatttacttatcgcagctacatagtagagtgctagcatctgtacttcggcggtcggaccaggtctacggtaccgtccgtaggtccacggacccgtaaggcctacccgg

SEQ ID NO: 269373 - DNA, 715 bp, Homo sapiens
  misc_feature: GYAE6OF02H91OJ.16.49.E05.1.454.CMB.1.raw
tcagtgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgccctccgtgtctgggtctcctggtcagtcatcaccatcctcctgcacgtggaacgcggcagtgagttggttacggggttataaccttgtcctccgtggtaccagcagccaccagaacaacgcccccaaatcatgtatttagtgagggacaagtaacgccggtaccctacgaaggtacgtttacctaaatcccgtactttcctacgtcggtaccctccgtaacgtccgttcggaaccctaaccggacccggtccccttacccgtagaacctaacgttcccgtaccgtccgggtaccccttacccggacggtccgtaacgggacgggaccggtacggtccgtttacggtaactttaacgttaccggtcgtaccgttcgtacctttaccgttaatttaccgtttaacgtaacggtttccgttacgttacctaacgtttagttccgtttacggttttcggacgggtacggtaaccggtaggtaccgtacccgttaccgtacggtaccgaaccggtacccgtaacggtccctaccggtacccccg

SEQ ID NO: 269374 - DNA, 747 bp, Homo sapiens
  misc_feature: GYAE6OF02IUMBF.16.49.E05.1.454.CMB.1.raw
  modified_base (135)..(135): a, c, t, g, unknown or other
  misc_feature (135)..(135): n is a, c, g, or t
  modified_base (144)..(144): a, c, t, g, unknown or other
  misc_feature (144)..(144): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
tcagtgtactactccacgaccggtgctcgatttagagcgactagcaacacacgaaaggggggggtcacaagaggcagcgctctcgggacgtctccaccatggcctgggctctgctgctcctcactctcctcactnaggacacgngggtcctcgggacccagtctcgcccgtagctcagcctcgcctcgtgtcgtgggtactcctggtacngtcgatcgacctgtctccngctagtggaacgcggtcagtgagttgggttcggggttaactaccttgtaccttccgtacggtaaccagccgaacgtccgaaaccgagaaacccgaaaaccgcccctaaactaccagttaccgtaagtttacgtaggacgaactaaacgtacggccgtctacgtaggtactttagaactcgtcttcgtacgtcgtacctcgtacgtcgtacgacctaacgcgtcccgtacctagaacgtacttccgagtccggacctggaacgtcgaccggaggaacggtcggtacttaacggtaatttcgacgtgtaccgtactctttaacgtacttaacgggtttacctaccggtttaggtaccttaaggttaaaccttggtttcccggtttttacggggtccggtaaaccgggggttaaccgtaacccggtagggggttaccctaaccccgggggtttaaccgcggttaaccccgaaaaccgggtcccgtaaccggtttaccccccgggttcccggtaaacccccg

SEQ ID NO: 269375 - DNA, 720 bp, Homo sapiens
  misc_feature: GYAE6OF02JI84N.16.49.E05.1.454.CMB.1.raw
  modified_base (247)..(247): a, c, t, g, unknown or other
  misc_feature (247)..(247): n is a, c, g, or t
  modified_base (289)..(289): a, c, t, g, unknown or other
  misc_feature (289)..(289): n is a, c, g, or t
tcagtgtactactccacgaccggtgctcgatttagagcgactagcaacacacaaaggggggggtcacaagaggcagcgctctcgggacgtctccaccatggcctgggctctgctgctcctcactctcctcactcaggacacgagggtcctgggcccagtcctgccctgactcagcctgcctccgtgtcgtgggtcctccgtggtcagtcgatcaccatcctcctggacacgtggaacgcgcagttanagttggttaggggttactaacgttcggtctccgtggtaaccngaccgagtccaacctagacgaaaccgaccccctaaactcaagtacgtaatttacgagaacggtactaagtaacgaccggcctagacggttatttaccgtaacttcggccttttactcccgtagtacccttaccggtacgttccgtacgacctaaaccgccggttacctccgtacgaaccgtattaccgtcgtacgccgtacctacggcgttacgaacgggtaccgaggttacacgttaacgttaccgtaacgttcgtccgttaacgcgtttactaacgtttacgttaaccctagggtttcccgtaaggttatacccgttaagttccggttttggttttaccggggaacggtaaccgggtaaaccggtggtaacccgtaacccgttcgttacggcccgaaccggtacgtaccgccgttacccggtacccccg

SEQ ID NO: 269376 - DNA, 911 bp, Homo sapiens
  misc_feature: GYAE6OF02HKELZ.16.49.E05.1.454.CMB.1.raw
  modified_base (129)..(129): a, c, t, g, unknown or other
  misc_feature (129)..(129): n is a, c, g, or t
tcagtgtactactccacgaccggtgctcgatttagagcgactagcaacacacaaagggggggtcacaagaggcagcgctctcgggacgtctccaccatggcctgggctctgctgctcctcactctcctnacctcgagacacgagggtcctcgggcccagtctcgccctgactcacgcctcgtccgtccggtgtcgtgggtcctccgtggtcacgtcgactccacctacgtcctccgtcggtacctacggtacggacggcggtacgtaggttgtaggtttgggggtttacgggggtttaaccttaccgtttcggtccttaccggttacgggtaaccacggtaccgaacggaccccaacccggaacgtaaacccgtaaaacccgtacccccctaaaactccgtaacgttaacgttaagtttacggtaacgggaacggtaagtaaaaccggttacggtacccggtcccgttaacggtaacgggttaccttttaacgtaacccggttccgtccgttttaccggacgttaccggtacccgtaccgtccgttaacggtaccggtaaccctaaacccgggtcccggttaacccctttacccgtaacgtaccttaaccgttccgttaccgttaacccgggtcccgtaccggtacggtaccggtaaccgggtaacgggtaccgggtacggttacgttaacggtttaacgtttaaccgttcggtcggttacctcgtaccgtaacttacgttaccgttaacgttaccggttaccgtcgtaacgttacgttacggtttcggtttacggtttacggggaccgggttaaccgggtaacggttacgggtaaccgtaaccgggttacggttaccggaccgtaccggtaacccggttacccgggtccccgttacccggttacccccgg

SEQ ID NO: 269377 - DNA, 561 bp, Homo sapiens
  misc_feature: GYAE6OF01BMCRZ.9.27.C05.1.454.CMB.1.raw
  modified_base (203)..(203): a, c, t, g, unknown or other
  misc_feature (203)..(203): n is a, c, g, or t
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanagccaccctctcctgtcgggccagtcagagtgttagaagcaacttagcctggtaccaacagagacctggccagcctcccaggctcctcatctttgatgcatccacgtagggccagtggaactcccagacaggttcagtggcaggtgggtctgggacaggagttcactctcagcatcaacngcgtgcgggctagaagttntttttgttttatagttgtctagtctagtatgaattaacgtggtccttgtggtcggtacgttcggaccgaaggggacctaagggtggaatggtaaccgaaacggtacgttggtacggctacggaccaccgtattccgttagttcctttcgactttccccg

SEQ ID NO: 269378 - DNA, 625 bp, Homo sapiens
  misc_feature: GYAE6OF01DWOWF.9.27.C05.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (388)..(388): a, c, t, g, unknown or other
  misc_feature (388)..(388): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaaccaanagagacctggccagcctcccaggcctcctcattctttgatgcactccacgtagggccagtggaactcccagactaggttcagtggcaggtgggtctgggacagtagttcactctcagcatacaacngcgtggcgggtctaggtaagtttatttttgtttttatagtttgtactagtactagttatgtaacttaacgtcggtccttacgttggtacgggtaccgtttaccgggaccgtaaaacggggaccgtaaagggttgggtaacgttacggtaaaccgtaaaaaccggtacggtttgggtacggtcttacggaaccctaacccgtaacttccttaggtttcccttacgtacgtttcccccg

SEQ ID NO: 269379 - DNA, 506 bp, Homo sapiens
  misc_feature: GYAE6OF01A0BVI.9.27.C05.1.454.CMB.1.raw
  modified_base (380)..(380): a, c, t, g, unknown or other
  misc_feature (380)..(380): n is a, c, g, or t
  modified_base (481)..(481): a, c, t, g, unknown or other
  misc_feature (481)..(481): n is a, c, g, or t
  modified_base (501)..(502): a, c, t, g, unknown or other
  misc_feature (501)..(502): n is a, c, g, or t
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctccaggctcctcatctttgatgcatccactagggccagtggaatcccagacaggttcagtggcaggtgggtctggggacaggtagttcactctcagcatcaacngcgtgcgggctgaagtattttgttttatattgtcagcagtatgatactggcctgtgtggtacgttcggcctaagggaccaagggtgatgacaaacgactgnggctgccactatctgtcttnnttcc

SEQ ID NO: 269380 - DNA, 741 bp, Homo sapiens
  misc_feature: GYAE6OF01C8NMU.9.27.C05.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtcctgtctgtgtctccgaggggaaanagcccaccctctcctgtcgggccagtcagagtgtagagcaacttgcctggtaccaanagagacctggccacgccctcccaggtcctcctcattctttgactcgacactccacgtacgggccaggtcggaaactccccgaagtacgaggttcaggtcggcgtaggtcgggtacgtgggacaggtacgttcactctacgagtcaacgtacaacgacggtccggtcgggaccgggtcgttaagggtaaagttttagttttttttacggtttttttaaatttacgttttcggttacctaaggttacgtaagtttagtttacggtaaactttaaccggttcgggtaccctttacggttacgggttacggggtacccggtttaccggggaacccggtaaacgggggtacccgtaaaggggttcggtaaacgttacggttaaacccggtaaaaaccggtacggtttgggttacgggtccttacggacccgtaaaccgttagtttacccgttacggttttaacccttccgttaaccgttttcccccg

SEQ ID NO: 269381 - DNA, 752 bp, Homo sapiens
  misc_feature: GYAE6OF01BRMLM.9.27.C05.1.454.CMB.1.raw
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagacgccaccctctcctgtcgggccagtcagagtgttagaagcaacttgcctggtaccaacagagacctggccacgccctcccaggcctcctctatctttgatcgcatcccacgtagggccaggtacggaactcccgagactaggttcaggtggctaggtgggtcgtaggggactaggtacgtttaccgacttctacaacggccaacttaccgaaacgtacgggccggttgggaccggggtacttagggttaaacggtttattttttttagggtttttttaactttagttttggtacgttaggtacgttaacgtttaagtagttaacgttaaaccgttcgggtaccctttacggttacggggttacggggttaaccgggtttaccggggaaccccggtaaaacgggggtaaccccggttaaagggggtacgggttaaacggtttaccggtaaacccggtaaaaacgggtacgtttagggtacgggtccgttacggaaccctaacccgttagttacccgttacggttccctttcccgtaacgtttcccccgg

SEQ ID NO: 269382 - DNA, 842 bp, Homo sapiens
  misc_feature: GYAE6OF01AU7SZ.9.27.C05.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctccgtgtcgggccagtcagagtgttagaagcaacttagcctggtaaccaanagacgacctggccagccctcccgaggcctcctctattctttgatgctactccacgtacgggccaggtcggaactcccgaagtaccgtaggttcgaaggttggaccgtagggttcgggggttactacgggggtaactaacggttacggtttaccaacgttccgttacgaacggtacctaacgttaaccgaaaacggtcggtaccgggttacggggacccggggtacgtttaacgggttaaaaacggtttttaacgtttttttttaggtttttttaaacgttaaacggtttttcgggtaacccgtaaggtttaacccgttaaaggtttacgttaaaggttaaactttaaaccggttcccggggttaaccctttacgggtttacggggttaaccgggttaacccgggttttacccggggaaacccggtaaaaccggggggtaacccgtaaagggggttaccgggtaactttaccggtaaaacccggtaaaacggtaacggttggggttacggtacccgttcggaaacccgtacccgttaacgttccgtttaacgttacccgtttactaaccgtttacccccg

SEQ ID NO: 269383 - DNA, 781 bp, Homo sapiens
  misc_feature: GYAE6OF01CJISY.9.27.C05.1.454.CMB.1.raw
  modified_base (435)..(435): a, c, t, g, unknown or other
  misc_feature (435)..(435): n is a, c, g, or t
  modified_base (466)..(466): a, c, t, g, unknown or other
  misc_feature (466)..(466): n is a, c, g, or t
  modified_base (507)..(507): a, c, t, g, unknown or other
  misc_feature (507)..(507): n is a, c, g, or t
tcagtgatacgtctcacgaccggtgctcgatttagacgcgatcgaagggtttgggggaggaactgctcagttacggacccagacggaaccatggaacgccccagcgcagtcttctcttcctcctgcctactcgtggtcctaccagtatatacaagtggaataaatagtaatcgacgctagtcctccgacgtccttccgttgtactggttcgtaccgtacggaaggggaaactaccgccctacccttcgtccgtcgggtaccggccaagtcaggtagtacgtaagacgtactaacgtcgccgtaggtaaaccagtagacgaccggtcgacctacgtcccgtaccggacgtcccttaccacttcgttgtttacgattccgactaccgtaccgtaacggtcggacgtgacgtaccacgagacgtacggttcaggtcgngtagggtcgtacgcggaatcgtactacgtcncgtaacacgtactacaataacgcggttacgcggtaacgttntaaaggttttacggttttattttttacgtttaactgttacgtagtaccgttaagtagttaacgtaactaaccgtttaacggcgttcccgttagggttaaccggtccgggtttaaaggtaccccgggtaaacgggtaaacggttaccgggtaagttcgggggtaaccttaaaacgggtaccgttaaacgggaacggtttaccgggcgtaccttcggaaaaccctttcggaacggttttaccttcgggtttaacccttccggtaacccttccccgg

SEQ ID NO: 269384 - DNA, 502 bp, Homo sapiens
  misc_feature: GYAE6OF02GGI9P.9.27.C05.1.454.CMB.1.raw
  modified_base (201)..(201): a, c, t, g, unknown or other
  misc_feature (201)..(201): n is a, c, g, or t
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
  modified_base (431)..(431): a, c, t, g, unknown or other
  misc_feature (431)..(431): n is a, c, g, or t
  modified_base (488)..(488): a, c, t, g, unknown or other
  misc_feature (488)..(488): n is a, c, g, or t
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaccaacagagacctggccagcctccaggctcctcatctttgatgcatccactagggccagtggaatcccagacaggttcagtggcagtgggtctgggacagagttcactctnagcatcaacagcgtgcgggctgaagtnttttgttttatattgtcagcagtatgataactggcctntgtggacgttcggccaaagggaccaaggtggatgtacaacggaactgtggctgcacntctgtcttcattcc

SEQ ID NO: 269385 - DNA, 538 bp, Homo sapiens
  misc_feature: GYAE6OF02IM7N6.9.27.C05.1.454.CMB.1.raw
  modified_base (203)..(203): a, c, t, g, unknown or other
  misc_feature (203)..(203): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
  modified_base (423)..(423): a, c, t, g, unknown or other
  misc_feature (423)..(423): n is a, c, g, or t
tcagtgatacgtctcacgaccggtgctcgatttagacgcgatcgaagggtttgggggaggaactgctcagttaggacccagacggaaccatggaagcccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaccaacagagacctggccagccctcccaggctcctcatctttgatgcatccatagggccaggtgaactcccagacaggttcagtggctaggtgggtcgtggggacagtagttcactctcagcatcaacngcgtgcgggctagaagttntttttgttttatattgtanagtctagttatgatacgtggtccttcgtggtcggtacgttcggaccgtaaggggaccaagggtgatcgtacgaaacggcttggtcggctgaccacctatcgtgtcttcattcccg

SEQ ID NO: 269386 - DNA, 511 bp, Homo sapiens
  misc_feature: GYAE6OF02ID614.9.27.C05.1.454.CMB.1.raw
  modified_base (394)..(394): a, c, t, g, unknown or other
  misc_feature (394)..(394): n is a, c, g, or t
  modified_base (415)..(415): a, c, t, g, unknown or other
  misc_feature (415)..(415): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccacctctcctgtcgggccagtcagagtgttagaagcaacttagcctggtaccaacagagacctggccagcctcccaggctcctcatctttgatgcatccactaggccagtgaactcccagacaggttcagtggcagtgggtctgggacaggagttcactctcagcatcaacagcgtgcggctagaagtntttttgttttatagttgcagnagtatgataactggcctgtgtggacgttcgacaagggacaagggtgatgtacaaacgaacgtgtcggctgacacccattccgtgtcttcattcccg

SEQ ID NO: 269387 - DNA, 607 bp, Homo sapiens
  misc_feature: GYAE6OF02JFC1T.9.27.C05.1.454.CMB.1.raw
  modified_base (202)..(202): a, c, t, g, unknown or other
  misc_feature (202)..(202): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (395)..(395): a, c, t, g, unknown or other
  misc_feature (395)..(395): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaccaacagagacctggccagccctccaggctcctcatctttgatgcatccactagggccagtggaatcccagacaggttcagtggcagtgggtctgggacagagttcactctcagcatcaacngcgtgcgggntgaagtnttttgttttatattgtcagtctagtatgaactacgtggcccttgtggttaggtacccggtttcggacccgtaaagggggaccctaaaggggttcgggtaatttacgggtaacccgaaaaaccggttaacgttgggttacgggtaccctttagggacccctaacccgtagtttacccgttggttttaccctttaccgtaacgttttcccccgg

SEQ ID NO: 269388 - DNA, 710 bp, Homo sapiens
  misc_feature: GYAE6OF02FNZ3X.9.27.C05.1.454.CMB.1.raw
  modified_base (407)..(407): a, c, t, g, unknown or other
  misc_feature (407)..(407): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggcccagccctcccgaggcctcctcattctttgatgacactccacgtacggggccaggtcggaactccccaagacctaggttcaggtggctagggtggggtcgtggggacaggtacgttcacttctcagcatcaacgngcggtggcgggtactaggaaagtttattttttaggtttttaattagtttgtacgtagtacgttaagttagtagtaattaaccgttgggtacccttagttacgggttacgggtaacccggttttccggggaacccggtaaaggggtaacccgtaaagggggttcgggtaacgtttcgggttaaacccgaaaaccgggttaacggttcggggttaaccggggtaccgtttaccgggtaacccctaacccgttaacgtttacccggtttacggtttaccctttttacccgtacttttaccccccgg

SEQ ID NO: 269389 - DNA, 590 bp, Homo sapiens
  misc_feature: GYAE6OF02I9SS1.9.27.C05.1.454.CMB.1.raw
  modified_base (202)..(202): a, c, t, g, unknown or other
  misc_feature (202)..(202): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaccaacagagacctggccagcctcccaggctcctcatctttgatgcatccactagggccagtgaactcccagacaggttcaggtgcaggtcgggtctggggacaggagttcacttctacagcagtcaacgagccgtggccgggctaggaagttatttttttggtttttaatagttcgtacgagtctaagttatgtaattaaccgttggcctttacgtggttagggaccgtttcggaaccgaaaggggtacctaaagggttgggtaattcgggtacaaaacggtacgttggttcggactggacctaccgtagtccttaggtcctttcgattccccg

SEQ ID NO: 269390 - DNA, 601 bp, Homo sapiens
  misc_feature: GYAE6OF02H7OYX.9.27.C05.1.454.CMB.1.raw
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaagacgccaccctctcctggtccgggccagtcagagtgttagaagcaacttgcctggtaccaacagagacctggccagccctccaggcctcctcatctttgatgcatccacgtagggccaggtcggaactcccgagactaggttcaggtggcaggtcgggtcgtgggactagtacgttcgactcctcagtcactacaacgnggcggtggccgggtntaggtaaagtttagttttttagtttttattaacgttgttccgagtctagttactgtattacgtggtccttgtagtccgggtacgttcgggaacgtaaacgggtacctaaagggttgtaagtcgtaccgaaacggtccgttagcggcgtagacctacgtattccgtgtccctttactacttccccgg

SEQ ID NO: 269391 - DNA, 690 bp, Homo sapiens
  misc_feature: GYAE6OF02H5IGF.9.27.C05.1.454.CMB.1.raw
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
tcagtgatacgtctcacgaccggtgctcgatttagacgcgatcgaagggtttgggggaggaacgtgctcagttaggaccagaccggaaccatggaagcccagcgcagcttctcttcctcctgctactctggctcccagatatcaagtggaagaaatagtaatgacgcagtctcagccgtctgtctgtgtcncgagggaangccacctctctgtcggcagtcagntntagaancaattnctcgtacaangacnctgcngccnccagctcctnattcttnatgcagtccagtaggcctagtaggtacctcccgaagtaccgtacggttacacggttggacctaggggttcggtaccgtaggggaacaagggtacgtttacnccgttaacncgaacggctaacgccaaaagtcgcggtcggacgggttcgtaacgtaaaggttttgtttttacgtttttagtagttttcgactaagtcgtaagttactttagaacttaacgttcggtaccctttacgggttagttacgggtaccgtttaaccggggaccgtaaaccgggggtaacctaaagggggggttctaaggtttaccggtaacgttaaaaacccggccggtttggtaaccggggacttaaccgtacccgaacctttcggtaacgttttacccgggttctttaccccgttagttcccccg

SEQ ID NO: 269392 - DNA, 867 bp, Homo sapiens
  misc_feature: GYAE6OF02JK3OH.9.27.C05.1.454.CMB.1.raw
  modified_base (206)..(206): a, c, t, g, unknown or other
  misc_feature (206)..(206): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctggcctcccagatatcaatggaagaaatagtaaatgacgcagtctccagccgtcctgtctgtgtctccgaggggaaanacgcccaccctctccgtggtccgggccagtcagtagtgtagaagcaacttagcctggtaaccaagagacgaccgtggcctagcccctccgacggtcctccgtcacgttccgtttgagtgacctactcccgtaacggtacgggacctaggtacggaaacctccccgaagtaaccgtacggttcaacgggttcggacggtaggggttacggggtccgttacgggggaaccagggttacgttaccgtaaccgttcctaccggacggtacctaaccgttaccgaaaccggtcgggtaccgggttcggggacccggggttaacgttaagggttaaaaggttttttagttttttttttacgggttttttaaaagtttcgttttacgggttcgaaacggtttacttaagggtttaacttaaggttaaacgttaaccgttcgggttacccttgggttacggggttaacggggttaaccccggttaccgggtaaccccgggtaaaacgggggtaacccggtaaaggggtttacggtaaccggttacggttaaaaacccggaaccgggttaacggtttacccggggtaagggtcccgtttaacccggacccgtaaaccggttccgtttaccggtcggtttttaacccttaccgtaacccggttttcccccg

SEQ ID NO: 269393 - DNA, 675 bp, Homo sapiens
  misc_feature: GYAE6OF02FVTI2.9.27.C05.1.454.CMB.1.raw
  modified_base (298)..(298): a, c, t, g, unknown or other
  misc_feature (298)..(298): n is a, c, g, or t
tcagtgatacgtctcacgaccggtgctcgatttagacgcgatcgaagggtttgggggacggaactgctcagttacggacccagacggaaccatggaagccccagcgcagcttctcttcctcctgctactctggctcccagatatcaatggagaaatagtaatgacgcagtctccagccgtcctgtctgtgtctccgaggggaacgccaccctctcctgtccgggccagtcagtacgtgtagaatcaacttgcctgtaccaataggacgacctggaccagccctacccaggtccctccnctacgttcctttagactcggacctactccgaacgttacggggaccctaggtacggtaactccccgaagacgtaacggggtttccaggttcgggcctaggggttcggtacgtggggactaggttcttcacctcgtacacgctaacgtaccaacgacgtcggtaggccggtagttaggtaaacgtttgttttttacggtttaacttagttgttacgtacggtcttaggttactagtacttaccgtgtcctagttcggtacggtacggttaccggaacgtacgggtactaagggtagtactacggtaaccaaaccggttagtcggttacgccgttacgacctacgttcgttacgttcggttcctttaccgtccttacccg

SEQ ID NO: 269394 - DNA, 577 bp, Homo sapiens
  misc_feature: GYAE6OF02I67HV.9.27.C05.1.454.CMB.1.raw
  modified_base (203)..(203): a, c, t, g, unknown or other
  misc_feature (203)..(203): n is a, c, g, or t
  modified_base (386)..(386): a, c, t, g, unknown or other
  misc_feature (386)..(386): n is a, c, g, or t
  modified_base (531)..(531): a, c, t, g, unknown or other
  misc_feature (531)..(531): n is a, c, g, or t
  modified_base (557)..(557): a, c, t, g, unknown or other
  misc_feature (557)..(557): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanagcccaccctctcctggtccgggccagtcagagtgttaagaagctaacgttagcctggtaaccaacagacgacctggccagcccctaccgaggccttcctcacttccgtttgattcgctactcccacgtacggggccaggtcggaaactccccgagactaggttcaggtggcaaggtgggtcngggacagtacgttcacgtctcgacgtcaactacgaacgtacggccgtcggacgggtctaggtaacgttatttttgttttatagtttgtactagtactagttatagatacgtgtcctgtgtcggtcgttacggacgaggacgtagngatgtaacaacgtactgtgctcgacnctagtctctcttcgacttcc

SEQ ID NO: 269395 - DNA, 857 bp, Homo sapiens
  misc_feature: GYAE6OF02HE443.9.27.C05.1.454.CMB.1.raw
  modified_base (149)..(149): a, c, t, g, unknown or other
  misc_feature (149)..(149): n is a, c, g, or t
tcagtgatacgtctcacgaccggtgctcgatttagacgcgatcgaagggtttgggggaggaactgctcagttaggacccagacggaaccatggaagccccagcgcagcttctcttcctcctgctactctgctcccagatatcaatgganaaatagtaatgacgcagtctccagtccgtcctgtctgtcgtctaccgaaggggaaacgcgcccacccttctccgtggccgggcctaggtcaacgtaggttagttaagaacgtactaaacgttggacccgttaggtaaccaacgtaggaacggtaccgtacgggacccacgccccgtacccgaacggtccctacctacctaacgtttccgtttttagacgttaccggacctaaccgttacccgtaaccggttacgggccccgtaaggtaccggtaaacctcccccgtaaggtaaaccgtacgggtttacgtaacgggtcggaacggtacggggttcggggttacggtaacggggaaccgttaaacggtaccgtttacccgtaaccgtacccgttacggaaccgtactaaaccttacgaaaccggtaccggttcgggtacggtacgggtcgttaaacggtttaaagtttttagtttttttacggtttttaacttacggttttacgtacgttaacgtacgtttaagggttaaactacggtaaacttaacggttccgtaaccgttttggtaacgggttccggttaccggttaccggaacggttaaccggaaccgttagggtacgtaaccggttacgtaacgtaacggtccggtttagacgggtacctacggacaccttacggtcgttacgtttcctacgttccttaccccgg

SEQ ID NO: 269396 - DNA, 205 bp, Homo sapiens
  misc_feature: GYAE6OF01DF8DZ.5.38.D05.1.454.CMB.1.raw
  modified_base (144)..(144): a, c, t, g, unknown or other
  misc_feature (144)..(144): n is a, c, g, or t
  modified_base (162)..(162): a, c, t, g, unknown or other
  misc_feature (162)..(162): n is a, c, g, or t
  modified_base (167)..(205): a, c, t, g, unknown or other
  misc_feature (167)..(205): n is a, c, g, or t
tcagatcagacacgcacgaccggtgctcgatttagtatctgatagttgggtttgggtttaagtatcctgatagttgggtttcgaggcgtcggcaggacgacgctacatgcctggtcaaggacacttcctcgttctgatctgagngggctggcgaaggccgcnttagnnnnnnnnnnnnnnnnnnnnnnnnnnnnnnnnnnnnnnn

SEQ ID NO: 269397 - DNA, 181 bp, Homo sapiens
  misc_feature: GYAE6OF01DA6A7.5.38.D05.1.454.CMB.1.raw
  modified_base (157)..(181): a, c, t, g, unknown or other
  misc_feature (157)..(181): n is a, c, g, or t
tcagatcagacacgcacgaccggtgctcgatttagtatctgatagttgggttgggtttagtatctgatagttgggtttggcggcgtgcgaggacgcatagctgcctggtcaaggactacttcccgtgtctgatctgagcggcgtgcaagcgcatagnnnnnnnnnnnnnnnnnnnnnnnnn

SEQ ID NO: 269398 - DNA, 117 bp, Homo sapiens
  misc_feature: GYAE6OF02FE63M.5.38.D05.1.454.CMB.1.raw
  modified_base (114)..(117): a, c, t, g, unknown or other
  misc_feature (114)..(117): n is a, c, g, or t
tcagatcagacacgcacgaccggtgctcgatttagtatctgatagttgggtttgggtttagtatctgatagttgggttctgacggcggtcgtggacgaaggccgactaagtagnnnn

SEQ ID NO: 269399 - DNA, 498 bp, Homo sapiens
  misc_feature: GYAE6OF01EGTN2.40.84.H07.1.454.CMB.1.raw
  modified_base (434)..(434): a, c, t, g, unknown or other
  misc_feature (434)..(434): n is a, c, g, or t
  modified_base (483)..(483): a, c, t, g, unknown or other
  misc_feature (483)..(483): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccaggggaaagaggcaccctctcctgcagggcagtcagagtgttgccaccaacttaacctggtaccagcagaaacctggccagcctccaggctcctcatctatcgtgcatccaccagggccactggtactcccagccaggttcagtgcagtgggtctgggacagacttcactctcaccatcagcagcctgcagtctagaagtattttgctagtttatttctgtcagtctagtattaataacgtgggtnctctacgttcggacggagggacaaggtgagatcgaagtcgaagtggtgntcgcacatctgtctc

SEQ ID NO: 269400 - DNA, 565 bp, Homo sapiens
  misc_feature: GYAE6OF01EBQNR.40.84.H07.1.454.CMB.1.raw
  modified_base (198)..(198): a, c, t, g, unknown or other
  misc_feature (198)..(198): n is a, c, g, or t
  modified_base (394)..(394): a, c, t, g, unknown or other
  misc_feature (394)..(394): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccgaggggaaanaggcaccctctcctgcagggcagtcagagtgttgccaccaacttagcctggtaccagcagaaacctggccagcctccaggcctcctcatctatcgtgcatccaccagggccactggtactcccagccaggttcagtggcaggtgggtctggggacagacttcactctcaccatcagcagcctgctagtctgaagtnttttgctagttttatttcgtgttcagtctagttaatttataacgttggggttctcttacgtaccgtttcggggacggtaacggggtaaccgtaaaggggtggaaagtagtaccggaaaggtccggtaaacgtgggttgggaccctgaccaccctaagttccgtggttaccc

SEQ ID NO: 269401 - DNA, 549 bp, Homo sapiens
  misc_feature: GYAE6OF01BBZGP.40.84.H07.1.454.CMB.1.raw
  modified_base (197)..(197): a, c, t, g, unknown or other
  misc_feature (197)..(197): n is a, c, g, or t
  modified_base (395)..(395): a, c, t, g, unknown or other
  misc_feature (395)..(395): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccaggggaaanaggcaccctctcctgcagggcagtcagagtgttgccaccaacttgcctggtaccagcagaacctggccagcctccaggctcctcatctatcgtgcatcccaccgagggcccactggtactcccagccaggttcaggtggcaggtgggtctgggacaggtacttcactctcaccatcagcagcctgcagtctagaagtntttgacttagttttattctgtcagctagttattataacgtggtctctcgtacgtttcgggacggtacgggtaccgaagggtggaagtacgtacgaaggcggtaaacgttggtagggtcctacggtaccctaaccgtacgttccgttcgttcccg

SEQ ID NO: 269402 - DNA, 590 bp, Homo sapiens
  misc_feature: GYAE6OF01BBR84.40.84.H07.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (431)..(431): a, c, t, g, unknown or other
  misc_feature (431)..(431): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatgtgctgacgcagtctccagccaccctgtctgtgtctccgaggggaaanggcaccctctcctgcagggcagtcagagtgtcgccacaattgcctggtaccagcaagaacctggaccagccctccgaggcctcctnactctatcgtgcactccaccgaggcccagtcggtactcccagccctagggttcacggtcggacgtagggtcggggtctcggggaacctagtaccgttcactccgtaccaacctagtcgaacgcacgtcctggctagttctagaagttntttgactttagtttattctgtcagtataagttacttaagtacgttggtacgtcttacgtacggtttacgggacggtaacgggtacgtaagggtggaaacgtagtacggaacgtacggtaacgtgggtacgcgtacgtacctaactcgtcgttgttaccg

SEQ ID NO: 269403 - DNA, 590 bp, Homo sapiens
  misc_feature: GYAE6OF01BJ0LW.40.84.H07.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
tcagtctagcgactcacgaccggtgctcgatttagcagacgtctgtcgcgggggaactgctcagttaggacccagacggaaccatggaagccccagcgcagcttctcttcctcctgctactctggctcccagataccactggagaaatagtgctgacgcagtctccagccaccctgtctgtgtctccaggggaaanggcaccctctcctgcagggcagtcagagtgttgccaccaacttagcctggtaccagcagaaacctggccagcctccaggctcctcatctatcgtncatccaccagggccactggtatcccagccaggttcagtggcagtgggtctgggacagacttcactctcaccatcagcagcctgcagtctgaagattttgctagtttatttctgtcaagtcagttattataacgttgggtacgtcttccgtaacgttttccgggacgggtaacggggtaccctaaaggggttcgggtaacggtaaagtttcccgaaaagggtcccggtaaaacggttcgggttacgggacccgtttacggacccgaaccccgtaagtttccccgttagggttttaccccc

SEQ ID NO: 269404 - DNA, 631 bp, Homo sapiens
  misc_feature: GYAE6OF01DFRE8.40.84.H07.1.454.CMB.1.raw
  modified_base (228)..(228): a, c, t, g, unknown or other
  misc_feature (228)..(228): n is a, c, g, or t
  modified_base (285)..(285): a, c, t, g, unknown or other
  misc_feature (285)..(285): n is a, c, g, or t
tcagtctagcgactcacgaccggtgctcgatttagcagacgtctgtcgcggggggaactgctcagttaggacccagacggaaccatggaagccccagcgcagcttctcttcctcttgctactctggctcccagataccactggagaaatagtgctgacgcagtctccagcccaccctgtctgtgtctccgaggggaaagaggccaccctctcctgcagggcagtcagngtgtgccaccattgcctggtaccagcaagaacctggaccagccctccgaggcctccnatctatcgtgccatcccaccgagggccacgtggtactccccgagtccctaggttccaggttcggacgtagggttcggggtactaggggacctaggtacctttcgaccttcctaccacctatcgacgaccgacgcctgactacgttcgtaagtaacgtttagtttcgacgtttagttttactttcgtacgtctaacgtctaaggtttaacttaagttaacgggtggttacgtccgttacgttaccggtttacgggacgggtacgggtaacgtagggtacggagtacgttaccgaaaggtcggtaaacgttggtacgtcgttacgaccgtaccgtactcgttgttacc

SEQ ID NO: 269405 - DNA, 539 bp, Homo sapiens
  misc_feature: GYAE6OF01D5KAQ.40.84.H07.1.454.CMB.1.raw
  modified_base (198)..(198): a, c, t, g, unknown or other
  misc_feature (198)..(198): n is a, c, g, or t
  modified_base (528)..(528): a, c, t, g, unknown or other
  misc_feature (528)..(528): n is a, c, g, or t
tcagtctagcgactcacgaccggtgctcgatttagcagacgtctgtcgcgggggggaactgctcagttaggacccagacggaaccatggaagccccagcgcagcttctcttcctcctgctactctggctcccagataccactggagaaatagtgctgacgcagtctccagccaccctgtctgtgtctccaggggaaanggcaccctctcctgcagggcagtcagagtgttcgccaccaacttgcctggtaccagcagaacctggccagcctccaggcctcctcatctatcgtgcactcccaccgagggcccacgtggtactcccgagccctaggttcagtcggcaggtgggctgggacaggacttcactcctacacatcagcagcctgactagtactagaagtatttcgacttagttttacttcgtgtacagtctaagttattaactacggttggtactccttgtcgttcgggacggtagggaccgtagggtgagtagtcgaaggcgtaagtggtggctcgaccactntccgtcgttcc

SEQ ID NO: 269406 - DNA, 582 bp, Homo sapiens
  misc_feature: GYAE6OF01A10B4.40.84.H07.1.454.CMB.1.raw
  modified_base (198)..(198): a, c, t, g, unknown or other
  misc_feature (198)..(198): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccgaggggaaanaggcaccctctcctgcagggcagtcagagtgttgccaccaacttagcctggtaccagcaagaaacctggccagccctccaggctcctcatctatcgtgcatcccacgagggccacgtggtactcccagcctaggttcagtggcaggtcgggtcngggacngtacttcgactctcaccatcagcagcctgactagtctagaagtatttgacttagttttatttcgttagtctagtactaagtttaattaacgttaacgttgggtacgtccttacgttacgtttcgggacgggtaacgggtaaccgtaaggggtacggaagtacgtacggaaggtacggtaacgtgggtacggaccgtacggacctacctagttccgtcgttcccg

SEQ ID NO: 269407 - DNA, 807 bp, Homo sapiens
  misc_feature: GYAE6OF01CTTHQ.40.84.H07.1.454.CMB.1.raw
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtcctccgaggggaaagaggccaccctctcctgcgagggcaggtcagagtgttcgccaacctaacttagcctggtaaccagacaagaaacctcggaccacgccctcccaggcctcctcactctatcgtgccactcccaaccgcgggcccacgttcggtactacccgacggtccccgtagggtttcaacgggttcggacgtaacgggttcgggggttaccgtacggggaacctaacggtacccttttcccaacctttccctacccaaccctagtaccgaagtaccgaacggtcccctaggtaccgtaacggttacgttaacggtaaacggttttacgtttttacggtaccgttttaaaggttttttaacctttttaccgtttggttaacccgttaggtaccgtttaaaggttttaacttttaacggttaaaccggtttggggttacgtacccttttaccggttaacggtttttaccgggggaccggggttaaacgggggaaacccgttaaggggttacggggtaaggtaacgttaaccgggaaacgggttaccggtaaaaccggttcgggttacggtaccgtttaccggaacccgttaacccgtactttccggttcgtttaccccg

SEQ ID NO: 269408 - DNA, 555 bp, Homo sapiens
  misc_feature: GYAE6OF01ECL22.40.84.H07.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccgaggggaaanaggcaccctntcctgcagggcagtcagagtgttgccacaacttgcctggtaccagcagaacctggccagcctccaggctcctcatctatcgtgcatccaccagggccactggtactcccagccaggttcaggtcggcaggtggtctgggacaggtcttcactctacgacctatcagcacgcctgctagtctagaagtattttgcttagttttacttcgtgtctagtctaagttattagtaacgttgggtcgtcttacgtacgtttcgggacggtaacgggaaccgtaagggtggaaggtacgtacgaaggacgtaacgtggttacggcgttcgacctacgtacttcgttgttacccg

SEQ ID NO: 269409 - DNA, 595 bp, Homo sapiens
  misc_feature: GYAE6OF01BQCRH.40.84.H07.1.454.CMB.1.raw
  modified_base (197)..(197): a, c, t, g, unknown or other
  misc_feature (197)..(197): n is a, c, g, or t
tcagtctagcgactcacgaccggtgctcgatttagcagacgtctgtcgcgggggaactgctcagttaggacccagacggaaccatggaagccccagcgcagcttctcttcctcctgctactctggctcccagataccactggagaaatagtgctgacgcagtctccagccaccctgtctgtgtctccgaggggaaanggccaccctctcctgcagggcagtcagagtgtgccacaacttagcctggtaccagcaagaacctggccagcctccaggctcctcatctatcgtgcatccaccaggccactggtactccgagccaggttcagtcggcaggtgggtctggggacagtacttcgactctcaccgatcagcacgtcctgctagtcgtagtaagtcttttaggcttaaggttttactttcgtagttacgagtctaaggttaatttaacttaacggttcgggtacgtccgttacgttacggtttaccgggacgggtacgggtaacccgtaagggttacggaacggtataccggaagtaccgggtaaacgttggtacgggactacggtaccctaacgtacttcgttggtttaccc

SEQ ID NO: 269410 - DNA, 804 bp, Homo sapiens
  misc_feature: GYAE6OF01AR2BR.40.84.H07.1.454.CMB.1.raw
  modified_base (198)..(198): a, c, t, g, unknown or other
  misc_feature (198)..(198): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccgaggggaaanggcaccctctcctgcagggcagtcagagtcgttgccacctacttagcctggtaccagcaagaaacctggccagcctccgaggcctcctcatctatcgtgcactccacgaggccacgtggtactcccgagcctaggttcaggtcggcgaggttggggtcgtaggggactacggtacctttccgaaccgttccgtacccaacccgtattacccgaacggaccgtaaccggtcccgttacggaccgtaacggtttacccgttaagggttaaaacggtttcgttttttacgggaccttttaacggttttttaacgtttttcccgtttagggttacccgtaacggtttaccgttaaaggtttttaaacttttaaccggttaaacgggttttacgggggttacgtttaccccgtttaccggtttaaccgggttttacccgggggtaaccggggttaaaccggggtaaccgggttaaaacgggggttcgggtaaaccgggttaaacgttacccgggtaaaagggttacccgggttaaacggttcggggttaacgggtacccgttacggaaccccgttaaccgttacggtttcccgtttacgggttttaacccc

SEQ ID NO: 269411 - DNA, 627 bp, Homo sapiens
  misc_feature: GYAE6OF01DC87L.40.84.H07.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccgaaggggaaanggcaccctntcctgcagggcagtcagagtgtgccacaattgcctggtaccagcagaacctggccagcctccaggctcctcattccagtcgtgcactcccaccgagggcccaacgttggtaactccccgagtccaagggttccaggtcggctaggtgggtactagggacaggtacctttcaacctctaccaacctatcaacgcacgtcctggactagtcgtagtaagttattttacgacttagtttttattctgtactaacggtactaaggtttaatttaagtaacgtttggggtactccttaccgttacgtttacggggacgggtaacggtaaccgtaagggttaggaaagtaacgtacgaaaaggtaccggtaaaccgttgggtacggtaccgtacggtaccaacccgtatttcccgtggtttaccc

SEQ ID NO: 269412 - DNA, 698 bp, Homo sapiens
  misc_feature: GYAE6OF01CNDLR.40.84.H07.1.454.CMB.1.raw
  modified_base (197)..(197): a, c, t, g, unknown or other
  misc_feature (197)..(197): n is a, c, g, or t
  modified_base (379)..(379): a, c, t, g, unknown or other
  misc_feature (379)..(379): n is a, c, g, or t
tcagtctagcgactcacgaccggtgctcgatttagcagacgtctgtcgcgggggaactgctcagttaggacccagacggaaccatggaagcccagcgcagcttctcttcctcctgctactctggctcccagataccactggagaaatgtgctgacgcagtctccagccaccctgtctgtgtcctccgaaggggaaancgccaccctctctgacgagggctaggtctaggtagtcgttcgacctaacctaacttacggccttacggaaccagacctaacggaaacccgtggacccacggtccctacccgaggtcccttccgtacaacgttcctacgtccgtcgctaaccgtcccgaccgtacggccctaacgtgtaaccncccgtagtccgtaggttcgagtcggactaggggttgggaccgtacgggaactacggtaacctttcaaccctctaacacctaagtccacgacctacggcctcggacgtacgttaccgtaagttaacgttacgttttacggacttttaagttttcttcgtagttacaacgtacgtttaattaagttaacgttaagtcgggtacctacgttacgttaacgggttcgggaacggtacgggtaacgtagggtacggtaacgtaacgtaccgtaaagggtacgtgttcggtacggtactacgactactacgttcgtacgttaccg

SEQ ID NO: 269413 - DNA, 653 bp, Homo sapiens
  misc_feature: GYAE6OF01BO5S8.40.84.H07.1.454.CMB.1.raw
  modified_base (198)..(198): a, c, t, g, unknown or other
  misc_feature (198)..(198): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccgaggggaaanggccaccctctcctgcagggcagtcagagtgtcgccacaacttagcctggaccagcagaaacctggccagcctccaggcctcctcatctatcgtgcactccacgacggccacgtggtactcccgagcctaggttccaggttcggactagggtcggggtctaggggactaggtaccttcgaaccttccgtaccaccctagtccgaacgccgtacgtcccgttcgacctaagttcctaaggtaacgttagttttcggactttaggttttactttccgtagttacagttactaagtttaattaacgttaacggttgggttaccgtacctttacgttaccgggttttcgggacgggtaacggggtaaccgtaagggtggaaacgtacgtacgaaaccggtacggtaaacgttggtacgggtacctacgggtaccaaccgttacttccgttcgttacccg

SEQ ID NO: 269414 - DNA, 744 bp, Homo sapiens
  misc_feature: GYAE6OF01A7ROU.40.84.H07.1.454.CMB.1.raw
tcagtctagcgactcacgaccggtgctcgatttagcagacgtctgtcgcgggggaactgctcagttaggacccagacggaactatggaagccccagcgcagcttctcttcctcctgctactctggctcccagataccactggagaaatagtgctgacgcagtctccagccacctgtctgtgtctccgagggtaagacgacgaccctctcctcgcgacggcgagtacagagtgttcgtaccaacctaacgttacgtccgtacggtaccgacgacgaacgtaaaccgtaccggaccgacgaccctcccgaccggtctacccgtcctactccttacgtccgtcgtaccacctacccgtaccgacgggacctaccgttcggttacgtaccccgacggtaccgtagggttaccgacggtcggacgtacgggtggggtaccgttacgggacgtaacgtaccgtttaccctaccgttacctaccgaaccacgtcgaacggtccacggtacccgtcgtacggtacgtacgtacgttaaggttacttttcgttaagttacgttttttagttacgtcggtacgtaagttacgttaagttaacttttaaccgtaaggtttcggggtctaccggtttacgttaaccggggttcgggtaaccgggacgggtaacggtacggtaggtaacggtacgtacggaagtaccggttaagtcggtcgtacgtcgaaccgttactcttacggttccgttaaccg

SEQ ID NO: 269415 - DNA, 693 bp, Homo sapiens
  misc_feature: GYAE6OF01E31XJ.40.84.H07.1.454.CMB.1.raw
  modified_base (380)..(380): a, c, t, g, unknown or other
  misc_feature (380)..(380): n is a, c, g, or t
  modified_base (426)..(426): a, c, t, g, unknown or other
  misc_feature (426)..(426): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtcctccagcccaccctgtctgtgtctccgaaggggaaagcggcctaccctctccgtgcgagggcagtcagtacgtgttcgacccacctaacgttacgcctaggtacccaggaccaacgtaaacccgtgggaccctacgtcccctacccgaggtcctccctatacttctagtccggtcacctacctcccgaaccggacggccctaacgttcggtaaccnccccgacggtccttagggttcagggtcggacgtaggtcggggtacnggggaacctacgtaccgtttcaccgttcaccaccctatccgagccacgtcctcgacgtagtcgtaagtaagttatttcgtactttagttttctttcgtgtacgtagtcgtaagttaagttacgtaacggttgggttcgtaccttacggttaccggtttacgggacgggtaacggttaccggtaaggggtacggtaacgtacgtaacgtaagggaacgttacggtcgttagggactccggtaacctaccgttcgtttcgtccgttttc

SEQ ID NO: 269416 - DNA, 817 bp, Homo sapiens
  misc_feature: GYAE6OF01C7PO9.40.84.H07.1.454.CMB.1.raw
  modified_base (163)..(163): a, c, t, g, unknown or other
  misc_feature (163)..(163): n is a, c, g, or t
  modified_base (198)..(198): a, c, t, g, unknown or other
  misc_feature (198)..(198): n is a, c, g, or t
tcagtctagcgactcacgaccggtgctcgatttagcagacgtctgtcgcgggggaactgctcagttaggacccagacggaaccatggaagccccagcgcagcttctcttcctcctgctactctggctccagataccactggagaaatagtgctgacgcagtcnccagccacctgtctgtcgtctccgaaggggaaacnggcctacccgtctccgtgcgagggcaagtcgaagtagtcgttcgaccaacctaacttacgccgttaggtaccgaaggcaaaggaaaccgtggaccacggtccctaccaggcctcctcattctatcgtgcactcccgaaccgcggccacgtcgtactcccgagccgtaggtcagtcggacgtggtcgggtcgtagggactacgtacttcacgtttccacgaacctagtaccgaacggtcctaacggtcccttcggtacgacgggtttacctaagggtaaacgttttacgtttttaccggacttttaaacggtttttttacgtttcgtacgggtttactaaccgttaaggtttaactttaacgttttaaacgttaacgggttttcgggtaacccgttcctttacccggtttaacgggtttacccggggggtacccgggtaaacgggggttaaaccgggtaaaggggttacggggtaaacgtttaccggggtaaccgtaaaaccggggttaaacgggtttaacccggttcggggggtttaaacccgggccgtttaaaccgggaaacccccgtttacccgggtttaaacttttcccgggtttttaacccgggttttaaccccc

SEQ ID NO: 269417 - DNA, 605 bp, Homo sapiens
  misc_feature: GYAE6OF01B1E7O.40.84.H07.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
  modified_base (599)..(599): a, c, t, g, unknown or other
  misc_feature (599)..(599): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggaagaaatgtgctgacgcagtctccagccacctgtctgtntctcgaggggaaancggccaccctctccngcagggcagtcagngtgtcnccacaagttcgccttggaccagcaacgaacctggccacgccctccgagcctcctcatctatcgncactccacgcggccatggtacncccgagccgtaggttcaggtcggtcagggtcggtacgtgggacaggtaccttcgactctacacctatcgagcacgtcctgacgtagtactagtaagttgtttagtactttagttttattctaggtactaagtcgttaacgttaatttaacgtaacggttggttacgtaccgttacggttaacgtttccggggacgggtaaacgggtaccggtaaaggtcgggtaacgtagtaaccgaaggtcgtaaacggtcgtaggcctacggacctaagtcttccggttnttaccg

SEQ ID NO: 269418 - DNA, 762 bp, Homo sapiens
  misc_feature: GYAE6OF01EX7YE.40.84.H07.1.454.CMB.1.raw
  modified_base (367)..(367): a, c, t, g, unknown or other
  misc_feature (367)..(367): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (690)..(690): a, c, t, g, unknown or other
  misc_feature (690)..(690): n is a, c, g, or t
tcagtctagcgactcacgaccggtgctcgatttagcagacgtctgtcgcggggggaactgctcagttaggacccagacggaaccatggaagcccccgacgcagcttcctcttcctcctgctactctggctcccagataccactggagaaatagtgctgacgcagtctccagccaccctgtctcgtgtcctccacggggaaagacggcacccgtcctcctcgcacggggccagtccagaggttcgtttcggaccccaaccgttaaacccgcttaacggtacccgtacggtacccgtaacggtaacccgtacggaaaccccgtacgggtccccgtaccgacccggtaccccgtacccggtaccgtaccntncctacttaccgnttacgttaccgttacggtaccgaccgtacccgtaccccgtaaccgggtaccggtaccctacggtacgtacccgtaccgtaccgtacggttacgtacggtacgggtcggtacggtacgggtacggtaccgggtaccgtacgtaccgttaccgtacctacctaccgtacccgtaactaccgtacgaccgacgtaccgtacctagttccgncngtttcgttaacgtaacgttttcgttacgtacgtttaagtttacgttacgttacgtacggtacgtacgtacgttaacgttaacgtacggttacggtaccntaccggtacggtttacgggtccgggtacgggtaacggaacggtacggtacggagtacgtaacgtacggtacg

SEQ ID NO: 269419 - DNA, 790 bp, Homo sapiens
  misc_feature: GYAE6OF01BRPU9.40.84.H07.1.454.CMB.1.raw
  modified_base (151)..(151): a, c, t, g, unknown or other
  misc_feature (151)..(151): n is a, c, g, or t
  modified_base (341)..(341): a, c, t, g, unknown or other
  misc_feature (341)..(341): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctccagataccactggagaaatagngctgacgcagtctccagcccaccctgtctgtgtctacgaggggaacgacggccaccctctcctgcgagggcagtgagtagtgttcgccactaacttacgccgtaggtaccagaccgaacgtaaacccgtgggccaaccggtcccctacccgacggtcccttaccctactaacgttacctacgtttccggngacccgtaaccttcccggaaacccggaccggggtccctaaaccggtttccgggtaaccctttcccccggaacggtcccgttaaggggtttacgacgggggttcggtccggtaggggttcggggttacggtacgggaacgtacgtaccgtttaccacgtacctccacctacgtacacgtcacgtccgtagccgtagttacgtagttaacgttacgttttacgtacgttttagttttcgttccgttgtactagttacgttaacgttagtttaacggtaacggttgggttaccgttaccggttacccggttttacggtttaacccggggggacggggtttaaaccggcgggttaaacgggtgggtaaacggacggtaccggtaagggaccggttacggttggaccgggtcctacccggtacgtaaccttacggtttcccgttgtttaacccg

SEQ ID NO: 269420 - DNA, 708 bp, Homo sapiens
  misc_feature: GYAE6OF01A8IH1.40.84.H07.1.454.CMB.1.raw
  modified_base (414)..(414): a, c, t, g, unknown or other
  misc_feature (414)..(414): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggcctcccagataccactggagaaatagtgactgacgcagtctccagcccaccctgtcctgtcgtctaccgaggggaaaagcggtccaccctctcctgccaagggccagtcaggagtgttcgacccactaacttgccgttggtacccaggtcaacggaaacccgtggaccctaggcccctacccgaggccctccgtacatacctacgtacgtcacgactcccgaacgacgggtacccacgtcggtacctcccgaaggcctaggttcaggtcgctaggtggtcgtgggacngtactcactccgtacaccagtcgacgacgacgtccgtcgcgtacgtcgtacgtaacgttagtttacgtacgttacgttttactttacgttacgttaccgtacgtacgtacgttaagttaacgttaacggttacgggttacgttaccgttaccgttaccggaccgggttttttttttaccgggaacgggtaaccggtaacgggtacggtacggtaacgtaccggtaacggtaaccggtaccggttacggtcggtacgtaccggtacccgtacccgtacttacgttcgtttacccg

SEQ ID NO: 269421 - DNA, 757 bp, Homo sapiens
  misc_feature: GYAE6OF01C7H73.40.84.H07.1.454.CMB.1.raw
  modified_base (154)..(154): a, c, t, g, unknown or other
  misc_feature (154)..(154): n is a, c, g, or t
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (463)..(463): a, c, t, g, unknown or other
  misc_feature (463)..(463): n is a, c, g, or t
tcagtctagcgactcacgaccggtgctcgatttagcagacgtctgtcgcggggggaactgctcagttaggacccagacggaaccatggaagcccaagcgcagtcttctcttcctcctgcttacctctggcctacccagacttaccacgtggaanaatagtgctgacgcacgtcctccagcccaccctgtctgtgtctccgaaggggaacnggccacctcnccgtgacgaggcagtacaggacgttagttcgccctaacgtaacttcggaccttcggtaaccacggtcaaacgtaacccgtcggacccaaccgccctcccgtacggtccctccgttacacttacgttaacgttcggtacaccctacgaccccgaaccggtacggtacctacggttacgtaccctcccgacgtccggtagtccgaagggttcgaccggtagggttccgggagtaccggggtaaancgtacccttacacccgtcctaaccgtaacccttgcgaccgtaccgtacgccgtacgtacgtaacgtcgttaacgttaacgtttgtttaccgtacgttttaggttttactttacgtcgttactaacggtacttaacgttaactttaacggttaacggttccgggtttactcgttaccggttcggtttaaccggggcggtaaaccgggttacgggaggttaaacggacggttaacggacgtaacggtactacgggtacgtcgtacgtacctacactttcgacccgttggttaaccc

SEQ ID NO: 269422 - DNA, 505 bp, Homo sapiens
  misc_feature: GYAE6OF02F0JAR.40.84.H07.1.454.CMB.1.raw
  modified_base (196)..(196): a, c, t, g, unknown or other
  misc_feature (196)..(196): n is a, c, g, or t
  modified_base (436)..(436): a, c, t, g, unknown or other
  misc_feature (436)..(436): n is a, c, g, or t
tcagtctagcgactcacgaccggtgctcgatttagcagacgtctgtcgcgggggaactgctcagttaggacccagacggaaccatggaagccccagcgcagcttctcttcctcctgctactctggctcccagataccactggagaaatagtgctgacgcagtctccagccaccctgtctgtgtctccaggggaaanaggcaccctctcctgcagggcagtcagagtgttgccaccaacttagcctggtaccagcagaaacctggccagcctcccaggctcctcatctatcgtgcatcccaccagggccactggtatccccagccaggttcagtggcagtgggtctgggacaggacttcactctcaccatcagcagcctgcagtctgaagtatttgctagtttatttctgtcagtctagttattataacgttgggtntctctacgtttcggcggtagggacctaaggtggagtatcgaagcgtaactgtggctgccaccatctgtc

SEQ ID NO: 269423 - DNA, 512 bp, Homo sapiens
  misc_feature: GYAE6OF02HR4LE.40.84.H07.1.454.CMB.1.raw
  modified_base (386)..(386): a, c, t, g, unknown or other
  misc_feature (386)..(386): n is a, c, g, or t
  modified_base (433)..(433): a, c, t, g, unknown or other
  misc_feature (433)..(433): n is a, c, g, or t
tcagtctagcgactcacgaccggtgctcgatttagcagacgtctgtcgcgggggaactgctcagttaggacccagacggaaccatggaagccccagcgcagcttctcttcctcctgctactctggctcccagataccactggagaaatagtgctgacgcagtctccagccaccctgtctgtgtctccaggggaaagaggcaccctctcctgcagggcagtcagagtgttgccacaacttagcctggtaccagcagaaacctggccagcctcccaggctcctcatctatcgtgcatccaccagggccactggtactcccagccaggttcagtgcagtgggtctgggacagcttcactctcaccatcagcagcctgcagtctgaagtntttgctagtttatttctgttcagctagttattaagttaacttgggtntcgttctacgtttcggacggtagggtaccaagggtggagagtcgaagcgaacgtgtggtcgtgcctaccgatctgtacc

SEQ ID NO: 269424 - DNA, 506 bp, Homo sapiens
  misc_feature: GYAE6OF02G7NN9.40.84.H07.1.454.CMB.1.raw
  modified_base (196)..(196): a, c, t, g, unknown or other
  misc_feature (196)..(196): n is a, c, g, or t
tcagtctagcgactcacgaccggtgctcgatttagcagacgtctgtcgcgggggaactgctcagttaggacccagacggaaccatggaagccccagcgcagcttctcttcctcctgctactctggctcccagataccactggagaaatagtgctgacgcagtctccagccaccctgtctgtgtctccaggggaaanaggcaccctctcctgcagggcagtcagagtgttgccaccaacttagcctggtaccagcagaaacctggccagcctcccaggctcctcatctatcgtgcatccaccagggccactggtatcccagccaggttcagtgcagtggtctgggacagacttcactctcaccatcagcagcctgcagtctagaagtatttgctagtttatttctgtcagtctagttattataacgtggtgtctctacgtttcggcggtaagggaccgaagggtggagtagtcgaagacggaatgtggctgactaccagttctgttc

SEQ ID NO: 269425 - DNA, 532 bp, Homo sapiens
  misc_feature: GYAE6OF02HSPKC.40.84.H07.1.454.CMB.1.raw
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtatccagccaccctgtctgtgtctccaggggaaagaggcaccctctcctgcagggcagtcagagtgttgccaccaacttagcctggtaccagcagaaacctggccagcctcccaggctcctcatctatcgtgcatccaccagggccactggtactcccagccaggttcagtcggcagtgggtctggggacaggacttcactctacaccatcagcagcctgcagtctgaagtattttgcttagtttatttctgttcagctagttattataacgttgggtgtcttcgtacgtttcggcggtagggaccgtaagggtggagtacgtacgaagcgtaacgtggtaggcgtcggacctaccgtattcctgttacc

SEQ ID NO: 269426 - DNA, 641 bp, Homo sapiens
  misc_feature: GYAE6OF02HXPE0.40.84.H07.1.454.CMB.1.raw
  modified_base (198)..(198): a, c, t, g, unknown or other
  misc_feature (198)..(198): n is a, c, g, or t
tcagtctagcgactcacgaccggtgctcgatttagcagacgtctgtcgcgggggaactgctcagttaggacccagacggaaccatggaagccccagcgcagcttctcttcctcctgctactctggctcccagataccactggagaaatagtgctgacgcagtctccagcccaccctgtctgtgtctccgaggggaaanggcaccctctcctgcgagggcagtcagagtgtgccacacttgcctggtaccagcaagaaacctggcccagccctcccaggcctcctcatctatcgtgcctatcccaccgagggcccacgttggtactccccgagccctagggttccaggtcggacgtaggtcgggttacgtagggggaacctaggtacctttccgaccttccgtaccgacccgtataccgaacgccaacggtccctggacctacgttacgtagtaaaggttacttttgaccttttaagttttacgtttcttacggttcaagtctaagtttattaacgttaacggttgggtactcgttaccgttacgtttccggggaggaacgggttaccgtaaggggtcgaagtacgtacggaacggtcgtaacgttggtaggtccgttagcctacgtattccgttggttacc

SEQ ID NO: 269427 - DNA, 571 bp, Homo sapiens
  misc_feature: GYAE6OF02JJFFK.40.84.H07.1.454.CMB.1.raw
  modified_base (198)..(198): a, c, t, g, unknown or other
  misc_feature (198)..(198): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
tcagtctagcgactcacgaccggtgctcgatttagcagacgtctgtcgcggggggaacgtgctcagttaggacccagacggaaccatggaagccccagcgcagcttctcttcctcctgctactctggctcccagataccactggagaaatagtgctgacgcagtctccagccaccctgtctgtgtctccaggggaaanaggcaccctctcctgcagggcagtcagagtgttgccaccaacttagcctggtaccagcagaaacctggccagcctcccaggcctcctcatcctatcgtgccatcccaccgagggcccacttggtactcccagcccaggttcaggtggcaggtgggtctgggacagtacttcacttcncaccntcagcagcctgctagtctagaagttntttcgcttagttttatttcgtcgttacacgtctagttattaagtaacgttgggtacgtcttacgtaccgttttcgggacgggtacggaaccgtaagggttggaagtacgtacgaaggtacggtaacgtggtacggcgttcggacctaccgtagttccgttagttc

SEQ ID NO: 269428 - DNA, 674 bp, Homo sapiens
  misc_feature: GYAE6OF02GPF42.40.84.H07.1.454.CMB.1.raw
  modified_base (329)..(329): a, c, t, g, unknown or other
  misc_feature (329)..(329): n is a, c, g, or t
  modified_base (403)..(403): a, c, t, g, unknown or other
  misc_feature (403)..(403): n is a, c, g, or t
tcagtctagcgactcacgaccggtgctcgatttagcagacgtctgtcgcgggggaactggctacagttacggacccaggacggaaccactggaagccccagcgcagcttctcttcctcctgctacgtctggctccctagataccacgtggagaaatagtgctcgacgcagtctccagccacctgtctgtgtctccgaggggaaagaggcaccgtctcctgcagggccagtcagagtgttgacctaccaattcgcctaggtaccagcaagtaaacctggcctagcctaccgaggccttccgcaagtcctagtccgtgactagtccaacgnggccacgttggtaactccccgagacccgtaagttccaagttcggcaggttcgggtctagggaccaggtaccttnacttctacactagtcacgcacgcctgactacgtcgtacgaagtacttttgcttaagtttactttcgttagtaccgagtaccgtagttaacgttaagttaaccgttcgggggttactccgttacccgttaacgggtttttcccgggacggtaaaccgggttaccgttaacggggttagaacggtaagttaacccggaaaggtacccggtaaaccgttgggttacgggtaccgtttacgggtacctaaccgtacgtttcggtacgtttacccg

SEQ ID NO: 269429 - DNA, 517 bp, Homo sapiens
  misc_feature: GYAE6OF02GN59I.40.84.H07.1.454.CMB.1.raw
  modified_base (197)..(197): a, c, t, g, unknown or other
  misc_feature (197)..(197): n is a, c, g, or t
  modified_base (440)..(440): a, c, t, g, unknown or other
  misc_feature (440)..(440): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccaggggaaanggcaccctctcctgcagggcagtcagagtgttgccaccaacttagcctggtaccagcagaaacctggccagcctccaggctcctcatctatcgtgcatcccaccagggccacgtggtactcccagccaggttcagtggcaggtggtctgggacagacttcactctcaccatcagcacgcctgctagtctagaagtatttgacttagtttatttctgtcagtctagttattataacgttgggtntcttctacgtttcggacggtagggaccgtaaggtggagtagtcgaagtcgaagtggtggctcgaccacgatcgtgtc

SEQ ID NO: 269430 - DNA, 544 bp, Homo sapiens
  misc_feature: GYAE6OF02HIGMB.40.84.H07.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccaggggaaanggcaccctntcctgcagggcagtcagagtgttcgccacaacttagcctggtaccagcagaaacctggccagcctccaggcctcctcatctatcgtgcatcccaccgaggccacgtcggtactcccgagcccaggttcaggtcggctaggtgggtctggggacagtacttcactctcacctatcagcacgcctgcagtctagaagtattttcgacttagtttactttctgtcagtctagttattagtacgttgggtctctcttacgttcgggcggacgggtaccaagggtggagtacgtcgaacggtcgtaacgtggtacggtcgtcgaccgacctagtccttgttcc

SEQ ID NO: 269431 - DNA, 492 bp, Homo sapiens
  misc_feature: GYAE6OF02JE1CZ.40.84.H07.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (360)..(360): a, c, t, g, unknown or other
  misc_feature (360)..(360): n is a, c, g, or t
tcagtctagcgactcacgaccggtgctcgatttagcagacgtctgtcgcgggggaactgctcagttaggacccagacggaaccatggaagccccagcgcagcttctcttcctcctgctactctggctcccagataccactggagaaatagtgctgacgcagtctccagccaccctgtctgtgtctccaggggaaanggcaccctntcctgcagggcagtcagagtgttgccaccaacttagcctggtaccagcagaacctggccagcctccaggctcctcatctatcgtgcatccacagggccactggtatcccagccaggttcagtggcagtgggtctgggacagcttcactctcaccntcagcagcctgcagtctgaagtattttgctagtttattctgtcagtctagtattataacgtggtctctctacgtttcggcggtaggaccgtaaggtggagatcgaagcgaactgtggctgcaccgatctgtc

SEQ ID NO: 269432 - DNA, 595 bp, Homo sapiens
  misc_feature: GYAE6OF02F6A67.40.84.H07.1.454.CMB.1.raw
  modified_base (198)..(198): a, c, t, g, unknown or other
  misc_feature (198)..(198): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccgaggggaaanggcaccctctcctgcagggcagtcagagtgttcgccaccaacttacgcctggtaccagcaagaaacctggccagcctcccaggcctcctcatctatcgtgcactcccaccgagggccacgtggtactccccagccctaggttcaggtcggctagggtcgggtctaggggactaggtaccttcacgtctaccacctatcagcacgcctgcagtctagtaagttatttcgacttagttttactttcgtgtacagtactaagttattagtaacgttgggtactctcgtacgtttcgggacggtaacgggtaaccgtaagggtggaacgtacgttacgaaacggtaccggtaacgttggtacggtcgttacggaccgtaaccgtacgttccgttcgttacc

SEQ ID NO: 269433 - DNA, 553 bp, Homo sapiens
  misc_feature: GYAE6OF02HTT7Z.40.84.H07.1.454.CMB.1.raw
  modified_base (394)..(394): a, c, t, g, unknown or other
  misc_feature (394)..(394): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccgaggggaaagaggcaccctctcctgcagggcagtcagagtgttgccaccaacttgcctggtaccagcaagaaacctggccagcctccaggcctcctcatctatcgtgcatcccaccaggccacgtggtactcccagccaggttcagtgcagtggtctgggacagtacttcactctacaccatcagcacgcctgcagtctagaagtnttttgcttagtttactttcgtgtcagtctaagttattagtaagttgggtactcttcgtacgtttcgggacggaacgggtaccgtaagggtggagtacgtaacgaacggtacgtaacgttggtcggtcttacggacctaccgtagttccgttagttaccg

SEQ ID NO: 269434 - DNA, 547 bp, Homo sapiens
  misc_feature: GYAE6OF02GVDSB.40.84.H07.1.454.CMB.1.raw
  modified_base (361)..(361): a, c, t, g, unknown or other
  misc_feature (361)..(361): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccaggggaaagaggcaccctctcctgcagggcagtcagagtgttgccacaacttagcctggtaccagcagaacctggccagcctccaggctcctcatctatcgtgcatccaccagggccactggtactcccagcctaggttcaggtggcaggtgggtctgggacagcttcactcncaccatcagcagcctgctagtctagaagtattttgacttagttttactttcgttgtctagtctagttattagtaacgttgggtctacgttcttacgtttcgggacggtaacgggtaccgtaagggttggaagtacgtacgaagaccgtaagtcggttagcgtcgaccacctagttcgtagttaccg

SEQ ID NO: 269435 - DNA, 591 bp, Homo sapiens
  misc_feature: GYAE6OF02GPHYQ.40.84.H07.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccaccctgtctgtgtctccaggggaaanggcaccctntcctgcagggcagtcagagtgttgcccaccaacttagcctggtaccagcaagaaacctggccagcctccaggcctcctcatctatcgtgcatcccaccgaggcccagtggtactcccagccaggttcaggtcgcaggtgggtctgggacagtacttcactctaccaccatcagcacgcctgcagtctagaagtattttgacttagttttactttcgtgttactagtactagttacttagttaacggttgggtacgtcttacgttacgtttcgggaccgggtaagggaccgtaagggttagggtacgtacgttacggaacggtaccggtaacgttagggttacggtacgttacggtacccgtaccgtaacgttccgtagttacccg

SEQ ID NO: 269436 - DNA, 523 bp, Homo sapiens
  misc_feature: GYAE6OF02HEOSH.40.84.H07.1.454.CMB.1.raw
  modified_base (197)..(197): a, c, t, g, unknown or other
  misc_feature (197)..(197): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (444)..(444): a, c, t, g, unknown or other
  misc_feature (444)..(444): n is a, c, g, or t
  modified_base (519)..(519): a, c, t, g, unknown or other
  misc_feature (519)..(519): n is a, c, g, or t
tcagtctagcgactcacgaccggtgctcgatttagcagacgtctgtcgcgggggaactgctcagttaggacccagacggaaccatggaagccccagcgcagcttctcttcctcctgctactctggctcccagataccactggagaaatagtgctgacgcagtctccagccaccctgtctgtgtctccgaggggaaanaggccaccctctcctgcagggcagtcagagtgttcgccaccaacttagcctggtaccagcagaaacctggccagcctcccaggcctcctcatctatcgtgcactccaccagggccacgtggtactcccagccctaggttcagtggcaggtgggtctgggacagtactcactcncaccntcagcacgctgcagtctagtaagtntttgcttagtttatttctgtcagtgtagttattagtaagtggtntctacgtacgttcggcggtaggacgaggtgagtacgacgaagacgtaagtggtagtcgtcgacctacacttcgtntccg

SEQ ID NO: 269437 - DNA, 550 bp, Homo sapiens
  misc_feature: GYAE6OF02IJLLA.40.84.H07.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
  modified_base (425)..(425): a, c, t, g, unknown or other
  misc_feature (425)..(425): n is a, c, g, or t
  modified_base (467)..(467): a, c, t, g, unknown or other
  misc_feature (467)..(467): n is a, c, g, or t
tcagtctagcgactcacgaccggtgctcgatttagcagacgtctgtcgcgggggaactgctcagttaggacccagacggaaccatggaagccccagcgcagcttctcttcctcctgctactctggctcccagataccactggagaaatagtgctgacgcagtctccagccaccctgtctgtgtctccaggggaaanggccaccctntcctgcagggcagtcagagtgttcgccaccaacttagcctggtaaccagccaagaaaccctggcccagccctaccccaggcctcctcattctatccgtgccactcccaccgagggcccagttggtactccccgagccctaggttcaggtcggcaggttcgggtctagggacagtacttcactctcaccntcagcagtccngcagtctagagtattttgnttagttttatttctgtcagtctaagttattataacgttggtntcgttcgtacgtttcgggacggtacgggaccgtaggtcgagtagtacgaagcgtaacgtggtcggctcgaccacgtatctgtc

SEQ ID NO: 269438 - DNA, 639 bp, Homo sapiens
  misc_feature: GYAE6OF02F54MS.40.84.H07.1.454.CMB.1.raw
  modified_base (198)..(198): a, c, t, g, unknown or other
  misc_feature (198)..(198): n is a, c, g, or t
  modified_base (397)..(397): a, c, t, g, unknown or other
  misc_feature (397)..(397): n is a, c, g, or t
tcagtctagcgactcacgaccggtgctcgatttagcagacgtctgtcgcgggggaacgtgctcagttaggacccagacggaaccatggaagccccagcgcagcttctcttcctcctgctactctgctcccagactaccactggagaaatagtgctgacgcagtctcagccaccctgtctgtgtactccgaggggaaanaggcaccctctcctgcagggcagtcagagtgttgcctacaacttagccttggtaccagtcaagaacctggaccagcctccccaggcctcctcatcacttcgtagcattccaccgagggcccattcggtactccccagccccgtaaggtttccaagggttcgacctaaggtcgggttacccgtggggacacggtaccttnaccgttccgtcaacctatccgtaaggtagccctggtactacggtccttagtaaagtacgttttggacttaagtttttaacgtttctggttacagttacgtagtttaacttagttaacgtgggtttcgtacttcgtacgtttcgggacgtacggaaccgtaagggttccggaatacgtacgtaacggccggttaaacgttggtacgggtctggacccgtacgtagttccgtttcgtaccttcg

SEQ ID NO: 269439 - DNA, 775 bp, Homo sapiens
  misc_feature: GYAE6OF02HW56Y.40.84.H07.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (312)..(312): a, c, t, g, unknown or other
  misc_feature (312)..(312): n is a, c, g, or t
tcagtctagcgactcacgaccggtgctcgatttagcagacgtctgtcgcggggggaactgctcagttaggacccagacggaaccatggaagccccagcgcagcttctcttcctcctgctactctggctcccagataccactggagaaatagtgctgacgcagtctccagccacctgtctgtgtctccgaggggaaanggcaccctctcctgccgaggcagtcagngtgttcgccacctaattcgcctaggtaccagaccaaggaaacctggaccacgccctcccgaggtcctcctacacttctacgtcggtnacctacgtcccaccgacgggccctaacgttcggtaacctcccgtaacggccctagggttccagggtacggtaccgtagggtcggggtacgttacggggaactacggtaacttccaaccgtttccaccaccgtataccgacgacgacggtcccttagactacggttcttaaggtaacgtttacgttttcggtaccgtttaagtttttaaccttttcgaccggtttactacggtaactttaaccgggttttaatttaaaccgggtaacgggtttcgggttacgttacccttaaccgggtttaccgtttccggggggaaaccgggttaaaccgggtaaccgggttaaggggtaccggggaacgtttaacggaaccccggtaagggttaccccgtaaacgggtttcgggaaccggttccttacgggaaccccctttaaaccggtgttttcccggtagggtttacccc

SEQ ID NO: 269440 - DNA, 595 bp, Homo sapiens
  misc_feature: GYAE6OF02GDABV.40.84.H07.1.454.CMB.1.raw
  modified_base (199)..(199): a, c, t, g, unknown or other
  misc_feature (199)..(199): n is a, c, g, or t
tcagtctagcgactcacgaccggtgctcgatttagcagacgtctgtcgcgggggggaactgctcagttacggacccagacggaaccatggaagccccagcgcagcttctcttcctcctgctactctggctcccagataccactggagaaatagtgctgacgcagtctccagccaccctgtctgtgtctcgaggggaaanggccaccctctcctgcagggcagtcagagtgttgccactaacttagcctggtaccagtcaacggtaacctggaccaggtccctacccgaggcctccctcattcctaagtccgtagcactcccaccgagggcccacgtggtactcccgagccctaggttcagtcggctagggtcgggtcacggggtacagtcttcaccgttctaccacctagtcacgcacgcctgactagtctagtaagttatttcgactttagtttacttcgtgtacacgtactagttacttaacgtacgtgggtctcgtactaccgttcggacggtaccggacgtagggtcgtagtacgtacgaacggtacgtaacgtggtacggtctacggacctaccgtacgttactcgtacc

SEQ ID NO: 269441 - DNA, 748 bp, Homo sapiens
  misc_feature: GYAE6OF02I9OPL.40.84.H07.1.454.CMB.1.raw
  modified_base (194)..(194): a, c, t, g, unknown or other
  misc_feature (194)..(194): n is a, c, g, or t
tcagtctagcgactcacgaccggtgctcgatttagcagacgtctgtcgcgggggaactgctcagttaggacccagacggaaccatggaagccccagcgcagcttctcttcctcctgctactctggctcccagataccactggagaaatagtgctgacgcagtctccagccaccctgtctgtgtctcgagggaangcacctctctgcagggcagtcagagtgttcgacccaaccaacgttacgccgtacggtaccagaccaaacgtaaaccgtcggacccacgtcccctaccccgacggcccttcccgtactacttccttaactccggtacgtacctaaccttccccgaaccggaccgggtccctaacggttccggttaaccctccccgaccggtccgtaagggtttccaacgggttcggtaccgtaggggtttcggggttaccgtacggggtactaacggtacttaccgacttacccgtacaccctatacgacgcacggtccctggacctagttcgtaagtaagtttcgtttcgaccgtttaaggtttttctttccgagttaactaggttaccgtaagtttaacgttaacgttaacggttgggttaccctattacccgtacggtttacccggggacggtaaaccggggttaccgtaaggggtggtaactacgggtaacgtaacgggtaccggttaacggtgggttaaccgacgtaacgtacccgtaacctcgttaccgttcgttaccg

SEQ ID NO: 269442 - DNA, 769 bp, Homo sapiens
  misc_feature: GYAE6OF02GJ4DG.40.84.H07.1.454.CMB.1.raw
  modified_base (91)..(91): a, c, t, g, unknown or other
  misc_feature (91)..(91): n is a, c, g, or t
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
tcagtctagcgactcacgaccggtgctcgatttagcagacgtctgtcgcgggggaactgctcagttaggacccagacggaaccagtggaanccccagcgcagcttctcttccgtcctgctactctggctcccagactaccactggaagaaatagtgctgacgcagtctccagcccaccctgtctgtcgtctccgaggggaaancggcacccgtctcctggctacgggcagtcgagtaggttnttcgacctaaccaacgttcgcctaggtacccagcaacgtaaccgtcggaccacgccctccgaggccctccgtactactccgtagtccgtgacctaacgtcccaccggacggcctaacgttacggtaccctccgacgtaccgtaggttcaggtcggacgtacgggttcgggtacgtaggggaactacggtaccttccggtacttacctacctaacctaccgtacggtaaccaccggtaacggtcccgtacggtaccgttaacggttacgtaacgttaaacggtttacgtttacgttaaccggttttaagtttttacttccggttagttaccgtaaggttaccttaaagtttacgtttaaacggtttacggtcgggtttccgttaaccgtttacgtttaccgggttaccgggggaacggtaccgggtaaaccggtaagggttacggtaacgtaaacggctaaaacgggtccgttaaacggttcggacggttacctcgaaaccccgtagtaaccgtttgtaccgtttccg

SEQ ID NO: 269443 - DNA, 742 bp, Homo sapiens
  misc_feature: GYAE6OF02JXT06.40.84.H07.1.454.CMB.1.raw
  modified_base (136)..(136): a, c, t, g, unknown or other
  misc_feature (136)..(136): n is a, c, g, or t
  modified_base (142)..(142): a, c, t, g, unknown or other
  misc_feature (142)..(142): n is a, c, g, or t
tcagtctagcgactcacgaccggtgctcgatttagcagacgtctgtcgcgggggaactgctcagttaggacccaggacggaaccatggaagcccagcgcagcttctcttcctcctgctactctggctccagctacnctgganaatagtgctagacgcagtacctccgagtccacctggtctacggtctctaccgaggggaaacacggtcccaccctctccgtacggccggagggtacctcggtacgaagtcgtggtcgaccctaacctaacgttcgccctagggtaccacgtcgaacgaaaccggtcgacccgtaagcccccgttaccgaggtaccgtacccgtaccgtaacgttccttaacggtcccgtcgtaaccgtaccttaccgaaccggtacgggtacctaccggtaccgggtactacccgacgtaccggtaaggttccgagtcggacgtggtcgggtgaacggactacggtacttaccggtactcccgacgtacctagtccgacgacgtactccgagtccgtacgtcgtaacgttacgttcttcggttaacttacggtttcttacgttcgaacgtcggtacgttaacgtaagtttataaaccggggttcgttacgtaacgttccgttccgtttaacggggagtccgggtaaacgtagggtacgtacgtacgaacggtagggttaccaacggtttggccgaccgtaggtcctaaccgtattccgttaccttaaccgg

SEQ ID NO: 269444 - DNA, 422 bp, Homo sapiens
  misc_feature: GYAE6OF01EKWB4.11.25.C03.1.454.CMB.1.raw
  modified_base (420)..(422): a, c, t, g, unknown or other
  misc_feature (420)..(422): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaagcctgagagccgatgacacggccgtgtattactgtgcgagagatggggcccacgaacgttactacgctatggacgtctggggccaaggggaccacggtcaccgtctcctcagcctccaccaagggcccatcggtcttccccctggcgccctgctccaggagcacctccgagagcacagcggccctgggctgcctggtcaaggactacttccgtatctctcgctgagcgggctggcaaggcgcatagnnn

SEQ ID NO: 269445 - DNA, 467 bp, Homo sapiens
  misc_feature: GYAE6OF01EPOTX.11.25.C03.1.454.CMB.1.raw
  modified_base (462)..(467): a, c, t, g, unknown or other
  misc_feature (462)..(467): n is a, c, g, or t
tcagcgagagataccacgaccggtgctcgatttagtagtgtagatttgggtttgggggaagaggaagactgacggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgtatctctcgctgagcgggctggcaaggcgcatagnnnnnn

SEQ ID NO: 269446 - DNA, 464 bp, Homo sapiens
  misc_feature: GYAE6OF01CB5S5.11.25.C03.1.454.CMB.1.raw
  modified_base (461)..(464): a, c, t, g, unknown or other
  misc_feature (461)..(464): n is a, c, g, or t
tcagcgagagataccacgaccggtgctcgatttagtagtgtagatttgggtttgggggggaagaggaagactgacggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggccacgaacgttactacgctatggacgtctggggccaagggaccacggtcaccgtctcctcagcctccaccaagggcccatcggtcttccccctggcgccctgctccaggagcacctcgagagcacagcggccctgggctgcctggtcaaggctacttccgtatctctcgctgagcgggctggcaaggcgcatagnnnn

SEQ ID NO: 269447 - DNA, 578 bp, Homo sapiens
  misc_feature: GYAE6OF01DHADD.11.25.C03.1.454.CMB.1.raw
  modified_base (443)..(443): a, c, t, g, unknown or other
  misc_feature (443)..(443): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaggggctggagtgggtctcctttattacagcagtggtagtacatacttccgcagactccggtggacggggccgattccaccatctccagagaacaactctaagaacacgtcttgtttctacaaatgaacngcctgagacgccgagtcgaccgacgggtccgtagttattacgtggtagcgaaggagacgtcgggggaccctaacggtaacgttactacgcttagtcgggtaacgtcgtagggggacccaaggggccctaaccggg

SEQ ID NO: 269448 - DNA, 420 bp, Homo sapiens
  misc_feature: GYAE6OF01DU7YK.11.25.C03.1.454.CMB.1.raw
  modified_base (418)..(420): a, c, t, g, unknown or other
  misc_feature (418)..(420): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactactccgtatctctcgctgagcgggctggcaaggcgcatagnnn

SEQ ID NO: 269449 - DNA, 420 bp, Homo sapiens; identical to SEQ ID NO: 269448
  misc_feature: GYAE6OF01BAL8J.11.25.C03.1.454.CMB.1.raw
  modified_base (418)..(420): a, c, t, g, unknown or other
  misc_feature (418)..(420): n is a, c, g, or t

SEQ ID NO: 269450 - DNA, 421 bp, Homo sapiens
  misc_feature: GYAE6OF01DEWK3.11.25.C03.1.454.CMB.1.raw
  modified_base (420)..(421): a, c, t, g, unknown or other
  misc_feature (420)..(421): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgtatctctcgctgagcgggctggcaagggcgcatagnn

SEQ ID NO: 269451 - DNA, 430 bp, Homo sapiens
  misc_feature: GYAE6OF01BF5PB.11.25.C03.1.454.CMB.1.raw
  modified_base (412)..(412): a, c, t, g, unknown or other
  misc_feature (412)..(412): n is a, c, g, or t
  modified_base (418)..(430): a, c, t, g, unknown or other
  misc_feature (418)..(430): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaagcctgagagccgatgacacggccgtgtattactgtgcgagagatggggcccacgaacgttactacgctatggacgtctggggccaagggccacggtcaccgtctcctcagcctcaccaagggcccatcggtcttccccctggcgccctgctccaggacgcacctccgagagcacagcggccctgggctgcctggtcaaggactacttccgtatctctcgctgagcgggctggcaaggcncatagnnnnnnnnnnnnn

SEQ ID NO: 269452 - DNA, 618 bp, Homo sapiens
  misc_feature: GYAE6OF01AMR7N.11.25.C03.1.454.CMB.1.raw
  modified_base (462)..(462): a, c, t, g, unknown or other
  misc_feature (462)..(462): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccgccaggcctccgaggggaaggggctgggaggtgggtcttccttttattacagcaggtggtagtacatattccgcagacctccggtggacggggccgtattccaccatcctacagacgactaactctaaagaccacgtcttcgtttactacaaagtcaaacngcctggagacgccgagtcgaaccgcgggtccgtagttacttacgtggtcggacggtagaggtacggtccggggaccccaaacggtaacgttaccacggtcctaaggtccgggtacggttccggtaggggaccccgaaaggggtcccgtaacccggg

SEQ ID NO: 269453 - DNA, 549 bp, Homo sapiens
  misc_feature: GYAE6OF01DS0TB.11.25.C03.1.454.CMB.1.raw
  modified_base (467)..(467): a, c, t, g, unknown or other
  misc_feature (467)..(467): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgagggaggggctggagtgggtatcctttatttacagcagtggtagtacatattccgcagactcgtggagggccattcacatctccagagacaactctaagaacacgctgtttctacaatgaacagcctgagagccgatcgacacggccgtgtattactgngcgagagagtcggggccctaacggaacgttactaccgcttagtcgggaccgtcggtaggggacccaaggggccctaaccggg

SEQ ID NO: 269454 - DNA, 581 bp, Homo sapiens
  misc_feature: GYAE6OF01AOMTY.11.25.C03.1.454.CMB.1.raw
  modified_base (411)..(411): a, c, t, g, unknown or other
  misc_feature (411)..(411): n is a, c, g, or t
  modified_base (439)..(439): a, c, t, g, unknown or other
  misc_feature (439)..(439): n is a, c, g, or t
  modified_base (451)..(451): a, c, t, g, unknown or other
  misc_feature (451)..(451): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttcggtccgcaggctccgagggagggctggagtgggtctctttattacagctagtggtagtacatacttccgcacgactccggtggacggggcctattcacctatcctacagagacaactnaagacacgtcttgtttctacaatgaacngcctagacgacnccgatcgaccgacggcgttagtattacgtggtacgacgaggagtcggtaccggggaccctaacggtaacgttacctacggacgttagtcgggaccgtcggtaggggaccccgaaggggcccgtaaccggg

SEQ ID NO: 269455 - DNA, 428 bp, Homo sapiens
  misc_feature: GYAE6OF01BLV2W.11.25.C03.1.454.CMB.1.raw
  modified_base (426)..(428): a, c, t, g, unknown or other
  misc_feature (426)..(428): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaagcctgagagccgatgacacggccgtgtattactgtgcgagagatggggcccacgaacgttactacgctatggacgtctggggccaagggaccacggtcaccgtctcctcagcctccaccaagggcccatcggtcttccccctggccgcccctgctcccaggagccacctccgagacgcacagccggccctggggctgcctggtcaaggactacttccgtatctctcgctgagcggctggcaaggcgcatagnnn

SEQ ID NO: 269456 - DNA, 587 bp, Homo sapiens
  misc_feature: GYAE6OF01DMKUO.11.25.C03.1.454.CMB.1.raw
  modified_base (461)..(461): a, c, t, g, unknown or other
  misc_feature (461)..(461): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttccaccgtcagtcacacctacatgagttgggtccgcaggcctccgaggggaaggggctggagtgggtcttcctttatttacagcaggtggtagtacatacttccgcagtacctccggtggacggggccgtattccgacctatcctaccaagacgaacaactctaaagaacacgtcttgtttacttacaaatgaacngcctagacgagccgatcgaacacggtccgttagtacttacgtgtgacgtagagacgtcggggaccctaacggtaacgttacgacgtctagtcggtaccgtcgaggggaccgaaagggccctaccgg

SEQ ID NO: 269457 - DNA, 557 bp, Homo sapiens
  misc_feature: GYAE6OF01DX4W9.11.25.C03.1.454.CMB.1.raw
  modified_base (365)..(365): a, c, t, g, unknown or other
  misc_feature (365)..(365): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaaggggctggagtgggtctcctttatttacagcagtggtagtacatattccgnagactccgtgacggggccattcaccatctccagagaccaactctaagaacacgctgtttctacaaatgaaacagcctgagagccgatcgacacgggccgtgtattactgtgcgaagagagtcggggccccaacggtaacgttacacgctagtcgggtaccgtcggtgggggacccaaggggccctaaccggg

SEQ ID NO: 269458 - DNA, 682 bp, Homo sapiens
  misc_feature: GYAE6OF01BBC8F.11.25.C03.1.454.CMB.1.raw
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtctggaggaggcctgatccagccgtggggggtccctgagactctcctgtgcagcctcgtgggttcaccgtcagtcacacctacatgagttgggtcccgccaggcctccggaggggaaggggctgggagtgggtcttcctttattacagcagtggtagtacattactccgcacgactccggtggacggggcctattcacctattcctaccgaagacgaaccaactactaaacgaaccacgtacttgtttaccttacaaattcgaaacacgtaccctaggaacgacggacccgtaagtcggaaccgtaccgggtaccggttagtttaacgtttacgttgggtacggacggaagggtaacggtacgggtaccggggggaccccctaaacgggtaaaccgtttaaccgtacggtaccgttaaggttacgggtaccggttacggtacgggggacccctaaacgggggcccgtaacccgggg

SEQ ID NO: 269459 - DNA, 439 bp, Homo sapiens
  misc_feature: GYAE6OF01B6V5A.11.25.C03.1.454.CMB.1.raw
  modified_base (426)..(439): a, c, t, g, unknown or other
  misc_feature (426)..(439): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaagcctgagagccgatgacacggccgtgtattactgtgcgagagatggggcccagaacgttacacgctatggacgtctggggccaaggggaccacggtcaccgtctcctcacgccctccaccaagggcccatcggtccttccccctggccgccctgctccaggcgcaccgtccgagacgcacagccggccctgggctgcctggtcaaggactacttcgtatctctcgctgagcgggctgggcaaggcgcatagnnnnnnnnnnnnnn

SEQ ID NO: 269460 - DNA, 701 bp, Homo sapiens
  misc_feature: GYAE6OF01D0MHK.11.25.C03.1.454.CMB.1.raw
  modified_base (302)..(302): a, c, t, g, unknown or other
  misc_feature (302)..(302): n is a, c, g, or t
  modified_base (385)..(385): a, c, t, g, unknown or other
  misc_feature (385)..(385): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtctggaggaggcctgatccagccgtgggggtccctgagactctcctgtgcagcctcgtgggttcaccgtcagtccacacctacatgagttcgggtcccnccaggcctccggaggggaacggggctgggaggtcgggttccttccttttatttacagtctaggtggtagtacatacttccganacgtactccggtaggacgggtcctattccaacctattcctaccgaaggaacgaacctaaacctacgtaaacgaaacccgtacgtctttacgttttacctaacgtaaattcggaaacctacggtccctaggaacgacgtacccgaagtcggaaccgtaccgggtccgttagttaactttacgtcgggtgacggtagtaacggtacggtaccgggggacccctaacgggtaaaccgttaccgtacggtaccgttaaggtccggggtaaccgttacgggtaccggggggaaccccgtaaaggggcccccgtaaccgggg

SEQ ID NO: 269461 - DNA, 423 bp, Homo sapiens
  misc_feature: GYAE6OF01CLRB1.11.25.C03.1.454.CMB.1.raw
  modified_base (420)..(423): a, c, t, g, unknown or other
  misc_feature (420)..(423): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaagcctgagagccgatgacacggccgtgtattactgtgcgagagatggggccccacgaacgttactacgctatggacgtctggggccaaggggccacggtcaccgtctcctcagcctccaccaagggcccatcggtctccccctggcgccctgctccaggagcacctccgagagcacagcggccctgggctgcctggtcaaggactacttccgtatctctcgctgagcgggctggcaaggcgcatagnnnn

SEQ ID NO: 269462 - DNA, 635 bp, Homo sapiens
  misc_feature: GYAE6OF01BCSK3.11.25.C03.1.454.CMB.1.raw
  modified_base (462)..(462): a, c, t, g, unknown or other
  misc_feature (462)..(462): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccgccgaggcctccgaggggaaggggctgggaggtgggtcttcttttatttacagcaggtggtagtacatacttccgcacgactccggtggacggggccgattccaccatcctccagacgaactaactctaagaaccacgtcttgtttactacaaatcgaacncgcctagagacgccgatcgaacgacggccgttagttaattaccgtgtgacggtagaggtacggtacgggggacccccaacgggttaaccgtttaccgtaccggtacttaaggttccggggtaccggttcgggtacggggggaccccgaaacggggggtaccccgtaacccggg

SEQ ID NO: 269463 - DNA, 559 bp, Homo sapiens
  misc_feature: GYAE6OF01AWEHY.11.25.C03.1.454.CMB.1.raw
  modified_base (365)..(365): a, c, t, g, unknown or other
  misc_feature (365)..(365): n is a, c, g, or t
  modified_base (438)..(438): a, c, t, g, unknown or other
  misc_feature (438)..(438): n is a, c, g, or t
tcagcgagagataccacgaccggtgctcgatttagtagtgtagatttgggtttgggggagaggagcccagcactgggattccgaggtgtttccattcggtgatcatcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggggtccgccaggctccgagggaagggctggagtgggtctcctttatttacagcagtggtagtacatattccgnagactccgtgagggccgattcaccatctccagagacaactctaagaacacgcttgtttctacaaatcgaaacngcctgagagccgatgacacggtccgtgtacttacgtgtgcgagagacgtggggaccccaggaaccgttactacggcctagtcgggtaccgtcggagggggacccaaaggggccctacgggg

SEQ ID NO: 269464 - DNA, 587 bp, Homo sapiens
  misc_feature: GYAE6OF01E4G7V.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctgggggtccctgagactctcctgtgcagcctctgggttcaccgtcagtcacacctacatgagttggtccgccaggctccgagggaaggggctggagtgggtctcctttatttacagcagtggtagtacatattccgcagactcgtgaggggccatcacatctacagacgacaactctaagaacacgtcttgtttcttacaaatgaaacagacctggaacgaggcccagtcgaaccaccgggtccgttagttaacgtttacgtggtaggaccggaagaggacgtcgggggacccctaacggaaaccgtttactacgactagtcgggaaccgtcgtacgggggaccaaagggcccgtaaccggg

SEQ ID NO: 269465 - DNA, 565 bp, Homo sapiens
  misc_feature: GYAE6OF01BKPN4.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgagggaaggggctggagtgggtctcctttatttacagcagtggtagtacatattccgcagacctccgtggacggggccattccaccatctaccagagaacaactctaaagaacacgtcttgtttctacaaatcgaacagcctgacgagccgatgaccacggccgtgtattacgtgtgacgaggagagtcggggacccacggtaacgttacacggctagtcggtacgttcggacggggacccaaggggccctaccggg

SEQ ID NO: 269466 - DNA, 660 bp, Homo sapiens
  misc_feature: GYAE6OF01A6QH9.11.25.C03.1.454.CMB.1.raw
  modified_base (462)..(462): a, c, t, g, unknown or other
  misc_feature (462)..(462): n is a, c, g, or t
  modified_base (472)..(472): a, c, t, g, unknown or other
  misc_feature (472)..(472): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtccctgagactctcctgtgcagcctcgtgggttccaccgtcagtcacacctacatgagttcgggtccgccgaggcctccgagggggaaggggctgggagtcgggtccttcctttatttacagctaggtggtagtacatacttccgcacgactcccggtggacgggggcctattccaccatcctaccgagacgaccaaacttcaaacgaacacgtcttgtttacctanaaatcgaacncgtcctagagacgcccgaatcgaaccgaccggtccgttagttaacttaccgtggtcgacggtaaggacggtacggtccgggggacccctaaaccgggttaaaccgtttaccgtacccggacgttaacggtcggggtacccgttaccgggtacgggggaacccgtaaacgggggccccgtaacccgggg

SEQ ID NO: 269467 - DNA, 615 bp, Homo sapiens
  misc_feature: GYAE6OF01CG9AT.11.25.C03.1.454.CMB.1.raw
  modified_base (119)..(119): a, c, t, g, unknown or other
  misc_feature (119)..(119): n is a, c, g, or t
  modified_base (284)..(284): a, c, t, g, unknown or other
  misc_feature (284)..(284): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
tcagcgagagataccacgaccggtgctcgatttagtagtgtagatttgggtttggggggagaggagcccagcactgggattccgaggtgtttccattcggtgatcagcactgaacacanaggactcaccatggaggtttggtcgtgagcgtgggttttccgtttcgttgtctattttaaaaggtaagtccagtgtgaggtgcgtctggtggagtctggaggaggcctgatccacgccgtcgggggtccgtcagactctcctgtgcagcctctggttcaccgtcngtcacacctacatgaggtgggtccgccaggctccgagggaggggctggagtggtctccttattanagnaggttgtagtacatattcccgnacgactccggtcgagggggacccattcaccacttctcccagaagaacaactactaagaacaacgtcttagtttcttacaaatagaacaagcctggacgaggacccgatcggtaacaccggtccgttgtattactaggtgacgagtaggagtacggggtcccgtaaccgtaaccgttaacggttaccgacgtacgttaggtaccgtcgtacggggtacccggaaagggtacccgtacccggg

SEQ ID NO: 269468 - DNA, 562 bp, Homo sapiens
  misc_feature: GYAE6OF01AEV7Y.11.25.C03.1.454.CMB.1.raw
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagacctctcctgtgcagcctctgggttcaccgtcagtcacacctacatgagttggtccgccaggctccgagggagggctggagtggtctcctttatttacagcagtgtagtacatatccgnagctcgngnggcntcacntcncagagacactctaagaccncgtcttgtttcttacaatcgaacngcctgacagcccgancgaacgcggcgttagtattacgtgtacgcggagaggcgtaccggggacccaaggtaaccgttcgtacgtcgttaggtcgggtaccgttcggtagggggaccctaagggggccctacccgggg

SEQ ID NO: 269469 - DNA, 652 bp, Homo sapiens
  misc_feature: GYAE6OF01EEVL7.11.25.C03.1.454.CMB.1.raw
tcagcgagagataccacgaccggtgctcgatttagtagtgtagatttgggtttgggggagaggagcccagacactgggattccgaggtgttccattcggtgatcagcactgaacacagaggactcaccatggaggttttggctgagcttgggttttccttgttgctattttaaaaggagtccagtgtgaggtgcgtctggtggagtctggaggaggcctgatccagccgtggggggtccctgacgactctccgtgtgcagtcctcgtgggttcaccgtcagtcacacctacatgagttcggtccgccaggctcgagggagggcgtggagtggtcttctttattacagcaggttgtagtactatacgttccgctacgacctccggtaggacggggtccctattccaacctatcctacgaagacgaaccaactactaaagaacctacgtcttgtttactacaaattacgaactacgcctagaacgtacgaccgtagtacgaaccgtaccgggtaccgttagttaacttacgtggtacggacggtaaggacggtacggttaccgggggacccctaaacgggtaaaccgtttaacgtaccggtacttaggtacggtaccggtacggtaccggggaccgtaaagggtccctaccggg

SEQ ID NO: 269470 - DNA, 614 bp, Homo sapiens
  misc_feature: GYAE6OF01ESM97.11.25.C03.1.454.CMB.1.raw
  modified_base (553)..(553): a, c, t, g, unknown or other
  misc_feature (553)..(553): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccgccaggcctccgaggggaaggggctgggaggtgggtcttccttttattacagctaggtggtagtacattacttccgcagactccggtggaacgggggcctattccacctatcctccagaacgacctaactcaaacgaactacgcttcgtttactacaaattgaactagcctgagacgccgatcgaacacggtccgtagttattacgtgtgacggtagacgtaggtccggggacccctaacggtaaaccgtttacnccggtacttaagtcgggtacccgtcggtacgggggaccctaaagggggaccctacccgggg

SEQ ID NO: 269471 - DNA, 691 bp, Homo sapiens
  misc_feature: GYAE6OF01CUSSS.11.25.C03.1.454.CMB.1.raw
  modified_base (178)..(178): a, c, t, g, unknown or other
  misc_feature (178)..(178): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggngtccagtgtgaggtgcaactggtggagtcgtgggggagcgtggtccagcctgggaggtccctgagactctcctgtgcagcgtctggattcaccttgaggagctatgacatgcacgtcgggtccgccgaggcctccgaggcgaaggggctagggaggtgggtgctagttatagtggtatggaagttaggtaaagtttaataaaattactaagtgggaacgtaccgttccgggtaaggaacggggtccctaagttccaaccgtactcctaccgaaggaacgtaaccctaccttacccgtaaaacggaaccgtacgggttagttaactacgtagtaacctaaagtacgaaaccgacgtcccgtaggaacggaaccggtaccgggaacggaacgtaccgggtcgttaggtacgttacgttaccgttaggtacgggacggggtaaacggggtaaaaccgaacggaccgaacggtccggtacggggtacccggaaagggggtactagggtagttacggg

SEQ ID NO: 269472 - DNA, 608 bp, Homo sapiens
  misc_feature: GYAE6OF01AQM0V.11.25.C03.1.454.CMB.1.raw
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
  modified_base (467)..(467): a, c, t, g, unknown or other
  misc_feature (467)..(467): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccgagccgtggggggtccctgacgactctccgtgtgcagcctcgtgggttcaccgtcagtcacacctacatgagttcgggtccnccgaggctccgagggagggctggagtgggtctcctttattacngctaggtgtatacatatccgnacgcgtccggtggacggggccattccacctatcctccgaagacgaaccaactacgtaaacgaacctacgtctttgtttaccttaacaaagtcgaaaccngtcccgtaggacgacgcccgaagtccgacgaccgggtccgttataacgttacgtggagtaccgaggagtacgtccggggaccctacggtaacttaccgcgtactagtcggacgttcggacggggaccaagggccctacggg

SEQ ID NO: 269473 - DNA, 473 bp, Homo sapiens
  misc_feature: GYAE6OF01BMF51.11.25.C03.1.454.CMB.1.raw
  modified_base (467)..(473): a, c, t, g, unknown or other
  misc_feature (467)..(473): n is a, c, g, or t
tcagcgagagataccacgaccggtgctcgatttagtagtgtagatttgggtttggggggaagaggaagactgacggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccatgggaccacggtcaccgtctcctcagcctccaccaagggcccatcggtcttccccctggccgccctgctccaggacgcacctccgagacgcacagccggccctgggctgcctggtcaaggactattccgtatcctctcgctgagcggctggcgaaggcgcatagnnnnnnn

SEQ ID NO: 269474 - DNA, 637 bp, Homo sapiens
  misc_feature: GYAE6OF01D79W5.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttccaccgtcacgtcacacctacatgaggttcgggtccgccaggcctccgaaggggaggggctgggaggtgggtctcctttattcagtctagtggtatacattattccgcagactccggtggacggggccctagttccacctatcctaccgagacgacaactacaaagaaccacgtcttagtttcttaacaaagtcaacagtccctaggacgagcccgagtcgaaccgtacgggtcttagttattacgtggtcgaccggtaaggacggtacgtccgggggaaccccctaacggtaaacgttttacccgaacggccttaaggtcgggtacggttacgtaccggggggaacccaagggggtaccccctaccggg

SEQ ID NO: 269475 - DNA, 462 bp, Homo sapiens
  misc_feature: GYAE6OF01C7FC7.11.25.C03.1.454.CMB.1.raw
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
  modified_base (451)..(462): a, c, t, g, unknown or other
  misc_feature (451)..(462): n is a, c, g, or t
tcagcgagagataccacgaccggtgctcgatttagtagtgtagatttgggtttgggggggaagaggaagactgacggtccgccaggctccagggaaggggctggagtgggtctcctttatttacagcagtggtagtacatattccgcagactccgtgagggccgattcaccatctccagagacaactctaagaacacgctgtttcttcaaaatgaacagcctgagagccgatgacacggccgtgtattactgtgcgagagatggggccaacgaacgttaactacgctaatggacgtctggggccaaagggaccacggtcaccgtctcctcagcctccaccaaggcccatcgtctcccctgccgcctgctcagagcacctcgagngcacagcgcctgggctgcctgcaagctactcgtatctcncgntgagcgggctggcaaggcncatagnnnnnnnnnnnn

SEQ ID NO: 269476 - DNA, 552 bp, Homo sapiens
  misc_feature: GYAE6OF01CORBO.11.25.C03.1.454.CMB.1.raw
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
  modified_base (407)..(407): a, c, t, g, unknown or other
  misc_feature (407)..(407): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (464)..(464): a, c, t, g, unknown or other
  misc_feature (464)..(464): n is a, c, g, or t
  modified_base (479)..(479): a, c, t, g, unknown or other
  misc_feature (479)..(479): n is a, c, g, or t
  modified_base (514)..(514): a, c, t, g, unknown or other
  misc_feature (514)..(514): n is a, c, g, or t
tcagcgagagataccacgaccggtgctcgatttagtagtgtagatttgggtttggggaggaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgacgactctcctgtgcagcctctgggttcaccgtcacgtcacacctacatgagttgggtccgccaggcctccgaggggaagggctggagtgggtctcctttattacngtcgagtggtagtacatattccgnacgactccgtggacgggccattccaccatctccaganacaactctaaagacacgtcttgtttcctacaaatgaacngcctgangaccatgaacncggctgtattcgtgngacggagagcgtcgggacccctagtaaccgttacncgctagtcggacgttcgcggggcccaagggccctacgg

SEQ ID NO: 269477 - DNA, 575 bp, Homo sapiens
  misc_feature: GYAE6OF01BQ8KG.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttggtccgcaggctccgagggaagggctggagtgggtctcctttatttacagtcagtggtagtacatattccgcagactccggtgacggggccattccaccatcctaccagacgacaactctaaagaaccacgtcttgtttacttacaaatgaaacagcctagacgagccgatcgacacggccgtagtacttactgtgcgaagacgacgtacggggcccaacggtaacgttaccgtacgctagtcgggaccgttcgtacgggggaccaacggggacccgtaccggg

SEQ ID NO: 269478 - DNA, 580 bp, Homo sapiens
  misc_feature: GYAE6OF01AFWNO.11.25.C03.1.454.CMB.1.raw
  modified_base (175)..(175): a, c, t, g, unknown or other
  misc_feature (175)..(175): n is a, c, g, or t
  modified_base (297)..(297): a, c, t, g, unknown or other
  misc_feature (297)..(297): n is a, c, g, or t
  modified_base (356)..(356): a, c, t, g, unknown or other
  misc_feature (356)..(356): n is a, c, g, or t
  modified_base (386)..(386): a, c, t, g, unknown or other
  misc_feature (386)..(386): n is a, c, g, or t
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagccgtgggggtccctgagactctcctgtgcagcctcgtgggttcaccgtcagtcacacctacatgagttggtccncaggctccgagggagggctggagtggtatcctttattacagcagtgtatacatatccgnagactcgtgagggccatcaccatctcaganacaactctaanacacgcttgtttctacaaaatgaaacngcctagagacgaccagtagaaccgacgggccgttagttaacttacctgggtacgacgaaggaaggacgttacgggggacccccaaacggttaaacgttactacggacctaagttcggacggttacgacggggggaaccaaacggggccaacccggg

SEQ ID NO: 269479 - DNA, 642 bp, Homo sapiens
  misc_feature: GYAE6OF01CMXDE.11.25.C03.1.454.CMB.1.raw
  modified_base (381)..(381): a, c, t, g, unknown or other
  misc_feature (381)..(381): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgttgggttttccttgttgacttaattttaaaaggagtccagtgtgaggtgcgtcgtggtggagtcgtgggaggaggcctgatccgaggccgtggggggtccctggacgactcctcctgtcgcacgtcctcgtcgggttccaccgtcagtcaacacctacatgaggttcgggtccgcgacggctccgagggaggctggagtggtctctttatacagcagtggtagtacatactccgnacgactccggtaggacggggcctatccactatcctaccaagacgaactaacgtctaaacgaccacgtcttcgtttactacaaatcgaactcgccgtagaacgacgaccgtaagtcgaaccggtacggtaccgttagttaacttacgtaggtacggacggaaggtacggacgggtaccggggaccctaaacggtaaaccggttacaccggtactaggtcgggtaccggttcggtagggggacctaacgggggccctaccggg

SEQ ID NO: 269480 - DNA, 575 bp, Homo sapiens
  misc_feature: GYAE6OF01BRUWF.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctgggggtccctgagactctcctgtgcagcctctgggttcaccgtcagtcacacctacatgagttgggtccgccaggctccgagggaagggctggagtgggtctccgttatttacagcagtggtagtacatattcgcagactccgtgagggccattcaccatctccagacgactaactctaagaacacgcttgtttctacaaatgaaacagcctgacgagccgagtgaacgacggccgttggtaatttacgtggtacgcgaggagtacggtcggggaccccaacggtaaccgttacgtaccgcctagtacgggtaccggttcgtaggggacccaagggggaccctaccggg

SEQ ID NO: 269481 - DNA, 660 bp, Homo sapiens
  misc_feature: GYAE6OF01BMQ49.11.25.C03.1.454.CMB.1.raw
  modified_base (436)..(436): a, c, t, g, unknown or other
  misc_feature (436)..(436): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctggatccagccgtggggggtccctgagactctcctgtgcagcctcgtgggttcaccgtcagtcacacctacatgaggttcgggtccgcgacggcctccgaggggaagggcgtgggagtgggtccttccgttttattacgagtctaggtggtagtacaagttacttccgacagaccgtccggtggacggggcctattcaccactctccgaagacgaacnctaaaaaaaactcgaactacgtcttcgtttacttaactaatacgtaacacgtaccgtagaacggtacgaccgtagtacgaaccgaccggtaccgttagttacttacgtacggtacgacggtaggacggtacgggtccgggacccgtaacggtaaccgttaccgtacgtacgtaagtcgggtacggttcgggtacggggaccggaaccgggaccgtaaccccggg

SEQ ID NO: 269482 - DNA, 724 bp, Homo sapiens
  misc_feature: GYAE6OF01DP350.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaaaacagaggactcaccatggagttttggctgagctgggttttccttgttgctaattttaaaaggagtccagtgtgaggtgcgtctggtggagtctgggaggaggcctgatccagccgtggggggtccctgagactctcctgtgcagcctcgtgggttccaccgtcacgtcacaccctacagtggtaggttcgggtcccgccgacggccgtaccgaagggggaacggggcgtgggaggttcgggttcctttaccttttatttacagtcgtagtggtaagtacattacttccgactagacctcggtggacggggcctacttccacctatcctccaagacgactaactactaaacgaactacgtcttcgtttactacaaagtcgaaacacgccgtaggaacgacgcccggaatacggaaccgaccgggtcccgttagttaactttacgtcggttacggacggaagggaacgtacggggtacccgggggtaaccccgaaacccggttaaaacccggtttaccgtaacccggttccttaagggttccgggtaacccggttcggggaccgggggtaaccccggaaacggggtcccccgtaacccggggttacccccg

SEQ ID NO: 269483 - DNA, 769 bp, Homo sapiens
  misc_feature: GYAE6OF01A9U4T.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtgggaggaggcctgatccagccgtcgggggtccctgagacctctcctgtgcagcctgtggtccaccgtcagtccacacctacagtgtaggttcgggtcccgccgacgggcctaccgggaagggggaacggggccgttaggggaggttcggggttcctttacctttttaagtttacgaggtacgtaggttgggtaacgttaacaacgtttacttcccggactaacgtaccgtccggtagggacgggggcctacttaccgaacctacgttcctaccgaaggaacgtaaccctaaacgttaccgtaaaacgaacccgtacggttaccgtttacggttttaacccttaaactaaaacgttacgaaacgtacggtacccgtaggaacggtacgacccggtagtaccggaaccgaccgggttacccgttagttaacgtttacggtcggtcggaacggaggtaacggtcgggtaacccgggacccgtaaacggttaaccgttaaccgtcggtacgtaaggtcgggtacggttaccgggacggggacccgtaaacgggcccgtaaacccggg

SEQ ID NO: 269484 - DNA, 712 bp, Homo sapiens
  misc_feature: GYAE6OF01C0DJL.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgatccagccgtggggggtccctgagactcctcctgtgcagcctcgtgggttcaccgtcagtcacacctacatgagttcggtccgccgaggcctccgaggggaacggggcgtgggagtgggttctccttttaatttacgagtcgtaggtggtagtaactatacttccgacacgtactccggtggaacggggtccgatttccaaccgtatccgtacccgaagtacgaacctaaactactaaaacggaacctaacggtactttacgttttacgttaacctaaaagttcgaaaacgtcggtacccttagggaacgaacggtaccgaagttacggaacccgtaaccggggtcccgttaagttaacgttaccgttggtcggacggtaaggacgtaacgggtaccggggaccccgtaaacggtaaaccgtttaaccgtaccggtactaagtcgggtaccggttacgacgggggacccaaaggggtcccgtaaacccggg

SEQ ID NO: 269485 - DNA, 592 bp, Homo sapiens
  misc_feature: GYAE6OF01B9TVJ.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctgatggagtctggaggaggcctgatccagccgtggggggtccctgagactctcctgtgcagcctcgtgggttcaccgtcagtccacacctacatgagttcgggtccgccaggcctaccgaggggaaggggctgggaggtgggtcttcctttatttacagcagtggtagtacatattccgcagactcgtggaggggccattccaccatctccagacgacaactctaaagaacacgtcttgtttcctacaaatgaaccagcctgacgacgcgatacggacgacgggtcccgtagttacttacgtgtagcgagagacggtccggggaccctaaggtaaaccgttactaccggcttaacggtgggacccggttggccgggggaccctaaacgggggaccccg

SEQ ID NO: 269486 - DNA, 612 bp, Homo sapiens
  misc_feature: GYAE6OF01A589M.11.25.C03.1.454.CMB.1.raw
  modified_base (358)..(358): a, c, t, g, unknown or other
  misc_feature (358)..(358): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggtccgccaggctccgagggagggctggagtggtctcctttattacagcagtggtatacatattccgnagactccgtagaggggccattccgacatctccagacgacaactctaaagaacacgtcttgtttactacaaatcgaacagcctagagacgccgaatcgaaccgaccgggtccgttagttaacttacgtggtagaccggaagacggtacggttacggggaccccctaacggtaaaccggtttacgtaccggaccttaggtaccgggtaccgttaccgggtagggggacccctaaaacgggggccccgtaacccggg

SEQ ID NO: 269487 - DNA, 606 bp, Homo sapiens
  misc_feature: GYAE6OF01CLAC5.11.25.C03.1.454.CMB.1.raw
  modified_base (344)..(344): a, c, t, g, unknown or other
  misc_feature (344)..(344): n is a, c, g, or t
  modified_base (386)..(386): a, c, t, g, unknown or other
  misc_feature (386)..(386): n is a, c, g, or t
  modified_base (435)..(435): a, c, t, g, unknown or other
  misc_feature (435)..(435): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagtttggctgagcttgggttttccttgttgcttattttaaaaggagtccagtgtgaggtgcgtctggtggagtcgtggaggaggcctgactccagccgtggggggtccctgagactctcctgtgcagcctcgtgggttcaccgtcagtcaccactacatgaggttcggtccgcaggctacgagggagggctggagtggtctctttattacngcagtggtatacatactcgcagactcgtggacgggcatcacntcacagacactactctaagacacgtcttgtttaccacaaatcggaaacngacctaggaacgcgacgatcgaaccgtcgggtccgtagttactacgtgtcggaacgtacggaggtacggccggggacccaaacgggttaaacccttacggtaccgtactacggtacgggtacccgtacgggtaccgggggaaaccctaaacggggtaccctaaccccgggg

SEQ ID NO: 269488 - DNA, 562 bp, Homo sapiens
  misc_feature: GYAE6OF01DCPXR.11.25.C03.1.454.CMB.1.raw
  modified_base (536)..(562): a, c, t, g, unknown or other
  misc_feature (536)..(562): n is a, c, g, or t
tcagcgagagataccacgaccggtgctcgatttagtagtgtagatttgggtttgggggggaagaggaagactgacggtccgccaggctccagggaaggggctggagtgggtctcctttatttacagcagtggtagtacatattccgcagactccgtgagggccgattcaccatctccagagacaactctaagaacacgctgtttcttcaaatgaacagcctgagagccgatgacacggccgtgtattactgtgcgagagatggggcccaacgaaccgttactacgctatggacgtcgtggggccaaagggaccacggtcaccgtcctcctcacgcctccaccgaacgggcccatccggtccttccccccgtgggccgccctcgcctccgacggacgccacccgtccgagacgcacaggccggccccgtggggccgtcgccgtcggtccgaaacgggtacctaacccgtttcccggttaactccttccgtccgtcgtaggacggccgggcgtcgggacgacgggccgacgagtacgnnnnnnnnnnnnnnnnnnnnnnnnnnn

SEQ ID NO: 269489 - DNA, 575 bp, Homo sapiens
  misc_feature: GYAE6OF01BPS5A.11.25.C03.1.454.CMB.1.raw
  modified_base (451)..(451): a, c, t, g, unknown or other
  misc_feature (451)..(451): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccgccaggctccgaggggagggctggagtgggtctcctttatttacagcagtgtagtacatacttccgacagactccggtggacggggcccattccaccatcctaccgagacgacaactctaacgaacacgtcttgtttcttacaaatgaacngcctgagacgcgatcgacacggcgtagtacttacgtgtgcgagagtagcggggacccacggtaacgttacaccgtactagtacgggaccgttcgaccgggggaccaaacggggccctaaccggg

SEQ ID NO: 269490 - DNA, 557 bp, Homo sapiens
  misc_feature: GYAE6OF01AGCIA.11.25.C03.1.454.CMB.1.raw
  modified_base (223)..(223): a, c, t, g, unknown or other
  misc_feature (223)..(223): n is a, c, g, or t
  modified_base (253)..(253): a, c, t, g, unknown or other
  misc_feature (253)..(253): n is a, c, g, or t
  modified_base (523)..(523): a, c, t, g, unknown or other
  misc_feature (523)..(523): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(542): a, c, t, g, unknown or other
  misc_feature (541)..(542): n is a, c, g, or t
  modified_base (545)..(557): a, c, t, g, unknown or other
  misc_feature (545)..(557): n is a, c, g, or t
tcagcgagagataccacgaccggtgctcgatttagtagtgtagatttgggtttggggggaaggaggaagactgacggtccgccaggctccagggaagggcgtggagtgggtctcctttatttacagcagtggtagtacatattccgcagactccgtgaggggccgattcaccatctccagagacaactctaagaacacgctgttcttcaatgaacagcctganagccgatgacacggccgtgtattactggtncgagagatggggcccagaacgttactacgctatggacgtctggggccaagggccacggtcaccgtctcctcagcctccaccaagggcccatcggtcttaccccctgggccgtccctcgccttccgaggtacgccaaccgtccgagagccacacggccggccctaggggcctcggcccgttgggtaccaacggggtacctacgtttaccccggtatccgtaccgtcgccgttggaacgtccggggtctcggcgaacggtcgactcgtaagngctcgatcgcgncngncnngcnnnnnnnnnnnnn

SEQ ID NO: 269491 - DNA, 594 bp, Homo sapiens
  misc_feature: GYAE6OF01CY7CM.11.25.C03.1.454.CMB.1.raw
  modified_base (299)..(299): a, c, t, g, unknown or other
  misc_feature (299)..(299): n is a, c, g, or t
  modified_base (450)..(450): a, c, t, g, unknown or other
  misc_feature (450)..(450): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctgggtggagtctgggaggaggcctgactccagccgtggggggtccctgagactctcctgtgcagcctctgggttcaccgtcagtcacacctacatgagttggccnccaggctccgagggagggctggagtggtctcttatttacagcagtggtatacatactccgcacgacctccggtggacggggcctattcaccatcctccagacgaactactactaaagaaccacgtcttagtttactaccaaatcgaaaccngtccctggaaggacgacccgagttcggaccgaccgggtccttaggttacttacgtgtcggacgaggagacgtcggggcccaacggtaccgttacgacgacgttagtcgggacgttcggaggggacccaaggggccctaaccggg

SEQ ID NO: 269492 - DNA, 848 bp, Homo sapiens
  misc_feature: GYAE6OF01COIBD.11.25.C03.1.454.CMB.1.raw
  modified_base (274)..(274): a, c, t, g, unknown or other
  misc_feature (274)..(274): n is a, c, g, or t
tcagcgagagataccacgaccggtgctcgatttagtagtgtagatttgggtttgggggagaggagcccagcactgggattccgaggtgtttccattcggtgatcagcactgaacacagaggactcacatggtagtttggctgagtcttgggtttttccttgttgtacttaagttttaaaaaggagtcctagtgtggaggtgcgtcgtgggtggagtcgtgggaggaggcctgactccgacggtccgggtcggggtcctagacgtctctcgtgcncgcgtccgtcggtcgtctaccgtacacgtacacctacctatgtaggtcggtcggtccgacggcgtccgacggaggggtacggtacgtgggtacggttcggtttactttaccgttttagtacgagtacgtaggttacgtaacgtacctattaccgttaccgacgtaaccggtaccggtccgggtaacgggaaccgggtaccttaccgttaccaaaccctacttacccgaaccggacgaaccgtaaacccgttaaaccgttaaccgaaaacggtaaccttacggtttaaccgtttaacgttttaacccaaacgtaaacgtacgaaaccggtacccgtacgtacgggaaacgaccggaaccgtacggttaaccgaacccgggtacgggttaccttaacggttaaactttcggaccgggtacggaacggttaagggtaaccgggtacccgggtaacccgggaaacccggttaaccgttaaacccggttacggtaaccggttcggtaagggttacccgggtaccgggtacggggttaacccgggggaaacccgtaaacggggtaccccgtaaccccggg

SEQ ID NO: 269493 - DNA, 657 bp, Homo sapiens
  misc_feature: GYAE6OF01CLF0D.11.25.C03.1.454.CMB.1.raw
  modified_base (303)..(303): a, c, t, g, unknown or other
  misc_feature (303)..(303): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtcgtgggaggaggcctgatccagccgtggggggtccctgagctctcctgtgcacgcctcgtggttccaccttcagtcacacctacatgagttcgggtccnccgaggcctaccgaggggacgggcgtggaggtgggtccttctttagttacagtctaggtggtagtctatcgtccgcagcctcgtaggacggggtcattccacactccaccgagacgacaactactaaacgaacctcgtctttacgtttacttaacaaactgaacacgtaccccgtaggaacgacggtacccgtaagtaccggaaccgtacccgggtaccgttaggtttaactttaccgtggttacggacggtaaggacggtacggtcggggacccctaacggtaaccgttaccacggttactacggtaggtcccggttacgggaccggggaaccgtaacgggacccgtaccggg

SEQ ID NO: 269494 - DNA, 625 bp, Homo sapiens
  misc_feature: GYAE6OF01C8ACR.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttccaccgtcagtcaccacctacatgagttcgggccgccaggctccgaggggaagggctggagtgggtctcctttattcagcaggtgtagtacattacgttccgacacgacgtccggtggacggggccgtattaccacctatcctccgaagacgaaccaactactaacgaactacgtcttacgtttacttacaaatcgaacctacgccttaggacgacgccgtaatcgaccgacggtccgtagtacttacgtggtcgacggtaggaggtacggtacggggacccctaaacggtaccgtttacgtaccggtactaggtacgggtaccgtcgggacggggacccgaaggggtaccctaccggg

SEQ ID NO: 269495 - DNA, 782 bp, Homo sapiens
  misc_feature: GYAE6OF01BSGRX.11.25.C03.1.454.CMB.1.raw
  modified_base (293)..(293): a, c, t, g, unknown or other
  misc_feature (293)..(293): n is a, c, g, or t
  modified_base (307)..(307): a, c, t, g, unknown or other
  misc_feature (307)..(307): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttattttaaaaggagtccagtgtgaggtgcgtcgtggtggagtcgtggaggaggcctgatccagccgtgggggtccctgagactctccgtgtgcagcctcgtgggttccaccgtcagtcacacctacntgaggttcggtccncgaggcctaccggaggggaacgggcgtagggacggttcgggttcttaccgttttaatttacgagtcgtaggtaggtaagtactaagttacgttccggactaacgtaccgttccggtacgggaccggggtaccgtaactttacccgaccgtactccgtaccgaagtaacgaacctaaacttaaccgtaaacgaaacctcgtacgtttacgttttactaacgaaagttcggaaacctacgtccgtaaggtaacggaacgacccgtaagtaccggaaccggtacccgggtaccgttaacgttaacgtttaccgtacgggtacggacccggtaaaggtacggtaaccggggtacccggggacccccgtaaaacggtaaacccgggttttaacccgaaccggtaccgttaacgggtacgggtacccggttaccggggtaacgggggaaccccgtaaacggggtacccccggtaacccggg

SEQ ID NO: 269496 - DNA, 716 bp, Homo sapiens
  misc_feature: GYAE6OF01BK9E1.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagtttggctgagcttgggttttccttgttgtcttaattttaaaaggagtccagtgtgaggtgcgtctgggtggagtcgtgggagggaggcctggactccgaggtccggtcgggggggtccctggagaccttctcctgtgcacgtcctcgtgggttaccaccgtcagtcaccacctacatgtagttcgggccgccgaggccgtccgaggggaaggggtctgggaggttcgggttccttccttttaatttacgagccgtaggtaggtagtaacagttacttccgagtaacgaccgttccggtgggacggggtccctaacgttaccaaccacttcctaccgtaaggaccgaactaaccgtaaccgtaaacgtaaacccaccgttactttacggttttacctttaacaaagtacgaaaccgtacgtacctaggaacgcgaaccgtagtcgaaccggtaccggccgttattacgttacgtcggtaggacggtagacggtacggtccgggacccgtaacggtaccgttaaccgcgtaccgtagaccgggtaccttcgggacggggaccccgaagggacccgtacccggg

SEQ ID NO: 269497 - DNA, 581 bp, Homo sapiens
  misc_feature: GYAE6OF01A35J6.11.25.C03.1.454.CMB.1.raw
  modified_base (442)..(442): a, c, t, g, unknown or other
  misc_feature (442)..(442): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggtcaccgtcagtcacacctacatgagttggtccaccgaggctccgagggagggctggagtgggtctccgtttatttacagcagtggtagtacatacttccgcagactccggtgacggggccattcaccatcctcagaacgacaactctaaagaacacgcttgtttctaacaaatcgaaacncgacctgagacgccgaatcgacaccgggccgttgttaacttctggtacgacggaaggagtacgtccgggggacccacggtaaaccgttactacgcgtaagtcgggacgttcgaggggacccaaggggacccgtaccggg

SEQ ID NO: 269498 - DNA, 739 bp, Homo sapiens
  misc_feature: GYAE6OF01ASOUP.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtggttccaccgtcagtcacacctacatgagttcgggtcccgcaggctccgagggagggctggaggtcgggtcttcctttatttacgagcgtagttggtaagtactaatacttccgactacggtacctcggtaggacggggccctacgtttccaaccctatcccttaccgaacggtacgaacctaaaccgttacgtaaacggaaacctaccggtcctttacggttttaccttaaccaaagttacggaaacctacgtacccgttaggaacggttacggaccccgtaagttcgaaccgaccgggtccgtttaagttacttaacgtgggtacgacgggtagacggacgggtacccgggggaacccctaaacgggtaaccgtttacccgtaacccggtacttaacgggttacccggggtaacccggtttcgggtaaccccggggggaaccgttaaaaccgggggcccccgttaaacccgggg

SEQ ID NO: 269499 - DNA, 762 bp, Homo sapiens
  misc_feature: GYAE6OF01CWBTA.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtgggaggacggcctgatccgagccggtcggggggtccctggacgctctccgtgtgcacgtcctcgttcgggttccaccggtcacgtcaacctaacctacgagtcggtacgttcggggtcccgccgaggtccgtaccggaagggggaacggggcgtagggtaggttcgggttcttaccgttttaatttacaggtcctaagggttggttaacgttacgattacgttcccgacaaggtaccgtcccgggttggacggggtacctacttacccgaccacgttcctaccgaagacgaacctaaaccttacgtaaacgaaccacgttcgtttacgttttaccttaacaaagttacgaaaccctggacccgtaggaacgaaccgtcccgaagtccggaaccacccgggttccgtagtttaacgtttcgtggtacggcggaaaggtaagggaccggttaccgggggaaccccaaacggttaaccgtttacccgaacggtacgtaggtaccgggtaccggttacgggaccgggggaacccaaagggggtcccctaaaccgggg

SEQ ID NO: 269500 - DNA, 562 bp, Homo sapiens
  misc_feature: GYAE6OF01AWG7O.11.25.C03.1.454.CMB.1.raw
  modified_base (365)..(365): a, c, t, g, unknown or other
  misc_feature (365)..(365): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttcgggtccgccgaggctaccgagggaggggctggagtgggtctctttattacagcagtggtagtacatacttccgnacgactccggtggaggggccgattcaccatctccagagacaactcaagaacacgcttagtttcttacaatgaacacgcctgacgagccgatcgaccacggccgtagtattactgtgcgagagagtcggggacccacggtaaccgttactaccgactagtcggacgtacggaggggacccaagggacccgtaaccggg

SEQ ID NO: 269501 - DNA, 906 bp, Homo sapiens
  misc_feature: GYAE6OF01CV52J.11.25.C03.1.454.CMB.1.raw
  modified_base (178)..(178): a, c, t, g, unknown or other
  misc_feature (178)..(178): n is a, c, g, or t
tcagcgagagataccacgaccggtgctcgatttagtagtgtagatttgggtttggggagaggagcccagcactgggattccgaggtgtttccattcggtgatcagcactgaacacagaggactcacatggagtttggctgagcttgggttttccttgttgacttaattttaaaaaggngtccagtgtgaggtgcgtcgtggtggagtcgtgggaggacggcctgactccgaggcccggtcggggggtccctggacgtaccttcctccgtggtcgccgacgtcccgttccggttcgggttaccacccggttcaacggtaccctaacctaaccctaacctaagttcggtaacgggttttccggggtacccccggaccggacgggtacccgtacccggaaaggggggtaacgggggtcgttacggggtaacgggtttcccggggttttaccccctttttaagttttaacccgaaggtaccgtaaggttagggttaaacgtaccgtaaactttacgttccccggacgtaacggtaacccgttccgggttaacgggaccgggggtaccccttaatttccccgaaaccctacttacccgtacccgaaagggtaacgtaaaccctaaacccgttaccgtaaaacgaacccgtacgttacccgttttacgttttaaccttaaaacgaaaacgttaccgaaaccgtaacgtccgtaaggaacggtaacggtacccgtaagttacggaacccgtaccggggtcctttaacgttacttaccggtggttacggacgaaggtacggtaccggtaccggggaacccctaaaggtaacccgttacgtaacccgtgtaacggttcgggaaccggttcccgggaacggggaccccgtaaacgggcccgtacccgggtaccccg

SEQ ID NO: 269502 - DNA, 672 bp, Homo sapiens
  misc_feature: GYAE6OF01CI3F7.11.25.C03.1.454.CMB.1.raw
  modified_base (177)..(177): a, c, t, g, unknown or other
  misc_feature (177)..(177): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtcgtggaggaggcctgatccgagccgtggggggtccctgagactctcctgtgcacgcctcgtgggttccaccgtcagtcaccacctacatgaggttcgggtccgccgaggcctccggaaggggacggggcgtgggaggtcgggtccttcctttatttacagtcaggtggtagtactattacgttccgacacgaccgtcggtgggacggggcctacttaccacctactcctaccgaagacgaacctaaacgtactaaacgaacctacgtcttcggttttacctacgaaactgaaaccgtacgtcccgtagacgacgaccgtataccgaaccggaccggtcccgttagttaacgttactggtcgacggaaggtgaccgggtcggggacccctaacggtaacgttacgtaccgtacgttagtcgggtaccggttacggacggggaacccgaacggggtacccgtaaccggg

SEQ ID NO: 269503 - DNA, 861 bp, Homo sapiens
  misc_feature: GYAE6OF01BWOHM.11.25.C03.1.454.CMB.1.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtcgtggaggaggcctgatccagccgtgggggtccctgagacctctcctgtgcagccttcgtgggttccaccgtcacgtccacacctacagtgacggttcgggtcccgccgaggtcctaccggaaggggaacggggtcgtggggtacggttcggggttccttaccgtttttaacgtttaacgacggtacgtaaggttacggttaaggttaacctagttaacgttcccggactaacggtaccgttcccggtaggggaaccgggggacccttaacgtttacccgaacccgtaacgttacccgtaccgaacgtaacgaaccctaaaccgttaacgttaaacgaaacccgtaccggttacctttacggttttaaccctttaaccgtaaaacgttacggaaaacccgtacggtaccccgttaaggaacggtaacggtaaccccggtaagtaaccgaacccgggtacccggggttacccgttttaggtttaaaccgtttaacggtcgggttaacggaaccgggtaaaggtacggtaccggggttacccggggaaccccgtaaacggttaaacccggttttaccgaaccggtacgttaacggtacggggtaacccgttcggggaaccgggggtacccgaaaaccgggggtccccgtaaacccggg

SEQ ID NO: 269504 - DNA, 609 bp, Homo sapiens
  misc_feature: GYAE6OF01CRCYE.11.25.C03.1.454.CMB.1.raw
  modified_base (175)..(175): a, c, t, g, unknown or other
  misc_feature (175)..(175): n is a, c, g, or t
  modified_base (372)..(372): a, c, t, g, unknown or other
  misc_feature (372)..(372): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtcgtggaggaggcctgatccagccgtggggggtccctgagactctcctgtgcagcctcgtgggttccaccgtcagtcaacacctacatgagttggtccgcgaggctccgagggagggctggagtgggtctcctttattacagcagtggtatacattatccgcagactcgnggagggccatcacatcaccagacgacactactaacgaacacgcttcgtttactactaatgaaacagcctagaacgagaccgatacgaactacgggtccgttagttacttaacgtgtcggacggaggaggacgtcgggggacccctaagggtaacccgtttaaccgacggtaccgttaagtcggggtaaccggttaccgggtagggggaacccgaaacgggggccccgtaaaccgggg

SEQ ID NO: 269505 - DNA, 574 bp, Homo sapiens
  misc_feature: GYAE6OF01BFYHG.11.25.C03.1.454.CMB.1.raw
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (440)..(440): a, c, t, g, unknown or other
  misc_feature (440)..(440): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtctggaggagggcctgatccagccgtggggggtccctgagactctcctgtgcagcctcgtgggtccaccgtcagtcacacctacatgtagttcggtccgcagggctccgaggggagggcgtggagtgggtcttctttattcagcagtgtatanatatccgnacgactcgngacgggcattccacatcctacagagaacaactacgtaagaacacgtactgtttactacaaatgaacngtacctagacgagaccgagtcgacacggccgttagtacttacgtggtagcgagaggtagcggggacccaacgggtacgtaacgtcgacgtagtcgggtaccgttcggacggggacccgaagggcccgtaaccgg

SEQ ID NO: 269506 - DNA, 770 bp, Homo sapiens
  misc_feature: GYAE6OF01DCXU7.11.25.C03.1.454.CMB.1.raw
  modified_base (285)..(285): a, c, t, g, unknown or other
  misc_feature (285)..(285): n is a, c, g, or t
  modified_base (648)..(648): a, c, t, g, unknown or other
  misc_feature (648)..(648): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttattttaaaaaggagtccagtgtgaggtgcgtctggtggagtcgtggaggaggcctgatccgagccggtcggggggtccctggagacctctccgtgtgcacgcctcgtggttcaccgtnagtcacacctacatgagttcggtccgccgaggctaccggaggggaaggggtctgggtaggtcggggttccttaccgttttaatttacgacggtcaagggtggtaacgtacgtaattacgtttccgactaacgtaccgttcccgggtggggacggggtacccgtaacgttttacccaaccgtaacctttccgaccccgaaggaaccgaaaccctaaacctttaaccgtaaaacggtaaacctaccccggttctttacggtttttaaccttaacgtaaaagttacgaaaccgtacgccccttagggaacgtacggaccgtaagtacggaaccgacccggggttccgtttagttaactttaccggngttacggaccggtagacggaccggtcggggaaccccctaaagggtaaccgtttaaccgacggtacttacggtacggtaccggttaccggtaggggacccccggaaaggggccctaacccggg

SEQ ID NO: 269507 - DNA, 550 bp, Homo sapiens
  misc_feature: GYAE6OF01AMW0E.11.25.C03.1.454.CMB.1.raw
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
  modified_base (513)..(513): a, c, t, g, unknown or other
  misc_feature (513)..(513): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggcctccgagggaggggctggaggtgggtctcctttatttacagcaggtggtatacatacttccgcagactccgtggaggggccattcaccatctccagnacaactctaagacacgcttgtttctanaaatgaaacngcctgagacgccgatggaaccacggccgtgtaacttagtgtgcgagagagtcggggccccaagaaccgttanacgctagtggaccgtcgaggggccaaagggccaccgg

SEQ ID NO: 269508 - DNA, 688 bp, Homo sapiens
  misc_feature: GYAE6OF01AIOYR.11.25.C03.1.454.CMB.1.raw
  modified_base (378)..(378): a, c, t, g, unknown or other
  misc_feature (378)..(378): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaaggagtccagtgtgaggtgcgtctggtggagtctggaggaggcctgatccagccgtggggggtccctgagactctcctgtgcacgcctcgtcgggttccacccggtcacgtccaccacctacatgaggttcgggtccgccaggctccgagggagggctggaggtgggtcctcctttattacagctagtggtagtacatacttccgnacgacctccggtggacggggcctatccacctatcctccaagacgaacaactctaagaaccacgtcttgtttacttacaaatcgaactagccgttagacgacgaccgtaagtcgaaccgaccgggtccgttagtactttacgtcggtacggacgtaaggacggtaccggtaccgggggtaccccgtaaacccggttaacccggtttaacccgtaaccgggtaccgttaacgggttaccggggtacccgggtttaccgggtcccggggggaaaccccgggtaaacccgggggtaccccgtaaaccccggggg

SEQ ID NO: 269509 - DNA, 585 bp, Homo sapiens
  misc_feature: GYAE6OF01AYXQQ.11.25.C03.1.454.CMB.1.raw
  modified_base (364)..(364): a, c, t, g, unknown or other
  misc_feature (364)..(364): n is a, c, g, or t
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
  modified_base (491)..(491): a, c, t, g, unknown or other
  misc_feature (491)..(491): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggtttttccttgttgcttattttaaaaggagtccagtgtgaggtgcgtctggtggagtctggaggaggcctgatccagccgtggggggtccctgagactctcctgtgcagcctcgtgggttcaccgtcagtcacacctacatgagttggccgcaggcctcgagggagggctggagtgggtccttctttattacagcagtggtatacatacttccgnacgctcgtggaggggcctattccacctatcctaccgagacgtaacaactactaagaacncgtacttgtttactacaaatgaaacncgcctagagacgccgatacgacgaccggtcgttagtattacngttagcggtagagacggtcgggacccctaaggtaaccttaacgtccggagttagtccgggacgttcggacggggacccaaaggggcctaccggg

SEQ ID NO: 269510 - DNA, 660 bp, Homo sapiens
  misc_feature: GYAE6OF01DPUL0.11.25.C03.1.454.CMB.1.raw
  modified_base (305)..(305): a, c, t, g, unknown or other
  misc_feature (305)..(305): n is a, c, g, or t
  modified_base (614)..(614): a, c, t, g, unknown or other
  misc_feature (614)..(614): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctgggtggagtcgtgggaggaggcctgactccaggccggtcggggggtccctggacgactcctcctgtgcacgtcctcgtcgggttccaccgtcagtcacacctacntgtaggttcggtccgcgaggctccggaggggacggggtcgtggaggttcgggtccttactttatttaccgagtctaggtggtatactattacttccgacacgacttccggtggacggggacctattccacctactccgtaccgaagacgaaccaacctacgtaaacgaacctacgtctttacgtttccttaacaaagtcgaaacgcggtactaggacacggccaagtcggaacctaccgggtcttacggttacttacggtaggtcgacggaggacgacgggtccggggaccctaacggtaacgttaccncgtactagtcggtaccggtcggagggaacccgaaggcccgtaccgg

SEQ ID NO: 269511 - DNA, 729 bp, Homo sapiens
  misc_feature: GYAE6OF01B54JX.11.25.C03.1.454.CMB.1.raw
  modified_base (382)..(382): a, c, t, g, unknown or other
  misc_feature (382)..(382): n is a, c, g, or t
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctcgatgagttgactcagcccaccctcagtgtccgtcgtccccaggacagacagccagactcccctgctcgtggaattgaattgagagataaatattacgttgttggtatacaaacagaacgccaggccacgtcccctgtattggtcatctactcaagataggtcgaaggccgtccctacgacgggtactcccgtggacgtcgtatctcgtcgtctaccacgtcgacggacncacgccactcacgaccataccgacgggacccggaccgacggtactacggtggaagtgggacgtcgtacgtaacttaagtttcgttacggtacggtaggggtaccggttacgggaaccgtacgggtacccggacggtaacccgttacccggttaccgggtttacccggttttaacggtcccgggttttaccggttaaacccgggggttaaaccggggttacccggggtaaaacccggtttaaaccggggtaccccgtttacccgggtttacccgttacgggtaaacccggttacccgaacccgggaacccccggaaaaccccgggtacccccccttaaaacccccggg

SEQ ID NO: 269512 - DNA, 831 bp, Homo sapiens
  misc_feature: GYAE6OF01A9INP.11.25.C03.1.454.CMB.1.raw
  modified_base (180)..(180): a, c, t, g, unknown or other
  misc_feature (180)..(180): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggtagttttggctgagcttgggttttccttgttgcttaattttaaaaaggngtccagtgtggaggtgcgtcgtggtggagtcgtgggaggaggcctgactccgacggccggttcggggggtccctggacgtaccttcctccgtgtcgcgacgtccttcgttcgggttccaccgtcgacgtccaaccaccctactagtggtacggtttcgggtcccgccgacggtccgtaccggagggggaacggggcgtaggggtaggttcgggttcctttaccttttaacgtttacgacggtacgtaaggttggtaacgtaactaattacgttccgactagtaccgtccggtagggacggggtaccctagtttaccgaacctacgtcctaccgaaggtaacgaaccctaaaccgttaacgaaaacgtaaccgtaaccgtcttttacgttttaaccttaaacctaaagtaccgtaaaacgaccgtaccgtaaggaacggtacggaccggtaagtaccggaacccggtaccgggtaccggtttaacgttaacgtttacggttacgggtaggaccgaagggtaacggtacgggtaacccggggtaacccctaaaccggttaacggtttaacccgaacggttacgttaccggtacggggtacccgtacggggtaacccggggaacccggtaaaccggggaacccgtaaccccggg

SEQ ID NO: 269513 - DNA, 660 bp, Homo sapiens
  misc_feature: GYAE6OF01ASOSN.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccgccaggcctccgaggggaaggggctgggagtgggtcttccttttattaccagtcgagtggtagtacatagttccgatacgaccttccggtggacgggggtcccgactttcacctagtcctacgaagagaaccaactactaagaaacctacgtcctttacgtttcttaacaaatacgaacacgtaccgtagacgacgaccgtatcggaaccgacggccgttagtacttacgtgtagccgaggacgtacggtccgggggtaccctaaccggtaaccggtttaccgtaaaccggtcgttaaagtcggggtaccgttacgggtaccgggggtaacccgtaaacgggggaccccgtaaccccgggg

SEQ ID NO: 269514 - DNA, 630 bp, Homo sapiens
  misc_feature: GYAE6OF01B98IL.11.25.C03.1.454.CMB.1.raw
  modified_base (418)..(418): a, c, t, g, unknown or other
  misc_feature (418)..(418): n is a, c, g, or t
  modified_base (465)..(465): a, c, t, g, unknown or other
  misc_feature (465)..(465): n is a, c, g, or t
  modified_base (478)..(478): a, c, t, g, unknown or other
  misc_feature (478)..(478): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggttttccttgttgcttattttaaaaggagtccagtgtgaggtgcgtctggtggagtctgggaggaggcctgatccagccgtggggggtccctgagactctcctgtgcagcctcgtgggttccaccgtcagtccacacctacatgaggttcgggtccgccaggcctaccgagggggaaggggctgggaggtcgggttcttccttttattacagctaggtggtatacatacttccgcacgtactccgtggacggggtccattccactntctacagacgacaactacaagacacgtcttgttactacaatcgaacngcctagacgtacncgatacgaaccgaccggtcgttagttacttacgtgtacggacgaaggacggtaggtaccgggggaacccctaacgggttaaacccgtttacaccggtcttaaggcgggtaacctcgggtacggggacccgtaaacggggcccgtaacccggg

SEQ ID NO: 269515 - DNA, 696 bp, Homo sapiens
  misc_feature: GYAE6OF01CEH0O.11.25.C03.1.454.CMB.1.raw
  modified_base (432)..(432): a, c, t, g, unknown or other
  misc_feature (432)..(432): n is a, c, g, or t
  modified_base (456)..(456): a, c, t, g, unknown or other
  misc_feature (456)..(456): n is a, c, g, or t
  modified_base (512)..(512): a, c, t, g, unknown or other
  misc_feature (512)..(512): n is a, c, g, or t
  modified_base (524)..(524): a, c, t, g, unknown or other
  misc_feature (524)..(524): n is a, c, g, or t
  modified_base (652)..(652): a, c, t, g, unknown or other
  misc_feature (652)..(652): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagtttggctgagtcgttgggttttccttgttgtacttaagtttaaaaggacgtccagtgtgaggtgcgtcgtggtggagtcgtgggaggacggcctgactccgaggccggtggggggtccctggacgccttctcctgtagccgacgtccgtcgttcgggttccaccggtcacgtccaccaccctagagtggtaggttcgggtcccgcgacggtccgtacggaggggtacgggtggtagtcggtcttactttattagacgcgtaggtgtaacgtactaattcgtcgacgtacgacgtcgngggacggctactccgaacattccncgaagtaacgaacctaactaacgaaacgaccctacggttactttgtttacctaaanaatcgaaaccgngtaccgtagacggaccgacgagtacccgaagtcccgggtgtttaactagtacctggtacgcggtaagaggtaccgggaccggacccttaacggtaacgttggaccctggtaccgacggggttaacccncggggtacggggacccctaaacggggtacccgtcccgttacccg

SEQ ID NO: 269516 - DNA, 555 bp, Homo sapiens
  misc_feature: GYAE6OF01B5IB5.11.25.C03.1.454.CMB.1.raw
  modified_base (527)..(528): a, c, t, g, unknown or other
  misc_feature (527)..(528): n is a, c, g, or t
  modified_base (531)..(540): a, c, t, g, unknown or other
  misc_feature (531)..(540): n is a, c, g, or t
  modified_base (542)..(548): a, c, t, g, unknown or other
  misc_feature (542)..(548): n is a, c, g, or t
  modified_base (550)..(555): a, c, t, g, unknown or other
  misc_feature (550)..(555): n is a, c, g, or t
tcagcgagagataccacgaccggtgctcgatttagtagtgtagatttgggtttgggggggaagaggaagactgacggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacggaacgttactacgctatggacgtctggggccaagggaccacggtcaccgtctcctcacgcctccaccgaacgggcccatccggtcctttcccccgtggccgcccctgcctccgtagggacgcccacccgtcccggaagacgccaccgagccggtcccgtgggcctggccctgggtaccaacggtaccttaccttcccggttaattccgttctcgctcggacgccggggcgtcgggacgaagggccgacagtacgnncgnnnnnnnnnncnnnnnnncnnnnnn

SEQ ID NO: 269517 - DNA, 802 bp, Homo sapiens
  misc_feature: GYAE6OF01EK00L.11.25.C03.1.454.CMB.1.raw
  modified_base (178)..(178): a, c, t, g, unknown or other
  misc_feature (178)..(178): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttattttaaaaggngtccagtgtgaggtgcgtctggtggagtcgtggaggaggcctgatccagccgtgggggtccctgacgactctcctgtcgcacgcctcgtcgggttcaccgtcacgtcaaccacctacagtggtaggttcgggtcccgccgacgggccgtaccgggaaggggggaagggggtccggtgggtacgggttcgggttcctttaccgtttttatttaccgagtacgtaaggttcgggtaacgtaactacttaacgttcccgacgtaacgaccgttccggtaggggacggggtaccgtacttacccgaacctacttccgtaccaaggaacgaacctaaacgttaccgtaaacgaaaccgccgttctttacgttttacttaaccgaaaagttcgaaaaccgtcggtaccctagggaacggaacggcccgtaagttcggaaccccgaaccggggttccggtttaagtttaaccgtttacgagggttcggacggtaacgggtagggaccgggttcccggggtaaacccccctaagggttaaacccgtttaccgtaaccggtcttaaacgggtcgggttacccggtcggggtacccggggaacccgggtaaaaccgggccccggtaaacccggg

SEQ ID NO: 269518 - DNA, 727 bp, Homo sapiens
  misc_feature: GYAE6OF01EYM9Q.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgacgactctcctgtgcagcctcgtgggttcaccgtcagtcacacctacatgagttcgggtcccgccgaggctaccggaggggaacggggcgtgggtacggttcgggttcctttccttttaattacgagacgtaggttaggtacgtactaattacttcccgctacgtaccgtccggtagggacggggcctacttaccacctacttcctaccgaagacgaacctaacctacgtaaacgaacctacgtctttacgttttaccttaacgaaacgttacgaaaccgtcgtacccgttaggaacgacggacccgtaagtaccggaacccggtacccgggttccgttacgtttaactttaccggtggtacggtaccggaaggtacgggtaccgggtaccggggtaacccccgtaacggttaaaccgtttaccgtaccgtacgtaaggtcgggtaccggttcgggacggggtaacccgaaacgggcccgtaccggg

SEQ ID NO: 269519 - DNA, 698 bp, Homo sapiens
  misc_feature: GYAE6OF01BY1R0.11.25.C03.1.454.CMB.1.raw
  modified_base (186)..(186): a, c, t, g, unknown or other
  misc_feature (186)..(186): n is a, c, g, or t
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (431)..(431): a, c, t, g, unknown or other
  misc_feature (431)..(431): n is a, c, g, or t
tcagcgagagataccacgaccggtgctcgatttagtagtgtagatttgggttgggaggaggagcccagcactgggattccgaggtgttccattcggtgatccagcactgaacacgagaggactcaccagtggtagttttggctggagtcgttcgggttttacctgttgacttaagttttaaaaggngtcagtgtgaggtgcgtgtgggtggagtcgtgggaaggnggcctaggactccgagccgtgggccggttacccngacgtctcctccgtgtacgcaggtccttcgttcgggttaccaccgtnacgtcacaccgtacngtaggtcggttcgggccacgaggtccgtaccggaaggggacgggcgtgggacggttcggtcctttacgtttattacgagcgtaggtggtaacgtacattacgtcccgganaacgtccgtccggtggaacggggccctattccacctatccgtaccaggacaactaacttaacgaaacgacgtaccggtactttacgtttactaactaaagtcgaaaccgcgtaccgtaaggacggaaccgtcgtaagaccgaccgtaccgggtagttacgttacgtacgtgacggacggagacggtacggtaccgggaaccctaaggtaaccttcgacgtacgttacgtacgggacgttaccggacgggaacccgacgggtaacccg

SEQ ID NO: 269520 - DNA, 621 bp, Homo sapiens
  misc_feature: GYAE6OF01BKAI6.11.25.C03.1.454.CMB.1.raw
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (439)..(439): a, c, t, g, unknown or other
  misc_feature (439)..(439): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtcgtggaggaggcctggatccaggccgtggggggtccctggaggactctccgtagtgcacgtcctgtcgggttcacgtcagtcacactacatgtagtcggtccncgacggctccgagggaggctggagtggtctctttatacngtcaggtgatacatagtcgnagctcgtgacggcatcactatcncgagcgacaactcgtaacgacacggtcttcgtttaacagtaaatcgaacncgtactagacgtacgccgagtcgaaccgtcggccgttagttactcgacggtcgacggtaaggagtaccggggtacgggtaccccctaggttaaacccgttccggtacggtcgttaacgggtacgggtacccgttacggggtacccgggggaaccctaaacgggggtaccccttaacccgggg

SEQ ID NO: 269521 - DNA, 614 bp, Homo sapiens
  misc_feature: GYAE6OF01DO43G.11.25.C03.1.454.CMB.1.raw
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggtttttccttgttgacttaattttaaaaaggagtccagtgtgaggtgcgtctggtggagtcgtgggaggaggcctgatccagccgtggggggtccctgagactctcctgtgcacgcctcgtgggttccaccgtcagtcaacacctacatgaggttgggccgccgaggcctccgaggggaaggggctgggaggtgggtctcggcttaattaagtcggccgagggtgacaagacatacacgcagagtccgngcgagggccatcgcacntcacagacgaacaacttacccaagaacgacgtctacgtacctagaacaaagtggacagcctagagacgaccgacgaaccgacggtacctaagttaacttacgtaggtaccgaaccgaaaggtaaaaccgttcccgtaacaaacggtaatttaagttcggaaccttaacgggtgggtacggtaccaaaacggttccg

SEQ ID NO: 269522 - DNA, 764 bp, Homo sapiens
  misc_feature: GYAE6OF01CDLGI.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccgagtccggtcggggggtccctgacgactcctcctgtgcacgcctcgtgggttccaccgtcacgtccaccacctacatgaggtttcgggtaccgccagggcctccggaagggggaggggcgtgggacggttcggggttccttaccgttttatttacgaggtcaggttaggtacgtaactattacgttcccgctacgtaccgtcggtacgggacggggcctattcccaaccgtatcctaccgagaacgtacctaaacgtactaaacgaacctaccgtctttacgtttacttaacaagtacgaaaccgtacgtacccgtaggacgacggacccggtatacggaccggtaccgggtaccgttagttaacgtttacgtacgggtcggaacggtaaaggacgggtaccgggacccgggggtaacccccgtaaaccgggttaaaccccggtttaacccggttaccggacgtttaaccgggacgggtacccggttacggggtacccgggggggtaacccaaacccggggggtcccttaaccccggggg

SEQ ID NO: 269523 - DNA, 642 bp, Homo sapiens
  misc_feature: GYAE6OF01BA5DN.11.25.C03.1.454.CMB.1.raw
  modified_base (178)..(178): a, c, t, g, unknown or other
  misc_feature (178)..(178): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (376)..(376): a, c, t, g, unknown or other
  misc_feature (376)..(376): n is a, c, g, or t
  modified_base (497)..(497): a, c, t, g, unknown or other
  misc_feature (497)..(497): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttattttaaaaggngtccagtgtgaggtgcgtctggtggagtctggaggaggcctgatccgagccgtggggggtcctgagtactctcctgtcgcacgcctcgtgggttccaccgtcacgtccacacctacngtggagttcgggtccncgaggctccggagggagggctggaggtggtcttcctttattacagctagtggtatcatagtccgngacgtactcggtggacggggtctaacttccaacctacttccgtaccgagacggtaacctaactacgtaaacgaactccggtactttcggtttactactaaactcgaacgtacgtcctaagngaaccgtccgaagtacgaccgaacgggtcgtagttactacgtggtgacgagtacggacgtccggggaccctaaggtaccgttacgtaccgtacgtacgttcgggaaccgttggtaccggggaacctaaccggggtctaacccggg

SEQ ID NO: 269524 - DNA, 709 bp, Homo sapiens
  misc_feature: GYAE6OF01AOXPY.11.25.C03.1.454.CMB.1.raw
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtctggaggaggcctgatccagccgtggggggtccctgagactctcctgtgcacgtcctcgtgggttcaccgtcagtcaccacctacatgagttcgggtcccgccaggctccgagggagggctgggngttggtctctttattacngctagtgtagtacatattccgcagacctccgtggacggggcctagttccacctatccgtccaagacgaaccaactaccgtaaacgaacctacgtccttacggttttaccttaaccaaagtcggaaacaccgcccgttaggaacgtacgggaccctaagtccggaaccgtacccgggtacccgttaggttaactttaccgtacgggttcgaccgggtaagacgggtacggtcccggggggaccccctaaacgggttaacccgtttaaccggtaccgttaccgtaacgggttaccgggtaacccggttcgggttaaccgggggaaccccggtaaacccgggggtccccgtaaaccccggggg

SEQ ID NO: 269525 - DNA, 673 bp, Homo sapiens
  misc_feature: GYAE6OF01B312S.11.25.C03.1.454.CMB.1.raw
  modified_base (178)..(178): a, c, t, g, unknown or other
  misc_feature (178)..(178): n is a, c, g, or t
  modified_base (498)..(498): a, c, t, g, unknown or other
  misc_feature (498)..(498): n is a, c, g, or t
tcagcgagagataccacgaccggtgctcgatttagtagtgtagatttgggtttggggggagaggagcccagcactgggattccgaggtgtttccattcggtgatcagcactgaacacagaggacctcaccatggtagttttggctgagctgggttttcctgttgctaatttaaaaggngtccagtgtgaggtgtcgtcgtgggtggagtcgtagggaggacggcctgactccgaggccggtcggggggtccctggagaccttcgtccgtgtagcacgcctcgtgggttccaccgtcagtccactacctacatgaggttcgggtcccgcgacggtctaccggaggggaaggggccgtgggaggtcgggttccttcctttagttaccgagtcgaggtggtagtacattacgttccgatagtaccgtcggtggacggggcctacttccacctatcctaccgagaacgacctaaactctaacgactacgctttgttacctanaagtacaacacgtctaggacgtacggccgatcgaccgtacggtctagttacgttcgtaggtcggtacgaggtacggacgggttcccgggaacccgtaaccgtaacggttaccctacggtcgttaggtacggtacccggtcggtaccggggaacccgtagggacccgttacccggg

SEQ ID NO: 269526 - DNA, 502 bp, Homo sapiens
  misc_feature: GYAE6OF01BTO97.11.25.C03.1.454.CMB.1.raw
  modified_base (353)..(353): a, c, t, g, unknown or other
  misc_feature (353)..(353): n is a, c, g, or t
  modified_base (480)..(502): a, c, t, g, unknown or other
  misc_feature (480)..(502): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgcttattttaaaagcctgagagccgatgacacggccgtgtattactgtgcgagagagtcggggcccacgtaacgttactacgctatggacgtcgtggggccaagggaccacggtcaccgtctcctcacgccctccaaccgaacgggcccaccggtccttcccccgtggcccgcccctgcctccgaggacnccacccgtcgaagcgaccacgacggccggcccgtggggcctcggccgttgggtacaacggtaccttaccgttccgtactcctcgtcgctggacggccgggtctgggaccgaagggccacgaagtagnnnnnnnnnnnnnnnnnnnnnnn

SEQ ID NO: 269527 - DNA, 794 bp, Homo sapiens
  misc_feature: GYAE6OF01BIPI1.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttatttaaaaggagtccagtgtgaggtgcgtctgggtgagtcgtgggaggaggcctgactccgaggccggtcggggggtccctggagactccgtccgtgtgcacgcctcgtcggtccaccggtcagtcaccacctacagtcggtaggttcgggtcccgccgtacgggtccgtaccggagggggaacggggcctagggtaacgggttcgggttcctttacccgttttaagttaccgaggtacctaagggttaggtaacgttaacctaattacgttacccgacgtaacgaccgtcccgggttacgggaacggggtcccgtaactttcccgaaccgtacttaccgtacccgaagggtacgaaaccctaaaccgttacgtaaaaacgaaccgtacgtccgttttacgtttacctaactaaagtcggaaactcgtaccgtaggaaaccggtacgacccgtaagaaccggtacccgtacgggtccgttaaggttattaaccgtgggtacgaacggaggtacggtaccggccgggtaaccccgtaaacgggttaaaccttacgttaacccgacgttttaagccggggtaccggttcggtaaccgggggaaacccaacgggggtcccctaaacccgggg

SEQ ID NO: 269528 - DNA, 895 bp, Homo sapiens
  misc_feature: GYAE6OF01CO3JB.11.25.C03.1.454.CMB.1.raw
  modified_base (171)..(171): a, c, t, g, unknown or other
  misc_feature (171)..(171): n is a, c, g, or t
  modified_base (271)..(271): a, c, t, g, unknown or other
  misc_feature (271)..(271): n is a, c, g, or t
  modified_base (302)..(302): a, c, t, g, unknown or other
  misc_feature (302)..(302): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagtttggctgagctgggttttcctgtgctatttaaaaggngtccagtgtgaggtgcgtctggtggagtcgtggaggaggcctgactccagccgtgggggtccctgacgactctcctgtgcagccttcgtgggtcaccgtnacgtccacacctacagtgtaggttcgggccncgaggcctaccggaggggacgggcgtgggacggttcggggtcctttaccgttttaagtttaccgagtaccgtagggttagggttaacgtaaccgtaagttacggttaccccgacgtaaaccggtacccgtaccgggttaggggaaccgggggtaaccctacgtttaccccgaaacccgttaccgtttacccacccgaaggtaaaccgtaaccctaaaaccgttaccgtaaaaaacccggtaaaccctaaaccggttcctttttaccggttttaaccctttaacgaaaaacgttaaccggtaaaaccgacccggtaccggttaggaaacgggtaaccgacccggtaacggtacccggtaaaccccggaacccggggtttacccgttacggtttaaacgtttaccccggttagggtcgtaacccgggaagggtaacgggtaccgggtaccgggggaaccccctaaaccggggttaaaacccgtttaaaccggtccggttaaccggttaacggttaacccggggtaccgggtttacccggggtaacccgggggaaacccggtaaacccgggggggtacccccttaaaccccggggg

SEQ ID NO: 269529 - DNA, 882 bp, Homo sapiens
  misc_feature: GYAE6OF01CIY8E.11.25.C03.1.454.CMB.1.raw
  modified_base (169)..(169): a, c, t, g, unknown or other
  misc_feature (169)..(169): n is a, c, g, or t
  modified_base (782)..(782): a, c, t, g, unknown or other
  misc_feature (782)..(782): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttctgtgctatttaaaggngtcagtgtgaggtgcgtcgtggtgggagtcgtgggaggacggtcctgtactccgaggtccggtcggggggtaccctggacgtacctcgtccgtgtcgacacgtccttcggtgggttccaccggtactacgtcaaccaccgtacagtaggtacggttcggccgccgacggtctaccgggaaggggtacgggcgtaggtacggtttcgggtcctttaccggtttaattacgaggtacgtaggttaggtaagtactagttacgtccgactaggtaccgtcggtacgggacgggtcctacttcccgaacctacgttaccgacgacggaaaccaccgtaaacctacgggtaaacgacgtacccgtttcgtttaacgtttacctaaacgtaaaccggtagtaaacccgaccggtttacgaacgggaaacccggtagggaacccgtaaggtacccggtaacccgggttaacccggggttccgttaacgggttttaacgttaaccccggttagggtaccggtaaccgggggaaaacgggtttacgggtaccccggggtaacccggggtaaccccggttaaaacccggtttaaaccgggtttacccgtaaaccccgggtttnttaaaaccggggttcccggggtaaaccccgggttttccgggggaaaacccgggggtaaccccccggtaaacgggggttaacccccggttaacccccgggg

SEQ ID NO: 269530 - DNA, 675 bp, Homo sapiens
  misc_feature: GYAE6OF01BJH1V.11.25.C03.1.454.CMB.1.raw
  modified_base (359)..(359): a, c, t, g, unknown or other
  misc_feature (359)..(359): n is a, c, g, or t
  modified_base (389)..(389): a, c, t, g, unknown or other
  misc_feature (389)..(389): n is a, c, g, or t
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtcgtccgtgtccccaggacagacagccagaactcccctgctctaggaattgaattgagagataatatacttgttagtatcaacagaacgccaggccacgtcccctgtattggtctatactatacaagtatgtaggaacgtccggtaccctacgagggtactcccgagtacgcgtacttcncgtcggcctaccgtaacgtcgtacgggacncgacgtccactcgtacgacctagtaccgacggacccgggaccaggtcgtagtcggtagtaggacgtcgtacgttaacgttagtttagttcggtaccgtaagggtccggttacgggaccgaacgtacgacggtacctaccggtaccgttccggttacttacggttcccggttaacgggaccgggtaaccgggtaaccgttaaccggggtacccttaccgggttaccgttacggtaaccggtacccggaacccgtaccccggaaacccggaccccgtaaaacccccgg

SEQ ID NO: 269531 - DNA, 782 bp, Homo sapiens
  misc_feature: GYAE6OF01ANOL6.11.25.C03.1.454.CMB.1.raw
tcagcgagagataccacgaccggtgctcgatttagtagtgtagatttgggtttggggggagaggaacccagcactgggattccgaggtgtttccattcggtgatcagcactgaacacagaggactcaccatggagttttggctgagctgggttttccttgttgctattttaaaggagtccagtgtgaggtgcgtcgtggtggagtcgtgggaggaggcctgactccgaggccgtggggggtccctggagacctctccgtgtgcacgcctcgtggttcaccgtcagtcacacctacatgagttcgggtcccgcgaggcctccggaagggggaacgggcgtgggaggtcgggttccttaccttttagtttacaggtcgtaggtgggttaacgtactattacgtccgacgtaacgtaccgttccggtagggaccgggggtccgtaacgtttacccaaccctaacgttcccgtaccgaacggtaacgaaaccctaaaccgtaccgttaaaacggaacccgtaccggttacttttacggttttaccttaaaccgaaaacgttacgaaaccgtacgtcccgttaggaacggtacggaccgtaagtacggaaccggtaaccgggtccgttagtttaacgttaaccgtgggttacggacggaagggtagtaccggggtaccggggaaccccttaagggtaaacccgtttaccggaacggttcgtaaggttccgggaacggttccggggtacggggaaccggaaaccggggtaccccgtgggttacccccg

SEQ ID NO: 269532 - DNA, 862 bp, Homo sapiens
  misc_feature: GYAE6OF01AUSHG.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggtagtttggctgagtcgttgggttttccttgttgtcttaattttaaaaggagtccagtgtgaggtgcgtcgtggtggagtcgtggaggaggcctgactccagccggtgggggtccctgacgtactctccgtgtgcacgtcctcgtcggttcaccgtcacgtccaccacctacagtcgtaggttcgggccgccgaggccgtaccggaagggggtaacggggtcgtaggggtacggttcgggttacctttaccgttttaagtttacgacggtacgtaggttaggttaacgtactaacttacgttcccgacgtacggtacccgtccgggtagggtacggggtacccgtacttacccgaaccgtactcccgttaccgaacggaaccgtaacctaaaccgttaaccgtaaaccggaaccgtaccgttaccgttttacgtttaacctaaacgaaacgtacgtaaccgtacgtaccgtaaggacggaccggtacccgtagtccggaacccgtaccgggtacccgtttaggttaaacttaacgtacggtcgtaaccggaaggtaacgggttacgggtaaccccgggggtaaaccctaaaacccggggttaaaccgtttaacccggttacccggttaacggtttaaaccgggtacccgggggttaacccgggttacccgggggtaaacccggggggtaaacccccggtaaaaccgggggcccccggttaaaccccgggg

SEQ ID NO: 269533 - DNA, 827 bp, Homo sapiens
  misc_feature: GYAE6OF01CW48R.11.25.C03.1.454.CMB.1.raw
  modified_base (180)..(180): a, c, t, g, unknown or other
  misc_feature (180)..(180): n is a, c, g, or t
  modified_base (278)..(278): a, c, t, g, unknown or other
  misc_feature (278)..(278): n is a, c, g, or t
  modified_base (643)..(643): a, c, t, g, unknown or other
  misc_feature (643)..(643): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggtagttttggctgagcgttgggttttcctgttggcttaattttaaaaggngtccagtgtgaggtgcgtctggtggagtctgggaggacggcctggactccgaggcccggtcggggggtcccctggagtaccttcctccgtgtcgaccncgtccgttcgttcgggttaccacccgttcgacgtaccaaccctaacccttaactacggttggtacgggtttccggggccccgaccggtaacgggcccgtaccgggtaagggggaaacggggtccgttaggggtacgggttcggttcctttaccgttttaacgttaacgagtccgtaaggttagggtaacttaacgtacgtttaccgttcccgacggtaacgtacccggttccggtacgggaccggggtacccctaccgtttaccaacccgtaacgttcccgtaaccgaaggtaaaccaacctaaccgtaactaaaacgaccctacggttcctttaacgttttactaacctaaacgtacgaaaccncgtaccgtaaggtacgaccgtacccgaataccggaaccgtaccggtacgttagttaccgttgtaggtcgtaaccgggaagtcgaaccgggttccggggaaaccctaaaccggtactttacggacctacggttaacgacgggtcgttaccgggaccgggaccgtaaaccgggcccgtaaccccgg

SEQ ID NO: 269534 - DNA, 606 bp, Homo sapiens
  misc_feature: GYAE6OF01DJ5ZG.11.25.C03.1.454.CMB.1.raw
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggtttttccttgttgcttaattttaaaaaggagtccagtgtgaggtgcgtctggtggagtctggaggaggcctgatccagccgtggggggtccctgagactctcctgtgcagcctcgtggttcaccgtcagtcacacctacatgagttggtccnccgaggctccgaggggagggctggagtggtctcctttattacagcagtggtagtacntacttccgnagactccgtgacgggccattcaccatctaccagagaacaactactaaagaaccacgtcttagtttactacaaatgaaaccagcccttaggaagacgccgtaatcggaaccaaccgggtcccgttagttaactttacgtggtgaccggaaggagacggtcggggaccccaaacggtaaacgttacctacgactagtacgggtacgtacgtgggggaccaaacggggccctaaccggg

SEQ ID NO: 269535 - DNA, 770 bp, Homo sapiens
  misc_feature: GYAE6OF01BG31P.11.25.C03.1.454.CMB.1.raw
tcagcgagagataccacgaccggtgctcgatttagtagtgtagatttgggtttgggggggagaggagcccagcactgggattccgaggtgtttccattcggtgatcagcactgaacacagaggactcaccatggtagttttggctgagcgttgggtttttccttgttgcttattttaaaaggagtccagtgtggaggtgcgtcgtggtggagtcgtgggagggaggcctgactccgagcccggtcggggggtccctggacgtacctcctccgtggtcgcacgtcctcgttgggtccaccgtcacgtccgaccacctacagtggtacggttcggggtcccgccgacggccgtaccggaagggggaagggggtccgtaggggtcggttcggggttcctttaccgttttaatttaacgagtccggtagttgggttaactaacgtacttacgttcccgagtaacggtaccgtccgggtggggaaccggggtccgtaacgtttccaacccgtcttaccacccgtaagaacgaaccgtaacctaccgtaaacggaacctaccgtactttacgtttacctaactaagtacgtaaacgccgtacgtaacggagacgtaccggactacggaccggtccggtcgttaacgttagttaacgtggtagacggaggtaggacggtaccggggaaccctaaccggttacttaaccggtccgttacgtagggtacccggtcggttacgggaccgggtttaacggaaccgggtacccgtacccggg

SEQ ID NO: 269536 - DNA, 881 bp, Homo sapiens
  misc_feature: GYAE6OF01C70KS.11.25.C03.1.454.CMB.1.raw
tcagcgagagataccacgaccggtgctcgatttagtagtgtagatttggggtttggggggagaggagcccagcactgggattccgaggtgtttccatttcggtgatcagcactgaacacagaggactcaccagtggtagtttgctgagtcgttgggttttccttgttgtactttaaagttttaaaaggcgtaccgtagttggtggaggtgtcgttcggtggtcgggtagttcggtgggaggacggtcctagactccgacggtccgggtcggggggtccctaggacgtacctcctcgtcgtgaccgtccgtccgttccggtcggttaccgacccgtacgacgtaccaacctaaccttacgtacgtggtacggttccgggtcccgccggacggtccggtaaccgggaggggaacgggtcggtgggtacggttcggttaccttttaccgtttaacgtacgacggtacgtaaggttacggttaactagttaacgttacgttccgacgtacggttaccgtacggtcggggtaccggacttaccgtaccgacctcgtaccgacgtaacgaacgtacctaaacttaacgaacgtaaccgttacggttacttttacgttaactaaacgtaactacgtaacgtacgtaccggtagtaacggaaccggtaccgtaacgtaaccggtacccggttaaccgggttacgtttacgttaacgttacggtttacggacgggttaaggaccggtaccggggtacccgggtaaacccgggtacccgtaaaaccggtttacccgttaacggttacccggtaacggtttaccggaccgggttacgggtacccgggttaacccggggaacccggtaaccgggggtaaaccccgttcccggg

SEQ ID NO: 269537 - DNA, 822 bp, Homo sapiens
  misc_feature: GYAE6OF01CDX3V.11.25.C03.1.454.CMB.1.raw
  modified_base (434)..(434): a, c, t, g, unknown or other
  misc_feature (434)..(434): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttaattttaaaaggagtccagtgtgaggtgcgtctggtggagtcgtggaggaggcctgactccgagccgtgggggtccctgacgactcctccgtgtgcacgcctcgttcgggttccaccgtcacgtccaaccaccctacagtggtacggttgggcccgccgagggcctaccggaagggggaaggggtcctaggggtcggttcggggttcctttaccgtttttattaccgtacgtacgtaggttaggtaacgtaactaattaccgttacccgngtaaccgtaccgttcccggtagggtaccggggtccgtaagttacccgaaccctacttaccgtacccgaagaaccgaaacctaaacccgtaacgtaaaacggaaccctaaccggttactttacgttttacccttaaacgaaacttaacggaaaccctacggtacccgtaggaaacggaccggtaccgtaacggtacgggtaacccgaccccggggttaccggtttagtttaaccggtttacgttcgggtacggaaccggttaaccgggaagggttaccggtacccgggggacccccgtaaaacggtttaacccgttaaccggtacgtaccgttaaggtccgggtaaccggtcgggtacggggaacccgaacggggtaccccgtacccgg

SEQ ID NO: 269538 - DNA, 832 bp, Homo sapiens
  misc_feature: GYAE6OF01DOMQV.11.25.C03.1.454.CMB.1.raw
tcagcgagagataccacgaccggtgctcgatttagtagtgtagatttgggtttggggggagaggagcccagcactgggattccgagatgtttccattcggtgatcagcactgaacacagaggactcaccatggagttttggctgagctgggttttccttgttgctattttaaaggagtccagtgtgaggtgcgtctgggtggagtcgtggaggacggcctgactccgagtccgtggggggtccctggacgacctcgtcctggtgcacgtccttcgtcggggttaccaccggttcacggtccaacctaccctaacgattcggtacggtttcggggtcccgaccgtacgggcctaccgggaacgggggaaaggggccgtaggggacggttcggggttacctttacccgtttttaacgtttaaccgcggtaccgtaaggttacgggttaacgttaaccgttaactttaccgtttaccccgggacgttaacgggaacccggtttcccgggtaagggggtaacccggggggtaccctttaacgttacccggtaaccctaacgtttacccgttaacggaaacggtaaccggtaaaccctaaaccggttaccgttaaaaacgggaaaccctacggttaccgttttacggttttaccttaacgtaaaacgttacgaaaccgtcgtaccgtaggacgtagcccgtaagtcggaaccggtaccggtacgttagttacttacggtgtacggacggaggacgtacgggaccgggaccctaaagggtaccttaccgaccgtgttacggtgggtacccgtggacggggacccgaagggtaaccccg

SEQ ID NO: 269539 - DNA, 552 bp, Homo sapiens
  misc_feature: GYAE6OF01CO4FQ.11.25.C03.1.454.CMB.1.raw
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
  modified_base (513)..(513): a, c, t, g, unknown or other
  misc_feature (513)..(513): n is a, c, g, or t
  modified_base (537)..(552): a, c, t, g, unknown or other
  misc_feature (537)..(552): n is a, c, g, or t
tcagcgagagataccacgaccggtgctcgatttagtagtgtagatttgggtttgggggggaagaggaagactgacggtccgccaggctccagggaaggggctggagtgggtctcctttatttacagcagtggtagtacatattccgcagactccgtgagggccgattcaccatctccagagacaactctaaagaacacgcttgtttcttacaaaatgaaacagcctgagacgccgatgaacacggccgttagtattactgtgcgagagagtcggggcccaagtaacgttactacgctaagtgggacgtcgtcggggaccaagggaccacggtccaccgtctccctcacgccctccaaccgaacggcccagtccggtccctccccgnggcccnccctgcctccgaggacncctacccgacgagacaccgagccggcccggcccgtcgggcctcggcttccggtacaacggtaccttacgttccgtacttcctcgtccgcgtagcgggccgggtntcgggaccgaggccgatagacggnnnnnnnnnnnnnnnn

SEQ ID NO: 269540 - DNA, 792 bp, Homo sapiens
  misc_feature: GYAE6OF01EO6AP.11.25.C03.1.454.CMB.1.raw
  modified_base (335)..(335): a, c, t, g, unknown or other
  misc_feature (335)..(335): n is a, c, g, or t
  modified_base (661)..(661): a, c, t, g, unknown or other
  misc_feature (661)..(661): n is a, c, g, or t
tcagcgagagataccacgaccggtgctcgatttagtagtgtagatttggggtttgggggggagaggagcccagcactgggattccgaggtgtttccattcggtgatcagcactgaacacagaggactcaccatggtagttttggctgagcttgggtttttccttgttgcttaattttaaaaaggagtccagtgtggaggtgcgtctgggtggagtcgtgggagggaggcctgactccgacggtcccggtcggggggtcccctggacgtaccttccttcctggtcgcacgtccttcggttcgggttcctacccgtctacgtccaacctaccttacngtggtaggtttcgggtcccgcgtaccggccgtaccggaagggggacggggtcgtgggtacgggttacggttccttttacctttttattaccgaggtacgtaggttggttaacgttaactagtttacctccgactacgtaccgttcggtacgggacggggtcctaacttcccaaccgtacttccaaccgaagaacgtaaaccctaacctacgtaaaacgtaacccgtcggttccttttacgttttacaaactaaagtcgaaacgccgtctaggaactaccgggcgtaacgcggaacccgtaccggttcgttaagtttaccttaccgnggtaccggaaggcggttaaacggccggtacccggggtaaacccgtaacgttaaacggttaccgtacggtactaagggttcgggtaccgtttccggggaagggaaccccggaaaggtccccgtaaacccggg

SEQ ID NO: 269541 - DNA, 841 bp, Homo sapiens
  misc_feature: GYAE6OF01C4TOC.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagtcgtgggttttccttgttgctattttaaaaggagtccagtgtgaggtgcgtcgtggtggagtctggaggaggcctgactccaggccgtggggggtccctgacgacctcttccgtgtcgcacgtccgttcgtcgggttaccaccggtcacgtaccaaccaccctatagttggtacggtttcggggtcccgaccgtacgggtaccgtaccggaaggggggtaaacgggggtccgtaggggtacgggttcggggttacccttttaccgtttttaaagttttaccgaggtaccgttaagggttacgggttaacgtaacctaacgtttacgtttacccggactaacggtaccgttcccgggttagggtacgggggttacctacgtttcccgaaccttacgttcccgtacccgaaaggtaacctaacctaaaccgttaaccgtaaacgtaaaccgtacggttacctttagttttaacctaacctaaaagtacggaaaccacgtcccgtaaggacgtacgcccgtaagtacgaaccggtacgggtccgttagttaacgtttacgaggtacgacggaagtaacgggtacggttaccgggggaacccctaaacgggtaaccgttaccgtaacggtcgttaacggtaccggggtaaccgtaccggggttaacggggaccccggtaaaggggcccggtaacccggg

SEQ ID NO: 269542 - DNA, 483 bp, Homo sapiens
  misc_feature: GYAE6OF01CB7PO.11.25.C03.1.454.CMB.1.raw
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (378)..(378): a, c, t, g, unknown or other
  misc_feature (378)..(378): n is a, c, g, or t
  modified_base (424)..(424): a, c, t, g, unknown or other
  misc_feature (424)..(424): n is a, c, g, or t
  modified_base (462)..(462): a, c, t, g, unknown or other
  misc_feature (462)..(462): n is a, c, g, or t
  modified_base (465)..(483): a, c, t, g, unknown or other
  misc_feature (465)..(483): n is a, c, g, or t
tcagcgagagataccacgaccggtgctcgatttagtagtgtagatttggggtttggggggagaggagcccagcactgggattccgaggtgtttccattcggtgatcagcactgaacacagaggactcaccatggagttttggctgagtcgttgggttttccttgttgacttaattttaaaagcctgagagccgatgacacggccgtgtatactgtgcgagagagtcgggcccaacgtaacgttactacgctagtggacgtcggtacggggaccgaacggggaccaccgggtccacccggtctcctcacgcctaccaccgaacgggcccagtccgtcccttccccgnggccncctgcctcgagacgcctaccgcgagcncacgtacgccgcgtaggctgcgtagacaagtcctacttcgattccncgtcgcgtaggacgggcgcgtggacgaagggcacgtanagnnnnnnnnnnnnnnnnnnn

SEQ ID NO: 269543 - DNA, 669 bp, Homo sapiens
  misc_feature: GYAE6OF01BEKR3.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggtcaccgtcagtcacacctacatgagttgggtccgccaggcctccgaggggaaggggctgggaggtgggtccttcctttatttacagcaggtggtatacattatccgcagacctccggtggacggggcctattccacctatcctaccgaagacgaccaacttactaaacgaacctacggtcctttcgtttaccttaacaaagttcgaaaccgacgcccgtaggacgacggccgatacggaacccgtaccgggtcccgttagttaacttaccgttgggtacgacggagggacggtacggtcccgggggacccctaaccgggtaaaccgtttaccgtaccgtacgttaggtaccgggtacggttccgggtacgggggacccgtaaacgggggtaccccgtacccgggg

SEQ ID NO: 269544 - DNA, 569 bp, Homo sapiens
  misc_feature: GYAE6OF01BHJ7E.11.25.C03.1.454.CMB.1.raw
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (538)..(569): a, c, t, g, unknown or other
  misc_feature (538)..(569): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggtagttttggctgagcttgggtttttccttgttgctattttaaaagcctgagagccgatgacacggccgtgtattactgtgcgagagagtcggggacccaacgtaacgttactacgctagtgggacgtcgtcgggggccaaggggcccacggtcaccgtctcctcacgccctccaaccgacggcccagttccggtccttccccccgnggcccncccgtcgcctccgaggacnccaccgtccgaggacncacgacgccggcccgtggggctacggtcccgtagggtaccgtaacgggaccctttaccgtttacccggttattcccgtaccgttcggtcccgtgggacgggtcccggggtaccgtcggggaaccgaacggggccgtacgacttaacggcancgngcnnnnnnnnnnnnnnnnnnnnnnnnnnnnnnnn

SEQ ID NO: 269545 - DNA, 607 bp, Homo sapiens
  misc_feature: GYAE6OF01EGSO7.11.25.C03.1.454.CMB.1.raw
  modified_base (583)..(607): a, c, t, g, unknown or other
  misc_feature (583)..(607): n is a, c, g, or t
tcagcgagagataccacgaccggtgctcgatttagtagtgtagatttggggtttggggggggaagaggaagactgacggtccgccaggctccagggaaggggctggagtgggtctcctttatttacagcagtggtagtacatattccgcagactccgtgaggggccgattcaccatctccagagacaactctaaagaacacgctgtttcttacaaatgaacagcctgagagccgatgacacggccgtgtattactgtgcgagagagtcggggacccaacgtaacgttacgtacgactagtggacgtcggtacgggaccgaaacgggaccgtaccggtcctacccgttcctccgtacaccgtccctacccgaacccggaaccgggacccctacgtccggttccccttcccccgtcggcccgtcccgtcgacctaccgacggacgacccgaccgtacccggaagaccgacacgacggcccgggtccgtcgggcgtcgtccgtacggtaacgaaacgtaccgttaccgttaccctactccgtcgtccgtcgtcggacggcgggtcgacggacggacgcgcagagcnnnnnnnnnnnnnnnnnnnnnnnnn

SEQ ID NO: 269546 - DNA, 748 bp, Homo sapiens
  misc_feature: GYAE6OF01BJZ2Z.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagacctctcctgtgcagcctctcgggttcacccgtcacgtccaccacctacatgtaggttcgggtcccgccaggcctaccggaagggggaacggggtcgtgggaggtcgggttcttccttttattacagctaggttggtagtacagttacgttccgacgtaacggtaccttcccgggtagggtacgggggcccgtaagtttcccacctactcccgtacccgaaggaacgtaaccctaaaccttaccgtaaaacgtaaacccgaccgttaccgtttacggttttaccttaacgaaagttacgaaacctacggtacccttagggacgacggtaccgtagtaccggaaccgtcgggtaccgttaggttactttacgtgggttacgacggaaggtacggacgggtacccggggacccctaaacggttaaaccgtttaccggaccgtacgttaggtaccggggtacgttacccggggtacggggaacccgaaccggggtaacccgtacccggg

SEQ ID NO: 269547 - DNA, 877 bp, Homo sapiens
  misc_feature: GYAE6OF01E32RT.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgacgacctccctcgtgtcgacgaccgtccttcgggttccggtacccgtaccgtacgtaccgtaccaaccctacctactagtaggttcgggttccggtccccgacggtaccggtcccgtacggggaaggggtacggtcggtagggtcgggttccggttcccttttacgttttaacgttacgacgtacgttagggttacgtaacgtaacgttaacgttaccggttccgaacgtacgtacccggtacgggtacgggggaccgggtaccgttacctacccgtaaccgttaccgtccctaacgaaggtaaacccgaaacccttaaaccgttaaaccggaaaacgaaccccgtcggttttaccgttttacgttttaacccaaaaagtaacgtaccgaaacgtccgtacgaggtaaccgccgtaccgaagtaacccggaccgggtacccggttagttaacgtttaacctcggtacgggtaccggaaaggacgggtaaggtacccggggggtacccccgaaacccggttaaaaccggtttaacccgttaaacccggcggttaaaccgtacggggttaccggtacccggggttaccgggggaaaccccgggaaaccgggtaaaccccggggaaccggttaccccgg

SEQ ID NO: 269548 - DNA, 866 bp, Homo sapiens
  misc_feature: GYAE6OF01CUWWK.11.25.C03.1.454.CMB.1.raw
  modified_base (242)..(242): a, c, t, g, unknown or other
  misc_feature (242)..(242): n is a, c, g, or t
tcagcgagagataccacgaccggtgctcgatttagtagtgtagatttgggttggggggagaggagcccagcactgggattccgaggtgtttccattcggtgatcagcactgaacacagaggactcaccatggagttttggctgagtcgttgggttttccttgttgacttaagttttaaaaggacgtcctaggtgtgaggtgcgtcgtgggtggtagtcgtgggaggaggtcctgacgtccgnggccggtcggggggtcccctgaacgccgtcctccgtaggtcgcgtacgtccgttcggttggttaccgacccggtctacgtacctaacctaacctaccgtaagtcggtcggttccggggtcccgcgtaacggccgtaccgggaaggggaacgggtcgtagggtacggttacgggttccttttacgttttaacgttacgacggtacgtaggttacggttaagtactaacgttaccgtcccggacgtaacgttacccggtccggtaggggaccggttacccgttacttacccgaaaccgtcgtaccctaccgaagtaacgtaaccctaaacgttaacccgtaaaacgtaaccgtacgttccgtttaacgttttaacccgtaaagaaacgtttaaccgaaggtacccgacccgttagggaagttacccggaacgtaaccggttacgaaccgggttacccggtcgttaacggtttaactgggtcgtaacggacgggtaacgtagggtaacccgggtccccggaaaacccgttaacgggttaaccgtttaccgtaaccggttcgttaacgggccgggttaccgggtacggtaacgggggacccgtaaaccgggacccggttaaccccggg

SEQ ID NO: 269549 - DNA, 648 bp, Homo sapiens
  misc_feature: GYAE6OF01A6GXD.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtgggttttccttgttgcttattttaaaaggagtccagtgtgaggtgcgtctggtggagtcgtgggaggaggcctgatccagccgtgggggtccctgagactctcctgtgcagcctcgtggtcaccgtcagtcacacctacatggtagttcgggtccgccgacggcctaccggaggggaacggggctgggtacggttcggttcctttccttttaatttacgaggtcgtaggttggtaacgtactaattacgttccgactacgtaccgtccggtagggacggggtcccgtattaccacctatcctaccagacgaacaactctaaagacctacgtcttgtttactaacaagtcgaacacgccgtagacgacgccgagtcgaacgccggtcgttagttacttacgtgtacgacgagagacggtccggggacccctaaacggtaccgttacgaccggtattaggcgggtacgtcgggtacggggacccaaaggggcccgtaacccgg

SEQ ID NO: 269550 - DNA, 862 bp, Homo sapiens
  misc_feature: GYAE6OF01CTZHG.11.25.C03.1.454.CMB.1.raw
  modified_base (179)..(179): a, c, t, g, unknown or other
  misc_feature (179)..(179): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggttttccttgttgctattttaaaaggntccagtgtgaggtgcgtctggtggagtcgtgggaggacggcctgactccacggcccggtggggggtcccctggacgtaccttcctcccgttggtcgccgacggcccgttccgtcgggtttacccaacccggttacacgtccaacccacctaacctagtcggtaggttcgggccccgccgacgggtccgtaccggaagggggacggggtccgtgggtaggtcgggttccttttccttttaagtttacgagtcgtaggttcggtaagtacctagttaccgttccgacgtaacggtaccgtcccgggtaggaccggggtacccctatttaccccgaacccttacggttccctaaccggaacggaaccgtaaccgtaaacccttaaccgtaaacgaaccgtaccggtttcttacgttttacctaacgtaaatacgtaaacgacgtcccggtaaggaaccggaacgtaccgaagttccggaacccgttaaccgggtacccggtttaggtttacttaaccgggtcggtacggaaacgggaggtaacgggacccgggttaccggggacccctaaaacccggttaaccggtttaacccggtaaccggttaaccggttagttacccggggtaccggtttacggggtaccccggggaaacccgggttaaaccgggtaccccggtaaccccggg

SEQ ID NO: 269551 - DNA, 703 bp, Homo sapiens
  misc_feature: GYAE6OF01D3WQ4.11.25.C03.1.454.CMB.1.raw
  modified_base (302)..(302): a, c, t, g, unknown or other
  misc_feature (302)..(302): n is a, c, g, or t
  modified_base (475)..(475): a, c, t, g, unknown or other
  misc_feature (475)..(475): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgactccagccgtgggggtccctgacgactctcctgtgcacgcctcgtgggttcaccgtcacgtcacacctacatgagttcggtccncgaggctccggaggggacgggtctggagtcggtcttctttattacagctaggtggtatacatacgtccgacacgtctccggtaggacggggtcctacttccaactatcctacaagacgaaccaacgtactaaagaaccgtacgtcttagtttacttaacaaagttcgaaaccncgtccctagggaacgacggaccgtaagtacggaaccgtaccgggtaccgttagttaacttacgtggttacggacggtaaggtacggtacggtacccgggggtaacccctaaaccggggttaaccgtttaaccgtacccggtaacgttacggttaaccgggggtaacccggtttaccgggggtaaccgggggaaccccggtaaaaccgggggtccccgtaaacccgggg

SEQ ID NO: 269552 - DNA, 774 bp, Homo sapiens
  misc_feature: GYAE6OF01BMF29.11.25.C03.1.454.CMB.1.raw
  modified_base (176)..(176): a, c, t, g, unknown or other
  misc_feature (176)..(176): n is a, c, g, or t
  modified_base (261)..(261): a, c, t, g, unknown or other
  misc_feature (261)..(261): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggngtcagtgtgaggtgcgtctggtggagtcgtggaggacggcctgatccaggccgtgggggtccctgacgtacctctccgtgtcgcncgtccgtcgtgggttaccaccgtacagtaccacctaacctacagtggacggttcgggtcccgaccgacggtccgtaccggaagggggtaaggggccgtgggtaggttcgggttcctttaccgttttaattacgagtcgtaaggttggtaatactattacgtccgacgtacgtacgtcccgtagggacgggacccgtattccgaaccacttccgacgaagaacaaccctaaacgttccaaacgaacctacggtctttacgtttaaccttaagtaaacttacgaaacctacggtccgtaagggaactaccggaaccgtaacgtacggaacccgtaaccgggtaccggtttagtttaaccctttccggtggtaccggaggaaacggtacggtaaccggggtacccggggtaacccctaaagggttaaaccccgttaacgttacccggtacgtaacggtccgggtaaccggttccgggtaccggggaacccgtaaacgggggtcccctaacccgggg

SEQ ID NO: 269553 - DNA, 941 bp, Homo sapiens
  misc_feature: GYAE6OF01DCNP3.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccagtggtagttttggctgagtcgtttgggtttttccttggttgtactttaaagttttaaaaaagggcgttaccgtaggttggtggtaggtggtccggttcgttggggtggtagttcgtgggaggacggtcctggactccgacggtcccggtcggggggtccctggtacgtccttccgtccgtaggtcgcgacgtccgttcggttcggttaccaccgttacgacgttaccaacctaacctacgtagtcggtacggttcgggtcccacgacggtccgtaccggagggggtaacgggtcgtcggggtacggtttccgggtttaccttttaccgttttaacgttaacgacggtaccgttaagggtttacggtaattaccgttaacgttaccgttacccggacgttacggtacccgggttacgggacggggtaaccgggtaccttaactttacccgaaaccttccgttacccgtaacgtaaacgggaacctaaccctaaaacgttaaccgtaaaacggtaacccgtacccgttttcgttttaacttttaaccgaaaagaaaccgttgggaaaacctcggtaaccggttaggaacccgacggaccttaggaaccgtaacccgggtaaccggtttcgtttaaagtagtttacgacggggttacgaaccggtaaagggtacgggttacccccgggggcccgttaaaaaacccccggttggttaaaaacccgttttaccggtgggaaaccgtttcgggtaaacccggggttcgttaacggggggaccccggtaaaaccggttaacccggggtacccgttccccg

SEQ ID NO: 269554 - DNA, 977 bp, Homo sapiens
  misc_feature: GYAE6OF01B0WXR.11.25.C03.1.454.CMB.1.raw
  modified_base (835)..(835): a, c, t, g, unknown or other
  misc_feature (835)..(835): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggtagttttggctgagtcgttgggttttccttgttgactttaagttttaaaaaggcgtccgtagtgtggtaggtgtcgtcgttgggtggtacgtcggtagggacggacggtcctcggaacctcccgacggcccgggtttacggggggtcccctaggaacgtacccgttccgttaccgttacggtcgacgtacgtcccgttcggtaccgggtttaccaccgtacgtaacgttaccaaccctaacccgttacgtaagttaggttacggtttaccgggaccccgtaccggacgggtaccccggtaaccggggtaagggggtaaaccgggggtcgttacgggggtaacgggtttccggggtttaccttttaaccccgtttttaagtttaacgaccggttacggtaaagggtttaacggttaacggttaacctaacggtttaccgttcccggaaccgtaaacggtcccggtttaccgggttacggggaaccggggtacccttaaacgttacccctaaccgtaccgtttacccgaccggaacgaacggtaaacccaaaccgtttaaaccggtaaaccgaaaccgttaccggtttactttaccggttttaaaccctaaagaaacgttaccggaaacgtccggtacctaagggaacgtaacggccgtaagtccgggaacccgttccgggtactttaagttacggtttaacgngggtaccgaacggaggtacggtaccgggaaaccgggttaccccaaagggtttaaaccctaaacggtccgtacggtaacggtaacgggtccgggaacccggtttaggggaaaccccgttaaggggcccccgtttaaaccgggg

SEQ ID NO: 269555 - DNA, 860 bp, Homo sapiens
  misc_feature: GYAE6OF01E01NM.11.25.C03.1.454.CMB.1.raw
  modified_base (181)..(181): a, c, t, g, unknown or other
  misc_feature (181)..(181): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagtcgttgggttttccttgttgtcttaagtttaaaaggntccagtgtgaggtgcgtcgtgggtggagtcgtgggaggaggcctgactccgacggtcccgggttcgggggtccctaggacgtacctccttccgtgtcgccacgtcctcggttcgggttaccaccgtacacgtaccacctacctacgtattcggtacggttccggtccgaccgtacgggccgtaccggaagggggacgggtcgtggggtacggtgggtcggtacttagtttacgttcgtagttacgtaggtaagtaaggtaaacgttggtacgtactttacgtaacgtttacgaacggtaaccgttcggttaaaggtaacccggggtacccgttatttaccccggtaacccgttccgtaaccgtaaggtaacctaacccgttaacgttacccgacggtaccctaccggtaaccgtttaccgtacgttacttccgtaacggaaccttaagtacgaacctaccggtaccgtaaggaacggtacgtccggtaaagggtacccggaacgttacccgggtagtttaccggttaacggtttaaacgttccggttaaaggtaccggtttaaaaccgttaaagttttaccggttttaaacggttaacgggttaagggttaacccggggtttacggtaaccgggggttacgggggtttaccttttaccggggtacggttaacccggggg

SEQ ID NO: 269556 - DNA, 732 bp, Homo sapiens
  misc_feature: GYAE6OF01AK74U.11.25.C03.1.454.CMB.1.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtgggaggaggcctgatccaggccgtgggggtccctgacgactctcctgtcgcacgtcctcgtgggttccaccgtcacgtccaccacctacagtgtagttcgggtccgccgaggcctaccggaggggaacggggctgggagtcgggtcttaccttttattacagcgtaggtggtagtacattacgttccgcacgacgtccggtaggacggggaccctagttccacctactccgtaccgagaacgacctaaaccgttactaaacgaacccgtacggtcctttacggttttaccttaacaaacgttacgaaacccaggtaccctaggaacggacggacccggtaagtacggtaacccggaccgggtaccgtttagttaacgttacgtcggtaggaccggaaggacggtaccggtaccggggacccccgtaaacggtaacccgttaccgtaaccggtccgttaaacggtcgggtaacccggttacgggtaccggggacccgtaaacccggggcccgttaaccccggg

SEQ ID NO: 269557 - DNA, 697 bp, Homo sapiens
  misc_feature: GYAE6OF01DDT8E.11.25.C03.1.454.CMB.1.raw
  modified_base (144)..(144): a, c, t, g, unknown or other
  misc_feature (144)..(144): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctganctgggttttccttgttgctattttaaaaggagtccagtgtgaggtgcgtctgggtggagtctggaggaggcctgatccagccgtggggggtccctgagactctcctgtcgcagcctcgtgggttccaccgtcagtcaccacctacatgaggttcgggtccgccaggctccggaggggaggggctgggagtgggtcttcctttattacagcgaggtggtagtactatacgttccgacacgtaccgtccggtagggacggggtacccgtactttaccaaccctacttcctaccgaggtaaacgaaccctaaacgttaaccgttaaaacggaacctaccgttcgtttacgttttacctaacgtaaaacgtcgaaactcggtacccgtaggaacggacgaccgtagtccgaaccgaccgggtccgttagttactttacgtggtagcggtaagacggacggtccggggaccctaacggtaaccgtttaccgtacggacgttacggcgggttaccggtacgggtaccggggaacccggaacggggcccgtaacccgggg

SEQ ID NO: 269558 - DNA, 786 bp, Homo sapiens
  misc_feature: GYAE6OF01CB3EW.11.25.C03.1.454.CMB.1.raw
tcagcgagagataccacgaccggtgctcgatttagtagtgtagatttgggtttgggggagaggagcccagcactgggattccgaggtgtttccattcggtgatcagcactgaacacagaggactcaccatgggttagtttgctgagtcgtttcggttttcttgttgtactttaaagtttaaaaggctacgtagtggtggtaggtcgtcgtcgtggtggagtcgtagggaggcgtcgtagactccgacgtccgggttccggggtcctagacgtctccgtccgtgtcgacgtccgtccgttcggttcggttacctaccgtacgtaccgtacctaacctaaccgttaacgtagttacgggtacgggtttccgggccccgaccggacggtccgtaaccggggaagggggtaacgggtcggtagggtcggttcggtttcccttttacgttttaacttacgcgtacgtagggttaacggtaactaactacgttacgttcccgacgtacgtaccgtccggtagggaccgggtactaaccttaccgacctactttcccaacgaagaccgtaaccttaacctaacgaaacgaaccgtacgttcgttttacttaacctaaagaagttaaccaccgacgtacgaggaacgcgaccgtaagtccgaaccggtccggtcgttagtaccttgcggtagaacggaggtaaggccggacgtaacccgtaacgtaaccgttacgaccgtagttaacgggtgtacccgggtcggacgggaaccgtaaaccggtccggtaacccg

SEQ ID NO: 269559 - DNA, 829 bp, Homo sapiens
  misc_feature: GYAE6OF01AW46O.11.25.C03.1.454.CMB.1.raw
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggtagttttggctgagtcgttgggtttttccttgttgtacttaattttaaaaggagtccagtgtggaggtgcgttcgtgggtggagtcgtagggaggtacggcctgactccgagccggtcgggggtcctgagctcctcctggtncncgtcctcgtcggtaccncgtcgcgaccactacctangtggtacggttccggtccgaccgcggtaccgtacgggaagggggtacggggccgtggggtacggtttcgggttacccttttacgtttttaacgttacggacgttacgtaagggtttacggtaacgttaacgtaattacccggttaccgacgtaaccggtcccgttaccggggtaggggaacccggggtcctaacgttacccacctacgttaccgccaaaggacctaactaacgtacgaaacgtaaacctcggttacctttcggtttaactaacgtaaacgttacgaaccgtacgtaccgttacggaacggtaccaaccgtcgtaaggtacctacgggttccgttaccggtttagttaaccgttacggtcgtacgggtacgggtaaggtaacccgggtcgggtaaccccggggtaacccttaaccggtaacccggtttacgaacggttaccgttacggggaccggttacccggggtagggttaaccccgggaaccccggggaacggttaacccccgggg

SEQ ID NO: 269560 - DNA, 867 bp, Homo sapiens
  misc_feature: GYAE6OF01BPP4U.11.25.C03.1.454.CMB.1.raw
  modified_base (181)..(181): a, c, t, g, unknown or other
  misc_feature (181)..(181): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcgttgggttttccttgttgcttaattttaaaaggngtccagtgtgaggtgcgtctggtggagtcgtgggaggaggcctgactccgagtccgtgggggtccctgacgactctcctgtcgcacgtcctcgtcgggttccacccgtcacgtccacgtaccctagagtcggtacggttcgggccccgccgacggcctaccggaagggggtaacggggcgtgggtacggttcgggttcctttaccgttttaagtttacgacggtaccgtaagggttgggttaactactaagtttacgttcccggacgtaacgtacccgtccgggtagggaccgggggtacctaacgtttacccaacccgtacttcccgtaccgaacggtaacgtaaaccctaaacccgttacgtaaaacgtaacccgtaccggttactttcgttttaaccgtaaactaaagtaccgaaaccgtaacggtcccgttaagggaccgaccggtaccgtaacgttggaacccggttaaccgggtccggttaagtttacgtttacccggtaggttaccgggaaccggtaagggtaacggtaacccggggttacccggggaaacccccgtaaaccgggtttaaaccccgggtttaaccggttacccggttacgttaacgggttacggggtacccggtttcggggaaccccggggtaaacccggaaacccgggggttacccgtaacccccggg

SEQ ID NO: 269561 - DNA, 779 bp, Homo sapiens
  misc_feature: GYAE6OF01C1YQQ.11.25.C03.1.454.CMB.1.raw
  modified_base (322)..(322): a, c, t, g, unknown or other
  misc_feature (322)..(322): n is a, c, g, or t
tcagcgagagataccacgaccggtgctcgatttagtagtgtagatttgggtttgggggagaggagcccagcactgggattccgaggtgtttccattcggtgatcagcactgaacacagaggactcacatggagttttggctgagtcgttgggttttccttgttggtacttaagttttaaaaaggcgtcctagtggtagaggtcgcgtcgtgggtggagtcgtggaggacggcctgactccgaggccggttgggggtccctggacgtacctctctgtgccgagtccttcggtcggtacctccgtacacgtacaacctacctanagtggtacggttccggtccgaccgaggccgtacggaagggggagggtcgtagggtagttcgggttctttaccgtttaagttcgagtacgtaaggttcgtaacgtacctagttaccgttccgacgtaacgtccgttaccgggacgggtacggtccttacttaccgacctattaccgaccgagtaacaacctaaacgtcgtaaaaacgccgtacgttacgtttacgtttaaccaaacgtaacgtcgaaaaccgttccgacgttaggaacggtacccggacgtaaggtaccgaaccgggttaaccgtgttttacgaactttacggtcggtcggaaggaacgtaggacccggttaccggggaaccccctaaagggttaaccttaccgtaacgtacccggttaggtacccgggtaccgtacccggggtagggaaaaccccggtaggaacccgggttaacccg

SEQ ID NO: 269562 - DNA, 780 bp, Homo sapiens
  misc_feature: GYAE6OF01BYTR5.11.25.C03.1.454.CMB.1.raw
  modified_base (178)..(178): a, c, t, g, unknown or other
  misc_feature (178)..(178): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggngtccagtgtgaggtgcgtcgtggtggagtctggaggaggcctgatccagccgtgggggtccctgagactctcctgtgcagtcctcgtgggttccaccgtcagtccaaccacctacatgagttcgggtcccgcgaggcctccggaggggaacggggctgggagtcgggttccttaccttttattacgagcgtaggttggtaagtactattacttccgactacgtaccgtccggtagggaacggggtcccgtaatttcccgaacctaacgttcccgttaaccgaacggaaccggtaacctaaaaccgttacgtaaaaccggaacccgtaacccggttaccttttacggtttttaaccttaaaccgtaaaagtttaccgaaaaccgtacggtacccgtagggaacggtaacggaccccgtaagtaccgggaaaccgtacggggttacccgttaggtttaactttaaccggttggtacggaacggaggtaacggtacggtacccgggggtaacccctaacgggtaaacctttaccgtacggtacgttaacggtcgggtaccggttacggtaccggggaacccggtaaacgggtccccggtaaccgg

SEQ ID NO: 269563 - DNA, 793 bp, Homo sapiens
  misc_feature: GYAE6OF01AZ57W.11.25.C03.1.454.CMB.1.raw
  modified_base (177)..(177): a, c, t, g, unknown or other
  misc_feature (177)..(177): n is a, c, g, or t
  modified_base (732)..(732): a, c, t, g, unknown or other
  misc_feature (732)..(732): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctgggaggaggcctgactccagccgtggggggtccctgacgactcctcctgtcgcacgcctcgtggttacaccgtcagtcaccacctacatcgtagttcggtccgcacgggctccgaaggggtaacggggtctaggggtacggttcggggttcctttaccttttaagtttactacggtacgtaggttcggtaacgttactaagttactttccgactaacggtaaccgttccgggtgggtacgggggtaccctaacgttacccaaccgtaacttccgtacccgaagtaaccggaacctaaacgttccgtaaaacgtacctaacccggtcttttacgttttaccttaacgtaaacgttaacggaaacccgtacgtacccgttagggaacggaaccggtcccggtaagttaccgggaaccggtacccgggtaccggttttaacgtttaaccgtttaacgtcgggttacggaccgaggtaacggtacggttccgggggaaccccctaacgggtaaccgtttaaccacccgngtttaacggagggtacccgttcggggaaccgggtacccggtaaaggggccccgtaaccggg

SEQ ID NO: 269564 - DNA, 1010 bp, Homo sapiens
  misc_feature: GYAE6OF01DB5WK.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgttgggtttttccttgttgtcttaagttttaaaaaggagtccgagtggtgaggtgcgtcgtggtggagtcgtggagggaggtcctgactccgaggtcccggttcgggggggttcccctggacgtaccttcctccgtggtcgcgacgtcccttcggttcgggtaccctaccggtctacggtaccaacctaacccttacgtaagtggtaacggtttccggggtccccgacccgacggtccggtaacccggtaaggggggaacgggggttccggtaggggtacgggtttccggggttttacctttttcccgtttttaaacgttttacgtaacgggtccgtaaagggtttacggttaacgttaactaacgtttaccgttcccgacgtacggtaccgttcggtaccgggggacggggtacccgtacttaccggaaccctcgtttaccccgtaacggacgggtaaaaccctaacccttaaaccgtttaaccgtaaaaaccggtaacccgtaccggtttcccttttaggtttttaaccctaaccgttaaaacgtacgtaaaccccgtaacggtccgtaagggttaacgacccggggttaaccgaaggtacccggaacccgggtaacccggggtttaccggtttagtttaaacgtttccgggttacgggtacgggtaccgtaaaacggggttaacggggacccggggttacccccgggaaaccccggttaaaacccggggttttaacgttttaaaccccgacccggttaaacggtttcgggttaaacccgggggttaaccgggttacccccgggggaaggggggttaaaaccccccccggaaagggggttaaccccccccggttaacccgggg

SEQ ID NO: 269565 - DNA, 733 bp, Homo sapiens
  misc_feature: GYAE6OF01ALUZU.11.25.C03.1.454.CMB.1.raw
  modified_base (177)..(177): a, c, t, g, unknown or other
  misc_feature (177)..(177): n is a, c, g, or t
  modified_base (336)..(336): a, c, t, g, unknown or other
  misc_feature (336)..(336): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagccgtggggggtccctgagactctcctgtgcagcctcgtgggttccacccgtcagtcaccacctacatgaggttcgggtccgccagggcctccgaggggaacggggctgggnggtgggtcttcctttattacagctaggtggtagtacatacttccgcagtcctcggtggacggggcctatcaccatcctccgagacgacctaactacgtaacgaacctacgtacgttcgttttaccttaacgaaacttacgaaacctcggtacccgtacggaaggtacggaccccgaagttacccggaacccggtaccggggtacccgggttagttaaaccttttacggtggtaccggaacggtaacggtagggtaaccgggtcccgggggaaccccgtaaacccgggttaacccggtttaacccgtaaccggtaccgttaacggttacggggttacccgggttacgggtaacccggggggaaccccgtaaaaggggggcccccgttaaacccggggg

SEQ ID NO: 269566 - DNA, 770 bp, Homo sapiens
  misc_feature: GYAE6OF01A13TV.11.25.C03.1.454.CMB.1.raw
  modified_base (177)..(177): a, c, t, g, unknown or other
  misc_feature (177)..(177): n is a, c, g, or t
  modified_base (317)..(317): a, c, t, g, unknown or other
  misc_feature (317)..(317): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttattttaaaaggngtccagtgtgaggtgcgtcgtggtggagtcgtgggaggaggcctgactcccgaggtcccggttcgggggggtcccctggacgtacctccgtccgtgtgccgacgtccctcgttcgggtccaccggtcagtccacacctanagtggtacggttcgggcccgccgagggcctccggaaggggaacggggcgtgggtaggtcggggttcctttaccgttttaatttaccgaggtcgtagggttacggtacgtactaattaccgttcccgactacggaccgttccggtagggtacggggcccgtacttccaacccgacttccaccgaagaacgtaacctaaacttacgtaaacgaaccgtacgtcctttacggtttaactaaccgaaagttacggaaacctcggtacccgtaggaacgggtacgaccggtataccggaaccggtaaccggttccggttaagttactttaccggtggacgaacggtaggtacgggtacgggcccggggtaaccctaaccggttaaacccgttacgtacgtactagggtaccggtacggtccgggtacggggaaccgtaccggggaacccgtacccggg

SEQ ID NO: 269567 - DNA, 759 bp, Homo sapiens
  misc_feature: GYAE6OF01AQXEK.11.25.C03.1.454.CMB.1.raw
  modified_base (585)..(585): a, c, t, g, unknown or other
  misc_feature (585)..(585): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggacggcctgactccgacggccggttcggggggtccctgacgacctctcctgtgcgacgtccttcgttcgggttccaccgtcacgtccaacctacctacatggtaggttcgggtcccgccgaacgggcctaccggaagggggaacgggggtcctagggggtacggttcggggttccctttaccgtttttaactttaaccgaggtccgtaaggttcgggttaacgtacctaacgttacgttccgactacggtaccgttccggtgggacggggtaccctactttcccgaacctacgtccgtaccgaggaacgtaacctaaactacgtaaacgaaaccctacgttctttacgtttacctaacaaacgttcgaaacncgtacccgtagacgacgtaccgaagtcggaaccgtacgggtcgttagttaacttacgtggtacgacgaaggtacggacgggtacccgggaccctaacggttaacgttaccgtacgcgttaagtaccgggtaccggtcggaaccgggggaacccgaacggggtcccgtaacccgg

SEQ ID NO: 269568 - DNA, 861 bp, Homo sapiens
  misc_feature: GYAE6OF01DWKSD.11.25.C03.1.454.CMB.1.raw
  modified_base (477)..(477): a, c, t, g, unknown or other
  misc_feature (477)..(477): n is a, c, g, or t
  modified_base (688)..(688): a, c, t, g, unknown or other
  misc_feature (688)..(688): n is a, c, g, or t
  modified_base (729)..(729): a, c, t, g, unknown or other
  misc_feature (729)..(729): n is a, c, g, or t
tcagcgagagataccacgaccggtgctcgatttagtagtgtagatttgggtttggggggagaggagcccagcactgggattccgaggtgtttccattcggtgatcagcactgaacacagagactcacagtggtagtttgctgagtcgttgggttttccttgttgtacttaagttttaaaaggacgtccgagtgtaggaggtgcgtcgtggtaggtgtcgtggaggacggtcctggactccgacggccgggttcggggggtccctaggaacgtccttccgtcccgttggtcgccgaccggtccgttaccggttcgggttacccgtaacccgttaccgtacgtaccctaaccctaacccttacaggttcgggtacgggttccgggtccccgaccggtacgggtacccgtaccggggaagggggtacgggtcggtacggggtacgggtttcggtttacctttacccgtttttagtaacgnggtacggtagggtacgttaacgtactacgttaccgtccgtacgacgtacggttccggagggtaccgggtacctactaccctacgtaaccgttccgtacgaacgttaaccgaaccgttaaccgtaacgtaaccgaacggttacctttcgtttacttttaaccgtaaactaaacgttacgaaacgtaccggttacacggtacggtaacccggngtaaccgtccgtaacggtcccggtacttacggtttaaacgnggttacggacggtacggtaaggacggtaccgggtaacccgggctaaaccgggttaaccctacggtcgtacggtacgggtccggtaacgttaccggggaccggtaaccggtaacccgggcccggttaccccgg

SEQ ID NO: 269569 - DNA, 946 bp, Homo sapiens
  misc_feature: GYAE6OF01ETRLP.11.25.C03.1.454.CMB.1.raw
tcagcgagagataccacgaccggtgctcgatttagtagtgtagattttgggtttggggagaggagcccagcactgggattccgaggtgtttccattcggtgatcagcactgaacacagaggactcaccagtggtagttttggctgagtcgttgggtttttccttgttagtactttaagttttaaaaggcgtccgagtggtggaggtgtcgtcgtgggtggagtcgtagggaggacggcctagactccgacggtccgggtcgggggtcctagacgtaccttccgtccgtggtcgccgtacggttccccgttcggttaccgggttaccacccggtacgtaaccgtacccaaccgtaacccttaacgtagttacgggtacgggtttccggggtcccccgacgggtacggtacccggtacggggaacggggggtaacgggggtccgttggggtacggtttccgggtttaccttttacgttttagttaccgaggtcgtaaggttacgtaacgtactagttaccgttccgacgtacgtaccgttccggtagggacccgggtaccgtacttacccgaacccgtacgttaccgaaccgtaaggtaaaccctaacccgtaaacgttaaccggtaaaacggtacccgtttaccgtttacgttttaccgtttaaccgtaaaaacgttaaaggtacccgtaaacccgtacgggtccccgtaaggggtacccggaaaccgggtaccgggaacgggtacccgtaacgggttccggtttaagtttaacggtttaacgtttaccgggtagggtaccgggttcccgtaccggggtcggtacccgtacggtaaccccgttccgggttacggttaaccccgggtcccggtttaacgggggtaccggaacgttacccggggtaaacggttacccgggttcccgtttaacccggcccccgtttaccg

SEQ ID NO: 269570 - DNA, 1094 bp, Homo sapiens
  misc_feature: GYAE6OF01CL7KO.11.25.C03.1.454.CMB.1.raw
tcagcgagagataccacgaccggtgctcgatttagtagtgtagatttgggtttgggggagaggagcccagcactgggattccgaggtgtttccattcggtgatcagcactgaacacagaggactcacatggtagttttgctgagtcgttcggttttcctgttgacttaagttttaaaaggagtccagtgtgaggtcgcgtcgtggtggacgtcgtgggaggacggcctggactccgtaggcccggttcggggggtaccctggacgtaccttccgtccgtggtcgtaccacgtccgttccggttacgggttcccgtacccgtacgtaccgttaccaacctaacccgttaccgtaagttacggttaacgggttcccggggttccccggacccgtaacggggtccccgttaacccggggaaacggggggtaacgggggtaccggttacggggtaacgggtttcggggttttacccttttaacccgtttttaagtttaccggaaggttcggtaacgggttacgggtaacttaaccgtacgttacccgttaccgacgtaccggtaccggtttccggtacgggtaacccggggttacccgtaaacgtttaccccgaaacccgttaccttacccgtaaccgtaacgggtaaaccgtaaccgtaaaacccggttaaccggttaaaaccgtaaacccggttacggttaacccgttttaccggttttaaaaccgtttaaccgaaaaacggttacccggttaaaaacccggtacccggttaaccggttaaccgggaaaaccggttaaacccggggtaccctaaacggtttaaccccgggtaacccgggtaaccccgggggtttaaaccggtttcgttttaaaaccggtttaacgggtttcccggtaacggggttaaaccggaagggggttaccccgggtaaaaccgggtttccccggggaaaccccggtttaaaaccggttaaaccgggttaaccccggtttaaacgttacccgggtaacggttacccgggggtaacccggttttaccggggaaacccccgggggttaaccgggaaacccgggtaacccgggttaacccccgggg

SEQ ID NO: 269571 - DNA, 987 bp, Homo sapiens
  misc_feature: GYAE6OF01A9S38.11.25.C03.1.454.CMB.1.raw
  modified_base (186)..(186): a, c, t, g, unknown or other
  misc_feature (186)..(186): n is a, c, g, or t
tcagcgagagataccacgaccggtgctcgatttagtagtgtagatttgggtttgggggggagaggagcccagcactgggattccgaggtgtttccattcggtgatcagcactgaacacagagactcaccatggtagtttggctgagtcgttgggtttttccttgttgtacttaagttttaaaaggngtccagtgtgaggtgcgtcgtggtggtagtcgtggaggacggcctagactccgacggtccgggttcgggggtccctgacgacctccgtccgtgtcgcacgtccgtcggttcggtaccgaccgtcgtacgtaccaacctaccgtactagtacggtacggttccgggtccgaccgacggtccgtacggggaaggggtacggggtcgtaggggtacggttccggttacctttaccgttttaacgttacgacggtcgtaagggttacggttaacgtaactacgttaccgtacccgacgtaaccggttacccgtccgggtaacggggtaccggggtacccttaacgttacccgtaaccgtaccttacccgtaaccggtaacggtaacctaaccgtaaaccgttaacggtaaaaccgaccgtttaccgtttaccgttttaaccgtttaaaccgtaaacgtaaacgtaaccggtaaacccggtaccggttaccgtaagggtaaacggtaacccggaaccgttaaacggtcccggtaaacccggttcccggggttaaccgggttttaacgtttaacggtttaaccccgggtacggttaagggaaacccgggtaagggtaaccgggtaccccggggttaaacccggggtaaacccccgttaaacgggttttaaacccggttaaacccgttccggggttaaacccgtttaacggggggtaccccgggttaaaccggggtttaccccgggggaaacccgggggtaaaaccccgggttaaacccccgggggtaacccccgtttaacccccggg

SEQ ID NO: 269572 - DNA, 867 bp, Homo sapiens
  misc_feature: GYAE6OF01DZYF8.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggtaggttttggctggagcgttgggttttccttgttgacttaattttaaaaggagtccagtgtgaggtgcgtcgtgggtggagtcgtgggaggaggcctgactccacggccggtggggggtccctagacgactctccgtgtgcacgtcctcgtgggttaccaccgtcacgaccacacctacagtggtacggttcgggccgccgaggccgtaccgggaaggggggtaacggggtcgtgggggtaacggttccgggttacctttaccgttttagtttaacgacggtaccgtaagggttcggttaacgtaacttaagttaccgttacccggacgtaacggtaccggttaccgggtgggtaccgggggtacctaacgtttccccaaccgtacgttaccccgtaaccgaaggggtaacctaaacccgaaacgtttaacccgtaaaacgggtaaacccgttaccccgttaccgtttttacgggtttttaaccttaaacgtaaacgttaaccggtaaacccgttacgggacccggtttaagggaaccgggaacggtacccggtaagtacccggtaacccggtacccggggttaacgtttacgttaaccggtttacggtacgggttaccggaagggtaacgtacgggtacggtaccccggggtaaccctaaacgggtaaccgtttacgaccgtagttacggtacgggtccgtacgggtaggggaccctaaggggaccctacccggg

SEQ ID NO: 269573 - DNA, 759 bp, Homo sapiens
  misc_feature: GYAE6OF01EF7TT.11.25.C03.1.454.CMB.1.raw
  modified_base (172)..(172): a, c, t, g, unknown or other
  misc_feature (172)..(172): n is a, c, g, or t
  modified_base (475)..(475): a, c, t, g, unknown or other
  misc_feature (475)..(475): n is a, c, g, or t
  modified_base (644)..(644): a, c, t, g, unknown or other
  misc_feature (644)..(644): n is a, c, g, or t
  modified_base (749)..(749): a, c, t, g, unknown or other
  misc_feature (749)..(749): n is a, c, g, or t
tcagcgagagataccacgaccggtgctcgatttagtagtgtagatttgggtttgggggagaggagcccagcactgggattccgaggtgttccattcggtgatcagcactgaacacagaggactcaccatggagttttggctgagcgtggttttcctgttgctattttaaagngtcagtgtgaggtgcgtgtggtggagtcgtggaggaggcctgtactccaggtccgtcgggggtaccctggacgactcttccgtgtgcgagtccgtcgttaggtacctaccggatacgtaccactaaccttacagtgtacggttcggcccgaccgcggtccgtccggaaggggtaaggggcctaggggttaacggtgggttccgtttaccttttaacgttacgaggttaccgtaggtaggttactacgtattaccgttccgaagtactcgtacggtcgggacggacctacgttaccaaaccgtntacccttaccgaaggttcgaaaccctaacgtacgtaaacaccggtaaaccgttcgtttaacgtttacccgttaacctaaacgtccgtaaaaccgtcgttacccgtaagacgtaacccggtaccgaagttaccgggacccgtaacggtccggttaagttaaccgttacgnggttacgcggaagtaacggtacgggtccccgttacgaaaccggttaacttaccgtacaccgttaggaccgggttctacggggtaacccgggaacgtaccggggtntaacccccgg

SEQ ID NO: 269574 - DNA, 495 bp, Homo sapiens
  misc_feature: GYAE6OF01E1XEZ.11.25.C03.1.454.CMB.1.raw
  modified_base (473)..(495): a, c, t, g, unknown or other
  misc_feature (473)..(495): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgcttattttaaaaagcctgagagccgatgacacggccgtgtattactgtgcgagagagtggggcccacgaacgttactacgctatggacgtctgggaccaagggaccacggtcaccgtctcctcacgcctccaaccgaacgggcccatccggtccttccccccgtggccgcccctgcctccgaggacgccaccctccgagacgcacagccggcccgtgggctcgccgtggtaccaaaggtacctaccttaccggtatcctacctcgcgttggacgggtccggggctcggacgaacgggtcgacagtaagnnnnnnnnnnnnnnnnnnnnnnn

SEQ ID NO: 269575 - DNA, 845 bp, Homo sapiens
  misc_feature: GYAE6OF01BTA3C.11.25.C03.1.454.CMB.1.raw
  modified_base (181)..(181): a, c, t, g, unknown or other
  misc_feature (181)..(181): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggtagttttggctgagtcgttgggttttccttgttgcttaattttaaaaggngtccagtgtgaggtgcgtcgtgggtggagtcgtgggaggaggcctgactccgaggtccggtcggggggtccctaggacgtacctccttccgtgtcgtaccgacgtcctcgttcgggtcctacccgtacgacgtaccgaaccaacccgtaactacgttagggtaccgggtttccgggtccccgggaccccgtaacggggtcccgttaacccggggaaggggggtaacggggggcggttacgggggtagggttttacgggttcccttttaaccgttttaagtttaacccagggttaccgtaggggttacggttaacgtaaccttagttaaccgttccggacgtaaccgtccggttacgggtccgggacggggtaccctacgtcctaaccgtaccttcccgtacgaacgtacgaaacctaaccgtaacgaaaccgcgtacttacgtttcgttaactaactaagtacgaaacctcgtacctggaacgtaccggcgtacgtaccgaccggtaccgtagtttactacggttctgggtaccgagtaacgggcgggtacggtaacccggggaccccttaagggttaaacccgtacgtccggtaacgttaggacccggggttacggtaccccggtaaaggggaaccccgttacggggaaccccgttacccggg

SEQ ID NO: 269576 - DNA, 783 bp, Homo sapiens
  misc_feature: GYAE6OF01BADTO.11.25.C03.1.454.CMB.1.raw
  modified_base (177)..(177): a, c, t, g, unknown or other
  misc_feature (177)..(177): n is a, c, g, or t
  modified_base (348)..(348): a, c, t, g, unknown or other
  misc_feature (348)..(348): n is a, c, g, or t
  modified_base (559)..(559): a, c, t, g, unknown or other
  misc_feature (559)..(559): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttggttttccttgttgcttattttaaaaggngtccagtgtgaggtgcgtcgtggtggagtcgtgggaggaggcctgactccgaggtccggttcggggggtcccctggacgtaccttccgtccgtggtcgaccgcgtcccgttcgtcgggttcccaacccggtcacgtaccaacctacctacagtcggtaggttcgggtcccnccgacggcctaccggaaggggacgggctggggtaggttcgggttacctttaccttttattaacgagtacgtaggttggtaacgtactaattacgttcccgacgacgtaccgtccggtagggacggggtccctacttacccgaactacgttccgtaccgaagtacgtaacctaaccgtactaaacgacctacgtctttacgtttaccttaanaacgtacgaaccgacgtcgagaacgcgaccgtaagtaccgaacgtacggtaccgtttagttaaccgttagtcggtacggacgtaaggacgtaccgggtacccggggtaaccccttaaaaccgggttaacccgtttaacgaaccggtacgtttacggaccgggttaccgggttaaccgggtaccgggggaaccccgtaaacccgggggaccccgttaaccccggg

SEQ ID NO: 269577 - DNA, 1105 bp, Homo sapiens
  misc_feature: GYAE6OF01D8KZP.11.25.C03.1.454.CMB.1.raw
  modified_base (180)..(180): a, c, t, g, unknown or other
  misc_feature (180)..(180): n is a, c, g, or t
  modified_base (267)..(267): a, c, t, g, unknown or other
  misc_feature (267)..(267): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttggggttttccttgttgcttaagttttaaaaggngtccagtgtgaggtgcgtcgtggtgagtcgtgggaggaggcctgactccgaggccggtcggggggtccctgacgtacctctccgtgngccagtcctggtcggtcaccgtcacgtccacacctacagtgaggttcgggtccaccgtggcctaccgggaggggggtaacggggtcggttaggggtacgggtttcgggttaccctttaccgtttttaacgtttaacggaacggtaccgtaaggggtttacgggttaaagttaaaccgtttacttaaccggtttaccccggaaccgttaaccggggtaacccggttttaccccggggttacgggggtaaccgggggggggttaccccctttaaacgtttacccccgaaaacccggtttaaccctttccccgttaaacccgggtaaacggttaaacccggaaaaaccccggttaaaacccctttaaacccggggtaaaaaacggtaaaacccccgttaaccccggttttacccggttttaaacgggtttttttcccttaaaaacccggttaaaaacgttttaccgggaaaaaaccccgttaaccccgggtttaccggtaaccggggtaaacgggttaaaccccgggtaaacccggttaacggtaaccccgggttaacccggtaacccggggggtttaacccgttttacggttttaaaccgggttttaccggttaacccgggttgggtaaacccgggtaaacgggttaacgggggttaaaccccgggtcccgggggttaaaaccccccgggttaaaacccggtttaaacccgggtttaaccgtaaaccccgggtttccgttaaaccggggtacccgggggtttaaccggggtttacccggggtaaccccggggggttaaacccggtaaacccgggggttaaccccggtaaccccccggggg

SEQ ID NO: 269578 - DNA, 934 bp, Homo sapiens
  misc_feature: GYAE6OF01A2FEZ.11.25.C03.1.454.CMB.1.raw
  modified_base (179)..(179): a, c, t, g, unknown or other
  misc_feature (179)..(179): n is a, c, g, or t
  modified_base (316)..(316): a, c, t, g, unknown or other
  misc_feature (316)..(316): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttattttaaaaggngtccagtgtgaggtgcgtcgtggtggagtcgtggaggaggcctgactccagccggtggggggtccctgacgactctccgtgtgcacgtcctcgtggttcaccgtcagtcactacctacagtgtaggttcgggtcccnccgaggcctaccggaagggggtaacggggccgtggggaggttcggggttcctttaccgttttaatttacgagtccgtaagggttaggttaacgtactaattacgttacccgacgtaacgtaaccgttcccgggtaggggtaccgggggtacccgtacgtttacccgaaacccgtacttcccgtacccgaaggaaccggtaaacccttaaacccgttaaccgtaaaaccggtaaccctaacccggttccgtttaccggttttttaaccctaaacgtaaaacgttccggaaaaccttaccgggaccccgtttagggaacccggtaaccggtaccccggtaaggtttaccggaaaccccggtttaacccggggtacccgttttaacggttttaaccggtttaacccggttggggttacggtaaaccccgggtaggggtaaaccgggttacggggttaaacccccggggggtaacccctaaaacccggggtttaacccggtttaacccggttaccgacccggttttaaacggggtttaccgggtaaccccggggttttccggggaaaccccgggggggaacccctaaaaccggggggtaaccccccgtttaaaccccggggg

SEQ ID NO: 269579 - DNA, 1015 bp, Homo sapiens
  misc_feature: GYAE6OF01B0IYN.11.25.C03.1.454.CMB.1.raw
  modified_base (177)..(177): a, c, t, g, unknown or other
  misc_feature (177)..(177): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttatttaaaaggngtccagtgtgaggtgcgtctggtggagtcgtgggaggacggcctgactccgaggccggtcggggggtccctgacgacctctcctgtgcacgcctcgtcgggttccaccgtcacgtaccaccacctacagtgaggttccggtccgccgacgggtccctaccgggaggggaacggggtcgtagggtaggttcgggttcccttttaccgttttaactttacgacggtccgtaagggtttacgggtaacgttaacctaacgtttaaccgttcccgggactaacggtaacccgttcccgggtaacggggtaccgggggtacccgttaacttacccccgaacccgtacttccccgttaacccgaacggtaaccgaaaacccgttaaaccccgttaaacggttaaaaccggaaacccgttaaccccggttaccggttttttaaccgtttttaccccgtttaaaacctaaaaacggttaaccgggttaaaccccaaccggttccccggttaaagggaaacccggtacccggtaaccccgggtaagtaaccccggggtaaccccgggtaaccccgggtttacggggttttaaccggttttaaaaccttaccccgggtttagggggtaacccggaaccccggggttaaagggtaccgggttaaaccgggggtttaccccccgggggaaacccccgttaaaaccggggtttaaaaacccgtttttacccgaaacccggggttacgtttaaaccggtaccgggggggttaaccccgggtttaccgggggaaacccccggggggtaaaccccggtaaaacccggggggccccccggtttaaaaccccgggg

SEQ ID NO: 269580 - DNA, 875 bp, Homo sapiens
  misc_feature: GYAE6OF01B48AZ.11.25.C03.1.454.CMB.1.raw
tcagcgagagataccacgaccggtgctcgatttagtagtgtagatttgggtttgggggagaggagcccagcactgggattcccgaggtgtttccattcggtgatcagcactgaacacagaggactcaccatggtagttttggctgagtcgttgggtttttcctttgtttgacttaagtttttaaaaagggcgtccagtggtaggtagggtgtcgttcgtgggtggagtcgtggacgggacggtcctgactccgacggccggttcggggggtcccctggacgtacctccgttccgtggtcgccgtacgtccttcgttcggttccaaccgtcgacgtaccacctacctacgattaggtacggtttcgggcccgacgcgggtccctaccgggaggggacggggtccggtcgggtacgggttcgggtttccttttaaccgttttacgtttaaccgaggtacgtaagggttacggttaacgttaacgtagtttaccgttcccggaactaacgttacccgttaccgggtgggtaaccggggccttaacgttaccctaaccgtacgttacccgttaccgaacgtaacgtaaccctaaaccgttaacgtaaaacggtaaccttaacggttcttttaccgtttactaacgtaaacgttacgaaactccggtacgtaacggacgtaccggaaccggtacgtaacggtaacccggtaccgggttaccgttaggttaaccgtttacggtgtacggacggtaacgtacgggtaccggtacccgggggtaaccctaaaccggttaaccggttaacgtaccggacggtttaacggaccgggttaccgtaccggtacccgggggaaactacccggggtacccgtacccggg

SEQ ID NO: 269581 - DNA, 794 bp, Homo sapiens
  misc_feature: GYAE6OF01CLZO3.11.25.C03.1.454.CMB.1.raw
  modified_base (766)..(766): a, c, t, g, unknown or other
  misc_feature (766)..(766): n is a, c, g, or t
tcagcgagagataccacgaccggtgctcgatttagtagtgtagatttgggttggggagaggagcccagcactgggattccgaggtgtttccattcggtgatcagcactgaacacagaggactcaccatggtagttttggcttgagtcgtttcgggttttccttgttgtacttaagttttaaaaaggcgtccagtgtggaggtgcgtcgtgggtggagtcgtgggaggacggcctgactccgaggccggtcgggggtccagacgtacctcctcgtgtgaccacgtccgttcgttacgggttccctaccgtcgaacgttccaaccgtaacctacgagtcggtaacggtttccgggccccgaccggaacggtacccgtaccggggaaggggacggggtacgttgggtaacggttcgggttccttaccgttttaagtttaaccgagtacgtaaggtcggttaacgtacttaagttaccgttaccgacgtaacggtaccggttcggtacggacccgggtaccgtaacctttaccggacccgtaacgttaccctaaccgtaaacgaacgtaaaccccgttaccttaaaccgtaaacgaaccgttacccttacgtttaccgttaaactaacccaaaggttaccgaaaccctgttcccggaagtaacggaccgaaccgtgttaaaccggcggttaaccccggtgttaagttcgtacgttgggactacgggaggtaccgacgggtccggaacctacgtaacgtcacgtagtccgnggtaccgcggtagggacaacggtcctcg

SEQ ID NO: 269582 - DNA, 773 bp, Homo sapiens
  misc_feature: GYAE6OF01AYJAH.11.25.C03.1.454.CMB.1.raw
  modified_base (177)..(177): a, c, t, g, unknown or other
  misc_feature (177)..(177): n is a, c, g, or t
  modified_base (344)..(344): a, c, t, g, unknown or other
  misc_feature (344)..(344): n is a, c, g, or t
  modified_base (547)..(547): a, c, t, g, unknown or other
  misc_feature (547)..(547): n is a, c, g, or t
  modified_base (634)..(634): a, c, t, g, unknown or other
  misc_feature (634)..(634): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggtagttttggctgagctgggttttcctgttgcttatttaaaaggngtcagtgtgagtgcgtctggtggagtcgtgggaggaggcctggactcccaggcccgttcggggggttccctaggacgacctccgtcccgtgtacgcgacgtccttcggttcgggttccaccgtcgtaacgtcccaacctacctaacacgtggtaggttcgggtcccnccgacggcctccggaagggggaacggggtcgtgggaggttcgggttaccttaccgtttatttacgagtcgtagttggtactacgtagtacttccgcgtaacgtcgtccggtgggaccgggacctattacccgacctactcctacgaagtaccgaacctaactaacgtaaacgaccgtccgttacgttttcgtttaccttaaanaaacttacgaaacgacgtcccttaggaaccggtacgacccgtaaggtaacgacccgtaaccgggttccgttaggttaactttacggnggttaccggacggaaggacgttccgggtaacccgggtaccctaaaccggttaccggttaaaccttccggattaacggggttcgtaacccgggttggttaaacccgggggccgtaaaaccccgggtccccggtaacccgg

SEQ ID NO: 269583 - DNA, 833 bp, Homo sapiens
  misc_feature: GYAE6OF01DQJ84.11.25.C03.1.454.CMB.1.raw
tcagcgagagataccacgaccggtgctcgatttagtagtgtagatttgggttgggggagaggagcccagcacttgggtattcccgaggtgtttccattcggtgatcagccacgagaacactagaggaacctcaccatggagttttaggctgagtacttgggttttcccttcgttcgtacttaagtttttaaaaaggcgtaccgagtgtggaggtcgtcgtctaggtggtagtcgtggaggacggcctagacttccgagtccgtgggggtcccctcgacgtacctcgtcctagtcgccacgtccttcggtgggtccgaccgtacgtacgtaccacctaaccgtaactagtggtacggttcgggtacccgccgaacggtccgccggaagggggtaacggggcgttagggtaggttcgggtttaccctttacccgttttatttaacgacggtcctaaggttcggtaacgtactaagttacgttccgaagtacgtacccgtcggtagggaaccggggtctactttcccgaaccagttcccgaccgtaacggtaacgtaacctaaccttaacgaaacgtaaccgtacccggtactttcgtttaaccttaaacgtaacgtacggaaacctcgtacccgttaggaacggtaccccgaggtaacttcgggaacccgtaccgggttaccgtacgttattaccggtgtacgggaccgaaggtacgggtaccgggtaccgggtacccccgtaaaggttaaacccggttctaaccggttaacctgggttacccggttaacggacccgggtacgggaacccgggtaaccggtaccggtacccccgg

SEQ ID NO: 269584 - DNA, 962 bp, Homo sapiens
  misc_feature: GYAE6OF01CQT36.11.25.C03.1.454.CMB.1.raw
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgtcttattttaaaaaggagtccaggtgtggaggtgcgtcgtgggtggagtcgtgggaggaggcctggactccgaggccggtcggggggtccctgacgctcctcctgtgcacgtcctcggttggttccacccggtgtacgtcaaccgacctaactagtggtacggtttcggggtcccgccgtacgggccgtaccggaagggggacggggtccgtggggtacggttcgggttcctttaccttttaagttaacgacgtcggtaggttacggtaacgttaactacgttaacgttcccggaccgtaacggtacccgtttcccgggtagggacccgggggtaccgtactttccgaaacctaccgtttccaaccggtacggaaacgtaaccctaaaccgtttacggtaaaaccgaaccgtaccggtttaccgtttacgtttttaaaccgtaaacgtaaacggtaaccggaaacccggttaacgtccggttaacgggaacgggtacccggtaacccgggtaacgttaaacccgggaacccggtaacccggggtttaccccggggtttaacttttaaaccggttttaccccgggtaagggggttacccggaaccgggggtaaaacggggtaaccgggtaaacccggggtttccccgggggaaaaccccgtaaacccggggtttaaaacccgtttaccgtaacccgggtacgtttaaaccgggttccgggggttaaccgggttacccggggttaccgggggggaaaaccccccgtaaaggggggacccccccgtttaaaccccgggggg

SEQ ID NO: 269585 - DNA, 788 bp, Homo sapiens
  misc_feature: GYAE6OF01DQKVV.11.25.C03.1.454.CMB.1.raw
  modified_base (523)..(523): a, c, t, g, unknown or other
  misc_feature (523)..(523): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtctggaggaggcctgatccagccgtggggggtccctgagactctcctgtgcagcctcgtgggttcaccgtcagtcactacctacatgaggttcggtccgccgaggcctaccgaggggacggggctggaggttcggtacttctttaatttacagctaggtggtagtacattacttccgcaacgaccgtccggtagggacggggaccctagttacccacctaacttcctacccgaaggaacgtaacctaaccgttaacgttaaacgaaaccgtaacccgttcgtttaacgtttttacctaaccgaaaacgttcggaaaccncgtacccttagggaacgtaaccgcccgggtaattaccgggaacccgtaaccggggttacccgtttaggtttaaccctttggtacggttcgggaacccggaaagggacggtaacccggggttacccgggggaaccccccttaaaccgggttaaaacccggttttacccgtaaacccggttccgtttaaacggaccgggggtacccggtttaccgggacccggggggttaaaccccgaaaccgggggtaacccccgtaaacccgggg

SEQ ID NO: 269586 - DNA, 750 bp, Homo sapiens
  misc_feature: GYAE6OF01CCYAI.11.25.C03.1.454.CMB.1.raw
  modified_base (608)..(608): a, c, t, g, unknown or other
  misc_feature (608)..(608): n is a, c, g, or t
  modified_base (626)..(626): a, c, t, g, unknown or other
  misc_feature (626)..(626): n is a, c, g, or t
  modified_base (633)..(633): a, c, t, g, unknown or other
  misc_feature (633)..(633): n is a, c, g, or t
tcagcgagagataccacgaccggtgctcgatttagtagtgtagatttggggtttggggggggagaggagcccagcactgggattccgaggtgtttccattcggtgatcagcactgaacacagaggaactcaccatggtaggtttggctggagtcgttgggttttccttgttgtattaatttaaaaggagtcagtgtgaggtgcgtcgtgggtggagtcgtagggaggacggcctgactccgacggtcggtcgggggtccctgactactctctgcgtacacgtccgtacgtgggtacctaaccggtacaacgtaccaacctacctaacgtagtaggtacgggtccgggtacccgaccggaggtccgtacgggaaggggaacgggtcggtagggttcggttacgttccgttttaaccgtttagttacgaccggtaggtaacggttacggttaacgtaacctacgtttaaccgtccgtaacgtacgtaccggtcggggttacgggaccggggtactaactacccgacgttaccttaccgaacgaagtaacctaacccaacggttaacaaacgtaaccgtacgtttctttaacgtacgtaacaagtaccgancgtaccgaaggacggtanaccgtanacgtccgacggttcgtattaacagtcgaggagtacgacggtacgaccggaccgtaaacgtaacgtacgtaagcgtaaacgggtcgacggttaccgggacgacggtacccgcgtaccg

SEQ ID NO: 269587 - DNA, 745 bp, Homo sapiens
  misc_feature: GYAE6OF01CEVZO.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggtagttttggctgagcgttgggttttccttgttgtcttaagttttaaaaaggagtccagtgtgaggtgcgtctggtggagtcgtggaggacggcctggactccgagccgtcgggggtcctgagacctcctccgtgtcgcacgtccgtcgtcgggttaccaccgtcgtacgtacctaaccaacccgtacaagttggtacggtttcgggtaccccgaccgtacgggaccgttacccgggaagggggtaacggggccgttaggggacggttcgggtttacctttccgttttaagtttacgaggcgtaggttgtaacgtacctagtacgttccgacgaacgtaccgtccggtcggacgggtccacgttcaactcgtcctacgaagacgaacctaactactaaacgacgactcgttacgtttactaaactaagtaacgaacgacgtactcggaaagccgtaccggaatccgaaccggtcggtaccgttagttaacgttcgtagtcgaaccggagaaggtaccggtccgggtacccgaacgttaacggttaccgtacgtcgaacggttcggtaacggttcgggaaaccgggggtacccaaccggggcccgtaaaccccggg

SEQ ID NO: 269588 - DNA, 584 bp, Homo sapiens
  misc_feature: GYAE6OF01BK4MZ.11.25.C03.1.454.CMB.1.raw
  modified_base (202)..(202): a, c, t, g, unknown or other
  misc_feature (202)..(202): n is a, c, g, or t
  modified_base (550)..(584): a, c, t, g, unknown or other
  misc_feature (550)..(584): n is a, c, g, or t
tcagcgagagataccacgaccggtgctcgatttagtagtgtagatttggggtttgggggggagaggagcccagcactgggattccgaggtgtttccattcggtgatcagcactgaacacagaggactcaccatggagttttggctgagcttgggttttccttgttgcttattttaaaagcctgagagcgatgacacggcgtntattactgtgcgagagagtcggggcccaacgtaacgttacctacgtctagtggacggttcgtcggggaccgaacgggaccacggtccaccgtctccgtcacggccctaccaccgaacgggccctacgtccggttcccttccccccgtgggcccgtcccctcgcctacccgacgggacgtaccacccgtccggaagacgaccgaccgaacggtcccgggcccgttcggggtcctacggccggtcggtaacgaacgggtaaccttaccgtttaaccgtcttaccgtcctcggtcgtacgggtacgggcggggtcctgggaccgaaggggccccgtaagtacgagctagcnnnnnnnnnnnnnnnnnnnnnnnnnnnnnnnnnnn

SEQ ID NO: 269589 - DNA, 651 bp, Homo sapiens
  misc_feature: GYAE6OF01C7T3R.11.25.C03.1.454.CMB.1.raw
  modified_base (146)..(146): a, c, t, g, unknown or other
  misc_feature (146)..(146): n is a, c, g, or t
  modified_base (620)..(651): a, c, t, g, unknown or other
  misc_feature (620)..(651): n is a, c, g, or t
tcagcgagagataccacgaccggtgctcgatttagtagtgtagatttggggttggggggagaggagcccagcactgggattccgaggtgtttccattcggtgatcagcactgaacacagagactcacagtggtagttttgctaggngtcgtttgggtttttccttgtttgtacttaaagtttttaaaaacgccgttagaaggacgcccggtaagtcggaaccgtaccgggtccgttaggttaactttacgtgggtagacggaaggaacggtacggtaccggggaccccgtaaaccggttaaaccgtttaaccgtaaccgtacgttaagtcggggtaaccgttcggacggggaccgaaacgggacctaccggtacctaccgttcctacctaccgaccgtacccaacccgaaccggaaccggtaccctacgttccccgttccccgttccccggcgacccgtccgtcgaccgtaccgacggaccaccgtaccgtaccgagaccgacgccggaaccggcccggtccgtcgcgtccgtcggtacgtaacgtaacgtaccgttaccgttacgttactcgtcgcggtacggacggcgggtacggacgacgaacgacgacacagagcnnnnnnnnnnnnnnnnnnnnnnnnnnnnnnnn

SEQ ID NO: 269590 - DNA, 741 bp, Homo sapiens
  misc_feature: GYAE6OF01B8O4P.11.25.C03.1.454.CMB.1.raw
  modified_base (324)..(324): a, c, t, g, unknown or other
  misc_feature (324)..(324): n is a, c, g, or t
  modified_base (414)..(414): a, c, t, g, unknown or other
  misc_feature (414)..(414): n is a, c, g, or t
  modified_base (616)..(616): a, c, t, g, unknown or other
  misc_feature (616)..(616): n is a, c, g, or t
  modified_base (672)..(672): a, c, t, g, unknown or other
  misc_feature (672)..(672): n is a, c, g, or t
tcagcgagagataccacgaccggtgctcgatttagtagtgtagatttgggtttggggagaggagcccagcactgggattccgaggtgtttccattcggtgatcagcactgaacacagagactcacatggtagtttggctgagtcgttgggttttccttgttagtactttaagttttaaaaagggcgttaccgaggttggtggtagggtgccgttcgtgggtaggagtcgtgggaggacgggcctagactcccgagggccggttcggggggtccctaggacgtacctctccgtggtcgacacgtccgttcgtggttcccaccgtnacgtacacacctacagtcgaggttccggccacgacgccgtaccgaggggaacggcgtggtacggtcggttaccttacttaagttaaccgngacgtaggttacggtaatactacttaccgtcgagaacgtaccgtcggtacggtacgggcctactaccacgtactaccgtacaagtaccgaactaaccgttaacgaacgaaccgttgtcctttaggtttaccaaagaagtcaaacgtcgtctaaggacgacttaccgagaccggaaccgtcgggtacttaaggtactttacgngggtaccagggtaagaccgtaacgggtcccggaaacccgtaacggtaacggttacncgttacccgtaaaggttcgggtaaaccccgtgggaaaccggggtccccaaaagggtcccgtaaccccgg

SEQ ID NO: 269591 - DNA, 775 bp, Homo sapiens
  misc_feature: GYAE6OF01E229V.11.25.C03.1.454.CMB.1.raw
  modified_base (394)..(394): a, c, t, g, unknown or other
  misc_feature (394)..(394): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcgttgggtttttccttgttgtcttaattttaaaaggagtccagtgtgaggtgcgtgtggtggagtcgtggaggaggcctgatccgacgccggtgggggtccctaggacgtacctcctcctgtcgcgacgtcctcgttcggttccaccgtcacgtacacacctacagtggtaggttcgggtccgccgaggccgtaccggaggggacgggtcggtgggtaggttcgggttctttccgttttaattacgngtacgtaggtaggttagtaactagttactaccaacgtacggtaaccgttccggtaggggtaccggggtaccttaacgttacccaacctacgttccgtaccgtaaacggaacgaaccctaaacgttaaccgtaaacgtaaacccgtaaccgtttccgttttaacgttttaccgttaaacgaagttacgaaaccgtacgtacccgttaggacgtacgaccgtacgtacgaccgtaccggttcgtacgttttacgtcgtagtacggaggaacggacgggtacggtcccgggtaacccgtaacgggtaaccgtttaccggtacgtaccgtaaggtccgggtaacgtccggggtacgggacccggaaaccgggtccgtaaccccgg

SEQ ID NO: 269592 - DNA, 820 bp, Homo sapiens
  misc_feature: GYAE6OF01BUKKC.11.25.C03.1.454.CMB.1.raw
  modified_base (180)..(180): a, c, t, g, unknown or other
  misc_feature (180)..(180): n is a, c, g, or t
  modified_base (623)..(623): a, c, t, g, unknown or other
  misc_feature (623)..(623): n is a, c, g, or t
  modified_base (649)..(649): a, c, t, g, unknown or other
  misc_feature (649)..(649): n is a, c, g, or t
tcagcgagagataccacgaccggtgctcgatttagtagtgtagatttgggtttgggagaggagcccagcactgggattccgaggtgtttccattcggtgatcagcactgaacacagagactcaccatggtagtttggctgagtcgttggttttccttgttgacttaagttttaaaaaggngtaccagtgtaggaggtcgcgtcgtggtggagtcgaggaggacggcctgactccgaggtccggtggggggtccctaggtactaccgttccgtaccgtggtacgacgaacgttccgtcggttacggggttacctacccggttacgaacgttacccaaacctaaccctagtaaggtcggtaacggtttccggggaccccgtacgacgggtacccgtaccgggaaggggggtaacggggtccgttagggtacgggttacgggtttacctttacccggttttaaattaacgacgggttacgtaaagggtttacggtaaacgttaactaacgtttaccgttccggaacgtaacggtaccgttacggaggggaaccggggtacccttaagtacccaacggttactaccgtacaagggtaaccaaccttaacgaacgtaacgaaaccgtnttccgttacgttttaacaacgtaaanacgaataccgtagagtaaggacgacctagtaaccgaccggaccggtcgttagtaatttcggagtacggacgaaggtacggtccgggtaaccggacctaaaccggtaacgttactaccgtagtacgtacgggttccggacgtaaccggggacgtaaacggccccgttaacgg

SEQ ID NO: 269593 - DNA, 849 bp, Homo sapiens
  misc_feature: GYAE6OF01D1C4E.11.25.C03.1.454.CMB.1.raw
  modified_base (176)..(176): a, c, t, g, unknown or other
  misc_feature (176)..(176): n is a, c, g, or t
  modified_base (298)..(298): a, c, t, g, unknown or other
  misc_feature (298)..(298): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctattttaaaaggngtccagtgtgaggtgcgtctggtggagtcgtggaggaggcctgactccgagccgtgggggtccctgacgactctccgtgtcgcacgcctcgtgggttccaccgtacacgtcaacctacctancgtggtacggttcgggtcccgccgaggtccgtaccggagggggaacggggtccgtaggggtacggtcgggtttaccttacccgttttaagtttaccgaaggtccgtaagggttcggttaacgtaaccgtacgtttaaccttcccgggaactaaccggtaccgttcccggggtaaggggaaccgggggtaccccttaattacccggtacctaaccttccgtaacccgaaggtaaaccgtaaccctaaaccggttaaccgtaaaacggaacccgtaccgtttacgtttaccgtttaactaaaccgtaaagttaaccggaaccgtacgtacccgttgggaaacggtaacccgaacccgggtagtaaccgggaccggttacccgggtaaccgtttgtttaaacggtttcccggtggtacgggaaccgtaacgggtagggtcccgggttaccggggaacccctaaaccggttaaacggttaacctaccggtagttacgggaccgggttaccgtacgggtacccggggaaccgttaaaacgggggccttaacccggg

SEQ ID NO: 269594 - DNA, 908 bp, Homo sapiens
  misc_feature: GYAE6OF01BRMV5.11.25.C03.1.454.CMB.1.raw
  modified_base (143)..(143): a, c, t, g, unknown or other
  misc_feature (143)..(143): n is a, c, g, or t
  modified_base (776)..(776): a, c, t, g, unknown or other
  misc_feature (776)..(776): n is a, c, g, or t
tcagcgagagataccacgaccggtgctcgatttagtagtgtagatttgggttgggggagaggagcccagcactgggattccgaggtgtttccattcggtgatcagcactgaacacagaggactcaccagtggtagtttttggntgagtcgttgggtttttccttgttgtactttaagtttttaaaaaagggacgtacctagttggtaggtagggtgcgttcgtgggtggtagtcgtgggagggacggcctgactcccgacggcccgggttcgggggggtcccctaggacgtaccgttcctccgtggtcgcgacgtccgttcggttcgggtacctaccgtcacgtaccaaccaaccctaatataggtcggttaccggggtccccgaccgacgggtaccggtaccgggaaggggggtaacgggggtccggtaggggtaagggttccgggtttacccttttaccttttaacgtttagaacggtcggtaggttaggttaacgtaaccttagttaccttacccggacgtaacggtccgttacccggggtaggggaaccggggtacctaccgttacccaacccttactcccgttaccgaaggtaacctaaaccttaaacccgtaaccggtaaaacgtaaacccgacccgggttttcctttttaacggttttaacccttaaacgtaaacgtaaccgtaaccgaaccggttcccgtaagaagggtaacccgtaccgaaggtacccggaaccgtaccccgggttgtttacgttaacgttttccgnggtacggaaggtacggcggtaccgggtacccggaacccgtaaccggtttaaccggttacgtacccgttgggtaacgttcgggtaccggtcccggggtaacggacccgggttaaacccgggcccggtacccgg

SEQ ID NO: 269595 - DNA, 829 bp, Homo sapiens
  misc_feature: GYAE6OF01D2K4B.11.25.C03.1.454.CMB.1.raw
  modified_base (179)..(179): a, c, t, g, unknown or other
  misc_feature (179)..(179): n is a, c, g, or t
  modified_base (327)..(327): a, c, t, g, unknown or other
  misc_feature (327)..(327): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttgctgagcgtgggtttttccttgttgcttatttttaaaaaggngtccagtggtgaggtcgcggtctgggtgacgtcgtggaggacggcctgactccaggtccgtcgggggttccctgacgaccgttctccgtgtcgaccacgtcctcgttggttccaccgtcacgtcaccacctacagtcgagttcggccnccgaggcctcggaggggagggtctgggtaggtggttccttccgttttaagttacgacgctaggttcgtaagtacctattacgttccgacacggtaccgtccggtacgggacggggtacctacttccgaacctactccgttaccgaagtaccgaaaccttaaaccgtcgtaaaaccggtaacctaccgttccgtttacggttttacctaacgtaaaacgttaccggaaaccgtccggtcccgttaaggaacgggtacccgaccgttaaagccgggtaacccgacgggttacccggtttaattaaaccgttttaccggtagggtaccgaggggttaaccggtaccggtaacgggggttaccccggaacccgttaaacccggggtttaaaccgttaacccggtaaacggttaccgtaagggttttacccgggtaccggggtttaaacccggggtccgggggttaaaaccccgggaaccggggtaacccgtttaaacccccggggg

SEQ ID NO: 269596 - DNA, 951 bp, Homo sapiens
  misc_feature: GYAE6OF01CDFF5.11.25.C03.1.454.CMB.1.raw
  modified_base (313)..(313): a, c, t, g, unknown or other
  misc_feature (313)..(313): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggtagttttggctgagtcttgggttttccttgttgtcttaattttaaaaggcgtccagtgtgaggtgcgtcgtggtggagtcgtagggaggacggcctgtactccgacggtccggtcggggggtccctggacgtaccgttcctccgtgtcgaccgacgtccgttcgttcgggttccaccggtntacgtaccaacctaccctacagttaggtacggtttcgggtccccgccgaacgggtccgtaccgggaagggggtaacggggtccggtaggggtacgggttcggttacccttttaccgtttttaacgttacgcgtacgtagggttagtactactacgtttacctcccgtacgtacggttaccggtcccgggtagggacccggggtacccttacttacccaaccgtacttaccctaccggtaagaacccgttaacctaaaccgttacgtaaaaccgtcccgttaacccgttcgttttaaccgtttaccgttaaaacaaccggtttaacggaaacccggttccgttaccggtacgggtaaaacggacccgggttacccggtaacgtccgggttaaaccccggggacccgggttttaccggttttaggttacccgtttttaaggcggggttacgggaacccgaaagggggttacccggacccgggggttaaacccccgggggaacccccttaaacgggttttaaacccggttttaaacccgagggttaccctttcggggtaaacccggggtaaacccggttttcccggggggaaacccgggggttaacccccggaaacgggggtttacccccctaaccggggg

SEQ ID NO: 269597 - DNA, 736 bp, Homo sapiens
  misc_feature: GYAE6OF01BBN3C.11.25.C03.1.454.CMB.1.raw
  modified_base (178)..(178): a, c, t, g, unknown or other
  misc_feature (178)..(178): n is a, c, g, or t
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggtagttttggctgagcttggttttcctgttgcttaatttaaaaggngtccagtgtgaggtgcgtctggtgagtcgtggaggagcctgactccgagtccggtcggggggtccctgacgacctctccgtgtgccgacgtccttcgttcgggtccacccgttcacgtccaacctacctanagtggtacggttcgggtccccnccgacggtccgaccgggaggggaggggtctgggtagggttcggttcctttaccttttagttacgagtcgtaggttaggtaacctactaacttaccgtccggactaacggtaccgtccggtagggaccggggtacctacttacccgaacctacttcccaaccgaaggtaacctaacctaaaccttaccgaaacgtaaccttccgtactttacggtttacctaaacgtaactacggaacgtcgtacccgagacgtaccgacgtagaccgtaaccgggtaccgacgtttggtacttaccgttgggacacggacgtagcccgggtaccggtacccaacggttaaccgttcgacgtcgtaaggtaccgggtcgtaccggggacggaaacccggtcggtacccggtaaccg

SEQ ID NO: 269598 - DNA, 893 bp, Homo sapiens
  misc_feature: GYAE6OF01BJ5V9.11.25.C03.1.454.CMB.1.raw
tcagcgagagataccacgaccggtgctcgatttagtagtgtagatttggggtttgggggggagaggagcccagcactgggattccgaggtgtttccattcggtgatcagcactagaaaacagaggactcaccatggagttttggctgagcgtgggttttccttgttgcttaattttaaaaggagtccagtgtggaggtgcgtcgtgggtggagtcgtgggaggaggcctgactccgaggtccggtcgggggggtccctggacggtacctcctccgtggtcgccacggtcccttcggttcggggttcctaacccgttcgaacgttccaacctaacccgtaacagtcgggtacgggtttccggggtaccccggcccgacgggtcccgtaccgggaagggggggaacgggggtccgtaggggtacggggtttcgggttacctttccgtttttaattacgaggtacgttaggttagggtaacgttaactaagttaccgttcccggacgtacggtacccgttccggggtacgggaacgggggtacctaacttacccaacctacgtcccgtaccgaaggtaacgaacctaaaccgttaacgtaaacgaaccgtaccgttccgtttacgttttaacctaaacgtaaaacgacgtaaacgacggtacccgtaagggaaccgaacggtacccggtaaactaccgggaacccggtaccggggtaccgtttaacgttaaggtttaccgagggtcggacggtaaagggtacggtaccggggtaacccggggtaacccgtaaaccggtaaaccgtttaccggtacggtacttacggggtacggtaccgggttacgggtacccggggggaaaccaacccgggggtaaacccgtcccgggtaaccccg

SEQ ID NO: 269599 - DNA, 830 bp, Homo sapiens
  misc_feature: GYAE6OF01COI83.11.25.C03.1.454.CMB.1.raw
  modified_base (286)..(286): a, c, t, g, unknown or other
  misc_feature (286)..(286): n is a, c, g, or t
tcagcgagagataccacgaccggtgctcgatttagtagtgtagatttgggtttggggggagaggaacccagcactgggattccgaggtgtttccattcggtgatcagcactgaacacagaggactcaccatggtagttttggctgagtcgttgggttttccttgttgacttaattttaaaaggacgtccagtgtgaggtgcgtcgtggtggagtcgtggaggaggtcctgactccgacggtccggtcggggggtccctagacgtacccttccgtcctggtcgaccncgtccgttcggttacgggttacctacccgtccgacggttaccaaccctaacctaaccgtaagttacggttacggggttaccgggtccccggccgaacgggtcccgtaccgggaagggggaacggggtctggggtacggttcggttcctttaccgttttaagtaccgagtcgtagtaggtacgtaactagttacttccgacgtacgtaccgtccggtagggaccgggtacctagttaccacccgtactaccgcgtaacgacgtaacccaacttaccggtaaagaaaccccgtcgttacgttttcgttaaccctaaagtaacgtttaccgaaacctggtacccctagggaaccgttaccgaccgtagtaccggtaaccggccggttacgttagttaagttaccgtgggttacggagtaacgggtctacgggtccccgggtaaccttaaacggttaacccgggttacctacgggtactttaacgggcccggtaccggtttccgggaaacccgggtaaccgtaacccggggcgttcccggtacccccg

SEQ ID NO: 269600 - DNA, 780 bp, Homo sapiens
  misc_feature: GYAE6OF01B4GKB.11.25.C03.1.454.CMB.1.raw
  modified_base (419)..(419): a, c, t, g, unknown or other
  misc_feature (419)..(419): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgtcttaattttaaaaaggagtccagttgtgaggtgcgtcgtggtggagtcgtgggaggacggcctgactccgagtccggtcggggggtccctggacgacctcgtcctgtcgcacgtcctcgttcgggttccaccgttcacgtaccaacctaccctactagtaggtacgggttccgggtcccgaccgacgggtcctaccggggaaggggaacggggtcgtaggggtacggttcgggttcctttacgttttaacttacgngtacgtaaggttaggttaacgtactatttacgtcccgcgtaaccgtacgtcccggtagggaaccggggtaccctaccttaccaaccgtacttccctaccgaacgaacgtaacctaaaccgttacgaaacgtactacgttcgtttacgtttactttaactaacgtaaacgtaacgtaaccgtcgtacgaggacggaacccgacgaccggtaaccgaccggttaccggttacggttaattacgtttacggcggtacggagtaaggacgggtaccgggtacccggaacgtaaccggttaaccgttacgacgtagttaacggtcggtaccgggtacgggacccgggaacggtaccgggtaaccgg

SEQ ID NO: 269601 - DNA, 792 bp, Homo sapiens
  misc_feature: GYAE6OF01D4V2O.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctgggtggagtcgtggaggaggcctgactccgagccgtcgggggtccctgagactctcctgcgcacgtcctcgtggttccacgtcagtcacacctacagtgagttcggccgcacggctaccgaaggggaagggtctgggtagtcgggtccttactttattacgagtcgtaggtgtagtaactagtacgttccgacgacgtaccgtcggtaggacggggaccgtattcccgaaccacttccgacctaaggaacgaacctaaccttaacgtaaacaaaacgtccgttacgttacgttttacctaaccgaaagttaaccggaaaccgtaccgtacggttaggaaacggtacggaccgtaagttaaccggacccggtaacccgggttaccgtttaacggttaaccttttaccggaggttacgggacggtaaaacgggtaaccggtacggggttaccccgggggaaaccccccaaacgggtttaaaccccggttaaccgtaaaacccgggttccggttaaacgggtaaccgggttcccggttaaccggggttaccgggggaaaccccggtaaacccggggaccccgtaaacccccgggg

SEQ ID NO: 269602 - DNA, 831 bp, Homo sapiens
  misc_feature: GYAE6OF01A7POZ.11.25.C03.1.454.CMB.1.raw
  modified_base (180)..(180): a, c, t, g, unknown or other
  misc_feature (180)..(180): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggngtccagtgtgaggtgcgtctggtggagtcgtggaggaggcctgactccaggccgtcgggggtccctgacgtacctcttcctgtcgcacgcctcgtcgggttccaccgtcacgtccacacctacagtgtacggttcgggccgccgaggccgtaccggaagggggtaacgggcgtgggtaggttcgggttcctttaccgttttaattaccgagtccgtaaggttcggtaagtacctattacgtcccgacacggtaccgtccgggtagggaccggggtccctactttcccgaaccctactacccgtaccgaacggaaccgtaaacctaaaccgttaacgtaaaacgaaacccgttaccggttaccgttttacgttttaaccttaaccgtaaacgttacggaaacctaacggtacccggtaggtaacggacgtacccgtaagtacccggaaccggtacccgggttaccgttacggtttaactttacggtacgggtcggaacgggtaacggtaacgggtaccgggtacccggggtaaccccgtaaaccgggtttaaaccgtttacggtaacccgtacggttaacgggtacgggtacccgggtttaccggggaacccggggacccgggtaaacccgggtaacccggttaaccccggg

SEQ ID NO: 269603 - DNA, 803 bp, Homo sapiens
  misc_feature: GYAE6OF01BUSYS.11.25.C03.1.454.CMB.1.raw
tcagcgagagataccacgaccggtgctcgatttagtagtgtagatttgggtttggggagaggagcccagcacgtgggattccgaggtgtttccattcggtgatcagcactgaacacagacggactcaccagtggtagttttggctgagtcgttgggttttccttgttgacttaagttttaaaaggcgtccgagtgtggaggtgcgtcgtgggtaggacgtcgtgggaggacggtccgtaggactccgacggtccgggttcggggggtcccctaggacgtaccttccgtccgtggtcgcgtacgtccgttcggttccgggtacctacccggtacgtacgtaccaacctaaccttacagttcgggttaacgggttccggggtaccccgccggacggtcccgtaaccggggaacgggggtaacggggtccgtagggtacgggttcggtttacctttaccgttttataacgcgtacgtaggtacggtaatacgtacttacgtcgacgacgtacgtccggagggtaccgggcctatccactcgtccacgaacgacaacctaactactaaacgaccgtactacgtttacgttactaaacaacgtacgaaacgtacgtcgtaggacgaacgtccgagtacgaaccggtaccgttacgtttagttaacgtttccgaggttacggaacggtaggtaaccggtacgggtaacccggggacccttaaacgggttaccgttaccgtaacggtacgttagggaccggtacgggtacccgggtacgggaaccccggaaaggtaccccgttacccggg

SEQ ID NO: 269604 - DNA, 868 bp, Homo sapiens
  misc_feature: GYAE6OF01A7P59.11.25.C03.1.454.CMB.1.raw
  modified_base (175)..(175): a, c, t, g, unknown or other
  misc_feature (175)..(175): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggngtccagtgtgaggtgcgtcgtggtggagtcgtggaggaggctgactccagccgtcgggggtccctgacgactctcctgtcgcagtcctcgtgggttccaccgtcacgtccaccacctacatacgtacggttcgggtcccgaccgacggccgtaccggaaggggaacggggtcgtagggtacggttcgggttcccttttaccgtttttaacgttttaaccgacggtaccgtaagggtttacgggttaacggtttaaccgtaagtttaaccgttacccgaacgtaacggtaacccgttccgggttacgggacgggggtaccctacgtttacccgaacccgtacttcccgtaccgaaaggtaccgaacccgtaaaccgttacgtaaaaacggaacccgtaacggttaccgtttacgttttacccttaaacgtaaacgttacgtaaaccgacgtacccgtaggaaccggtacgtacccggtaagtcccggtaaaccgtaccgggtaccgtttaggttaacctttacggtaggtacgggaccggtaaagggtacggaacgggttacccgggggtaaccccgtaaaccgggttaaacccgtttaaccggtaccggtaccgtttaagggtacccgggttacccgggtccggggtaacgggggaaaccccggaaaccggggttaccccggtaaacccgggg

SEQ ID NO: 269605 - DNA, 883 bp, Homo sapiens
  misc_feature: GYAE6OF01BTZ9M.11.25.C03.1.454.CMB.1.raw
  modified_base (182)..(182): a, c, t, g, unknown or other
  misc_feature (182)..(182): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgtcttaattttaaaaaggngtccagtgtgaggtgcgtctggtggagtcgtgggaggacggcctgactccgacggccggttcggggggtcccctggacgtaccttcctccgtggtcgccgtacgtccgttcggttcgggttaccacccgtctacgtccaacctaacctacagtggtacggttcggggtcccgccgaacgggtcctaccgggaacgggggtaacggggtccgtggggtacggttcgggttccttttaccgttttaatttaacgagtacgtaggttacggttaagtacctaacgttaccgttacccgacgtacggtaccgtccgggtagggaccgggggtacccgtacttaccgaacctacttccgtacgaacggtaacgtaaacctaaaccgttaacgtaaaacgtaacccgtacggttacctttacggtttttaaccctaaacgaaaacggtttaccgaaaaccgtcggtaaccgtaagggaacggaaccccgtcggtaagtacccggtaaccgggtacccgggttacccgtttaggttaaaccttaccggttggtaccgggaacggtacgggtaaacggtaccggggtaccccggggaacccctaaaagggtttaacccggtttaacccgtacggtacgttaaggtacccgggtacgggttaccgggtaacccgggggaacgtaaaacccgggggtcccctaaaccgggg

SEQ ID NO: 269606 - DNA, 881 bp, Homo sapiens
  misc_feature: GYAE6OF01AU9FK.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtcgtggagggaggtcctgactcccgacggcccggttcggggggtcccctggacgaccttcctcccgtggtacgccgacgtccgttcggttcggggttccgacccgtctacgtcctaaccgtacctactagtaggtaggttcgggtcccgaccgacggtccgtaccggaaggggaacggggtcgtgggtaggttgggtttacctttacccgttttaagtttaccgaggtacgtagggtacggtaacgttactagttaccgttacccggtacgaacggtaccgttaccgggcgggtaacggggtaccctaacgtttcccgaaacccgtaccttcccgtaccgtaaacggaccgtaaaccgtaaaccgttaaccgtaaaaccgaaaaccgtacccggttaccgttttcggttttaacctttaaacgaaaccgtttacgaaaaccccggtaacgtaccccggttaacgggtaacggtaaccggacccgaacgggttccggaaacccggtacccggtaccggttacgttaaccgtttacgacgggttacggtacggaaggtaccggttaccgggaccggggtaaccccgtaacggttaaacccggtttagtaaacccgggcttaacgtcggggtaaccgtacggggaccggggacccggaaacggggtccccgtaaccggg

SEQ ID NO: 269607 - DNA, 789 bp, Homo sapiens
  misc_feature: GYAE6OF01D58I0.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagagactcactagtggtagttttgctgacgtcgtttggttttccttgttagtacttaagtttaaaggacgtcgtagtgtgaggtgtcgttcgtgggtgagtcgtagggaggacgtctgactccgacggtccgggtcggggtcctagacgtacctctcgtgtcgacgtacgtccgtacggttcggttaccaccgtacgtactaccacctaacctagtaggtcggttacgggttccggacccgtacggtacggtccggtacggggtagggggacgggtcgtagggttacggtcggtttaccttttacttttacgtacgtaggtagtacgggttagtaacgtactagtccgttccgaacgtacggtccgtacgggacggtaccggtacgtaccttacaaccgtcgtaccgtaccgaagtacaacgttaaccaacggtaactcgtacttcgtttacgtttaaccaaagtacgtactaaccgtcgtacgtaaggactacggactactacgggacccgtaacggtttcttaggttaccttcggtagaaccggggtacgtaagggtaccgggaccggtaaaccccggtaaccgtaccggttaacttacgcggttaagtcccgggttaggtcccgggtacggggttaaccgacccggtaaacccgggtccgtaaccccgg

SEQ ID NO: 269608 - DNA, 778 bp, Homo sapiens
  misc_feature: GYAE6OF01BBGMA.11.25.C03.1.454.CMB.1.raw
  modified_base (190)..(190): a, c, t, g, unknown or other
  misc_feature (190)..(190): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (526)..(526): a, c, t, g, unknown or other
  misc_feature (526)..(526): n is a, c, g, or t
  modified_base (540)..(540): a, c, t, g, unknown or other
  misc_feature (540)..(540): n is a, c, g, or t
  modified_base (565)..(565): a, c, t, g, unknown or other
  misc_feature (565)..(565): n is a, c, g, or t
tcagcgagagataccacgaccggtgctcgatttagtagtgtagatttgggtttgggggggagaggagcccagcactgggattccgaggtgtttccagttcggtgatcagcactgaaacacagaggactcaccagtggtagttttggctgagcgtttgggtttttccttgtgtacttaagttttaaaaggntccgagtgtgaggtgcgtgtgggtggtagtcgtagggacggagcctagactccgaggtcccggttcgggggtccctggacnccttccgtccgtagtncgcgtccttcggtcggttccaccgtctacgtacaacctacgtacgtgtacggtacggttccggtcccgacgacggtccgaaccgggaaggggtaacggggcgttagggtaggttccggtttacctttaccgtttaagttacgacgtcgtaaggttacggtagtactagttacgtcccgagtaccgtacgttccgggagggtacggtaccttcgtaccacgtactccgtacgaacggtanaacctaccgttaanaaaccgttacctacggtttactttnttaaccgtaaacgaacttacgaaccgccgaagtcgaacggtacgacctgtaccgaaccggtcgttcgtaagttactcggtagaggaacggtcggacggtacggtaccgggtaacccctaaaggtttacccttagggtaccttacggttaacgggtcggttccgggtaaacccgggtacccggggaaacccggtcccggttaacccgtaccggg

SEQ ID NO: 269609 - DNA, 768 bp, Homo sapiens
  misc_feature: GYAE6OF01D6L8I.11.25.C03.1.454.CMB.1.raw
  modified_base (179)..(179): a, c, t, g, unknown or other
  misc_feature (179)..(179): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaatttaaaaggngtccagtgtgaggtgcgtctggtggagtcgtggaggaggcctgactccgagccggtggggggtccctgacgacctcctccgtgtcgcacgtcccttcgttcgggttcctacccgtcgtacgtaccaacctacccttaacgagttggtacggtttcgggtccccgccgacgggtcctaccgggaagggggtaacggggcgttaggggtaggttcgggttcctttccgtttttaagttacgagtcgtaggttggtaacgtactacgtacgttccgactacgtacgtccgggtaggaccgggtcctattaccacctactccgtaccgaagtaaccgaacctaaaccgttacgaaacgacctacgtcttttacggtttacctaacaaagttccgaaactcggtccgtaaggaacgtacggccgtaagtccggaaccgtaccgggtcgtttacgttaagttccggtagcggacggaaggtacgggacgggtacccggggaaccccctaagggttaaacctttaccgacggtcttaagggtccgggtaccgtcggggaaccggggaacccgaaaccggggaccccgttaccgggg

SEQ ID NO: 269610 - DNA, 688 bp, Homo sapiens
  misc_feature: GYAE6OF01CYQUK.11.25.C03.1.454.CMB.1.raw
  modified_base (142)..(142): a, c, t, g, unknown or other
  misc_feature (142)..(142): n is a, c, g, or t
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (437)..(437): a, c, t, g, unknown or other
  misc_feature (437)..(437): n is a, c, g, or t
  modified_base (461)..(461): a, c, t, g, unknown or other
  misc_feature (461)..(461): n is a, c, g, or t
  modified_base (478)..(478): a, c, t, g, unknown or other
  misc_feature (478)..(478): n is a, c, g, or t
tcagcgagagataccacgaccggtgctcgatttagtagtgtagatttggggtttggggggagaggagcccagcactgggattccgaggtgtttccattcggtgatcagcactgaacacagaggactcaccgatggagtttgntgagcgttggtttctgtgtctaatttaaaaggngtcngtgtgaggtgcgtcgtgggtggacgtgtggaagggcggcctagcgtccgaggtccgggttcggggggtcccaggaacgtccttccgtccgtgtcgacgcgtcctcggtggttaccaccggtactaacgtaccaacctaaacctacctacgtaggtacggtttcggcccgccgtacgggtaccgtaccgggaaggggtaacgggcggtcgggtaggttcggttcttactttacttacgacgtcgtagtacgtagtactnttaacgctcagacgtcggtacggnggctagtcaaccgtacncgacagaacactaactaacgtacgacgtctcgttaattactacgaacgtacgacgtacgtacgacgagtacgacgtacgtacggaccgtacgtaccgtagttacgtacggtcgagaacgaggtacggtcggtaccgaacgtaaaccgtaccttaacgacgtacgtagaccggtaccggtcggtaacgggaactaaccgggccggtaaccg

SEQ ID NO: 269611 - DNA, 546 bp, Homo sapiens
  misc_feature: GYAE6OF02GZJSA.11.25.C03.1.454.CMB.1.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgagggaaggggctgggagtgggtctcctttatttacagcagtggtagtacatattccgcagacctccgtgaggggccattcaccatctccagagacaactctaaagaacacgctgttcttacaaatgaacagcctgagagccgatgacacggccgtgtattactgtgcgagagagtggggacccaacggaacgttacacgctagtcggacgtcgtggggacctaagggaccctaccggg

SEQ ID NO: 269612 - DNA, 491 bp, Homo sapiens
  misc_feature: GYAE6OF02JWS3K.11.25.C03.1.454.CMB.1.raw
  modified_base (355)..(355): a, c, t, g, unknown or other
  misc_feature (355)..(355): n is a, c, g, or t
  modified_base (467)..(467): a, c, t, g, unknown or other
  misc_feature (467)..(467): n is a, c, g, or t
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatccctgctctggaattgaattgagagataaatatacttgttggtatcaacagaagccaggccagtcccctgtattggtcatctatcaagatgtgaagcggccctcagggatccctgacgcgattctctggctccaactctgggaacncagccactctgaccatcagcggacccaggcctatggatgaggctggactattattgtcaggcgtgggacagcagcactgccgttatgtctcggactgggaccaggtcacgtnttgacgtcagccaggcctaacccg

SEQ ID NO: 269613 - DNA, 548 bp, Homo sapiens
  misc_feature: GYAE6OF02FV6BV.11.25.C03.1.454.CMB.1.raw
tcagcgagagataccacgaccggtgctcgatttagtagtgtagatttgggtttgggggagaggagcccagcactgggattccgaggtgtttccattcggtgatcagcactgaaaacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccaggggaaggggctggagtgggtctcctttatttacagcagtggtagtacatattccgcagactccgtgaggggccattcaccatctccagagacaactctaaagaacacgctgtttctcaaatgaacagcctgagagccgatgacacgggccgtgtattactgtgcgagagagtcggggcccaaggaacgttactacgctagtggacgttcgtaggggaccaaggggacccacgggtaccg

SEQ ID NO: 269614 - DNA, 468 bp, Homo sapiens
  misc_feature: GYAE6OF02GO435.11.25.C03.1.454.CMB.1.raw
  modified_base (462)..(468): a, c, t, g, unknown or other
  misc_feature (462)..(468): n is a, c, g, or t
tcagcgagagataccacgaccggtgctcgatttagtagtgtagatttgggtttggggggaagaggaagactgacggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggctacttccgtatctctcgctgagcgggctggcaaggcgcatagnnnnnnn

SEQ ID NO: 269615 - DNA, 551 bp, Homo sapiens
  misc_feature: GYAE6OF02G6A5U.11.25.C03.1.454.CMB.1.raw
  modified_base (363)..(363): a, c, t, g, unknown or other
  misc_feature (363)..(363): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgagggaaggggctggagtgggtctcctttattacagcagtggtagtacatatccgnagactcgtgaggggccattcacatctcagagacaactactaagaacacgcttgtttcttacaaatgaaacagcctagagacgccgatcgacgacggccgtgttacttactgtgcgagagagtcggggacccacggtaaccgttacacgactagtcggacgtcgtcggggaccgtagggacctaccggg

SEQ ID NO: 269616 - DNA, 502 bp, Homo sapiens
  misc_feature: GYAE6OF02H7NUB.11.25.C03.1.454.CMB.1.raw
  modified_base (354)..(354): a, c, t, g, unknown or other
  misc_feature (354)..(354): n is a, c, g, or t
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctcaactctgggacncagccactctgaccatcagcgggacccaggctatggatgaggctgactattactgtcaggcgtgggacagcttcactgatgtgtattcggcggtagggaccaagctacggaccgtcgtaggtccaggccccaaggtcctcgtcccccg

SEQ ID NO: 269617 - DNA, 547 bp, Homo sapiens
  misc_feature: GYAE6OF02GKAPK.11.25.C03.1.454.CMB.1.raw
  modified_base (456)..(456): a, c, t, g, unknown or other
  misc_feature (456)..(456): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccgccaggctccgaggggagggctggagtgggtctctttattacagctagtggtagtacatattccgcagactccgtggacggggccattcaccatctccagagacaactctaagaacacgcttgtttctacaaatgaacagcctgagagccgatgacncggcgtgtattactgtgacgagagagtcggggacccaacggtaaccgttactacgcttagaggacgtcgtggggaccaagggacctacggg

SEQ ID NO: 269618 - DNA, 541 bp, Homo sapiens
  misc_feature: GYAE6OF02GPAOD.11.25.C03.1.454.CMB.1.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgagggaagggctggagtgggtctctttattacagcagtggtagtacatattccgcagactccgtgaggggccattcaccatctccagagacaactctaaagaacacgctgtttcttcaaatgaacagcctgagagccgatgacacgggccgtgtattacgtgtgcgagagagtcggggacccaacggaaccgttacacgctagtcggacgtcgtggggaccaagggccctacgg

SEQ ID NO: 269619 - DNA, 471 bp, Homo sapiens
  misc_feature: GYAE6OF02FFZ5Z.11.25.C03.1.454.CMB.1.raw
  modified_base (390)..(390): a, c, t, g, unknown or other
  misc_feature (390)..(390): n is a, c, g, or t
  modified_base (464)..(471): a, c, t, g, unknown or other
  misc_feature (464)..(471): n is a, c, g, or t
tcagcgagagataccacgaccggtgctcgatttagtagtgtagatttgggtttgggggggaagaggaagactgacggtccgccaggctccagggaaggggctggagtgggtctcctttatttacagcagtggtagtacatattccacagactccgtgaggggccgattcaccatctccagagacaactctaagaacacgctgtttcttcaaatgaacagcctgagagccgatgacacggccgtgtattactgtgcgagagatgggggcccacgaacgttactacgctatggacgtctggggccaaggggccacggtcaccgtctcctcagcctccaccaagggcccatcggtcttccccctggcgccctgctccaggagcacctccgagngcacagcggccctgggctgcctggtcaaggctacttccgtatctctcgctgagcgggctggcaaggcgcatagnnnnnnnn

SEQ ID NO: 269620 - DNA, 467 bp, Homo sapiens
  misc_feature: GYAE6OF02IDSU5.11.25.C03.1.454.CMB.1.raw
  modified_base (465)..(467): a, c, t, g, unknown or other
  misc_feature (465)..(467): n is a, c, g, or t
tcagcgagagataccacgaccggtgctcgatttagtagtgtagatttgggtttgggggggaagaggaagactgacggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatgggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgtatctctcgctgagcgggctggcaaggcgcatagnnn

SEQ ID NO: 269621 - DNA, 507 bp, Homo sapiens
  misc_feature: GYAE6OF02HRFC4.11.25.C03.1.454.CMB.1.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtccccctgtattggtcatctatcaagatgtgaagcggccctcagggatccctgagcgattctctggctccaactctgggaacgcagccactctgaccatcaggccgggacccaggctatggatgaggctgacttattattgtcaggtcgtgggacagcagcacgtgcccgttatcgtcgttcggaactgggaccaaggtccacgtcgttgacgtcacgcccaggcccaacccg

SEQ ID NO: 269622 - DNA, 506 bp, Homo sapiens
  misc_feature: GYAE6OF02G0248.11.25.C03.1.454.CMB.1.raw
  modified_base (356)..(356): a, c, t, g, unknown or other
  misc_feature (356)..(356): n is a, c, g, or t
  modified_base (475)..(475): a, c, t, g, unknown or other
  misc_feature (475)..(475): n is a, c, g, or t
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacncagccactctgaccatcagcgggacccaggctatggatgaggctgactattatgtcagggcgtgggacagcagcactgcccgttatgtcttcggaacgtgggaaccaggtccaccgttnttagacgttcaggcccaaggccctaaccccg

SEQ ID NO: 269623 - DNA, 540 bp, Homo sapiens
  misc_feature: GYAE6OF02GWIO9.11.25.C03.1.454.CMB.1.raw
  modified_base (432)..(432): a, c, t, g, unknown or other
  misc_feature (432)..(432): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaaggggctggagtgggtctcctttatttacagcagtggtagtacatattccgcagactccgtgaggggccattcaccatctccagagacactctaagacacgctgttctcaaatgaacngcctgagagccgatgacacggcctgtattactgtgacgagagagtcggggaccccaagtaaccgttacacgctagtgggaccgtgtcggggaccaagggccctacggg

SEQ ID NO: 269624 - DNA, 518 bp, Homo sapiens
  misc_feature: GYAE6OF02ICUWI.11.25.C03.1.454.CMB.1.raw
  modified_base (149)..(149): a, c, t, g, unknown or other
  misc_feature (149)..(149): n is a, c, g, or t
  modified_base (157)..(157): a, c, t, g, unknown or other
  misc_feature (157)..(157): n is a, c, g, or t
  modified_base (164)..(164): a, c, t, g, unknown or other
  misc_feature (164)..(164): n is a, c, g, or t
  modified_base (174)..(176): a, c, t, g, unknown or other
  misc_feature (174)..(176): n is a, c, g, or t
  modified_base (178)..(181): a, c, t, g, unknown or other
  misc_feature (178)..(181): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (365)..(365): a, c, t, g, unknown or other
  misc_feature (365)..(365): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (440)..(440): a, c, t, g, unknown or other
  misc_feature (440)..(440): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagtttttggctgagcggngtttcgtntaggcgnttaagagcannngnnnngtgatntgngngctgntcagcctgggggtcctgagctcncctgtgcagcctctggttcaccgtcagtcacacctacatgagttcgggtccncaggtcaccaggggaagggctggagtggtctcctttatttacagcagtgtagtacatatcgcagactcgtgagggccgattcaccatctccanagacaactacaagaacacgntnttactacaatanacagcgtagagacgacgatcgacgacgtcgtagtattatgngacgagagagtacggaccgaacgtaacgtaacgtacgtacgtagtacgtacggtacgtcgggaccggaccggacgacg

SEQ ID NO: 269625 - DNA, 479 bp, Homo sapiens
  misc_feature: GYAE6OF02HHSEA.11.25.C03.1.454.CMB.1.raw
  modified_base (258)..(258): a, c, t, g, unknown or other
  misc_feature (258)..(258): n is a, c, g, or t
  modified_base (443)..(479): a, c, t, g, unknown or other
  misc_feature (443)..(479): n is a, c, g, or t
tcagcgagagataccacgaccggtgctcgatttagtagtgtagatttgggtttgggggggtagggaggagcccagcactgggattccgaggtgtttccattcggtgatcaggccactgaacacagagggactcaccatggagttttggctgacgctggggttttccttagttgctattttaaaagcctgagagcccgatgaccaccggccgtgtattactgtgcgagagatgggggcccacgaacgttactacgctangggactctggggccaagggaccacggtcaccgtctcctcagcctccaccaagggccccatcgggtacttccccctggccgccctgctccaggagccacctccgagtagcaacgaggccggcctgggactgcctggtcaaggctacttccgtatctctacgctgagcggctggcaaggcgcatagnnnnnnnnnnnnnnnnnnnnnnnnnnnnnnnnnnnnn

SEQ ID NO: 269626 - DNA, 544 bp, Homo sapiens
  misc_feature: GYAE6OF02F23R4.11.25.C03.1.454.CMB.1.raw
  modified_base (526)..(526): a, c, t, g, unknown or other
  misc_feature (526)..(526): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtggaggggccgattcaccatctccagacgacaactcaagaacacgctgtttctacaaatgaacagcctgagagccgatgacacgggtccgtgtattacgtgtcgcgagagagtcggggacccacggaaccgttactacgctagtggacgtcgnggggccagggaccacggg

SEQ ID NO: 269627 - DNA, 559 bp, Homo sapiens
  misc_feature: GYAE6OF02GRPGR.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaaaacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtcccgccgaggcctccgaggggaaggggctgggagtggggtctccttttatttacagcaggtggtagtacatacttccgcagactccgtggacggggccattcacctatcctccagagacaactctaaagaacacgctgtttctacaaatgaacagcctagagacgccgatcgacacggccgtgtacttactgtgcgagagagtcggggacccaggtaaccgttactacgctagtggacgtcgtggggccaagggcccaggtcc

SEQ ID NO: 269628 - DNA, 546 bp, Homo sapiens
  misc_feature: GYAE6OF02H7G9N.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggcctccgaggggaaggggctgggagtgggtatccttttatttacagcagtggtagtacatattccgcagactcgtgaggggccattcaccatctccagagacaactctaaagaacacgctgtttctacaaatgaacagcctgagacgccgatcgacacggccgtgtattacgtgtgcgagagagtcgggacccagaacgttacacggtactagtcggacgtcgtcggggaccagggacctaccgg

SEQ ID NO: 269629 - DNA, 547 bp, Homo sapiens
  misc_feature: GYAE6OF02FZ9T7.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgagggaaggggctggagtgggtctcctttattacagcagtggtagtacatattccgcagactccgtgaggggccattcaccatctccagagacaactctaagaacacgctgtttctcaaatgaacagcctgagagccgatgacacggccgtgtattacgtgtgcgagagagtcggggacccaacggtaacgttactacgctagtcggaccgtcgtcggggacctaagggaccctaccgg

SEQ ID NO: 269630 - DNA, 581 bp, Homo sapiens
  misc_feature: GYAE6OF02HXW67.11.25.C03.1.454.CMB.1.raw
  modified_base (342)..(342): a, c, t, g, unknown or other
  misc_feature (342)..(342): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacngcagtggtagtacatattccgcagactccgtgacggggccattcaccatctccagagacaactctaaagaacacgcttgttctcaaatgaacagcctgagacgccgatgaccacgggccgtagtacttaactggtagcgagagtagtcggggaccccaacggtaaccgtttaaccgtacgacctaagttcgggaccggttccggtacgggggacccgtaacggggaccctaacccgggg

SEQ ID NO: 269631 - DNA, 516 bp, Homo sapiens
  misc_feature: GYAE6OF02IRI6S.11.25.C03.1.454.CMB.1.raw
  modified_base (258)..(258): a, c, t, g, unknown or other
  misc_feature (258)..(258): n is a, c, g, or t
  modified_base (378)..(378): a, c, t, g, unknown or other
  misc_feature (378)..(378): n is a, c, g, or t
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
  modified_base (501)..(516): a, c, t, g, unknown or other
  misc_feature (501)..(516): n is a, c, g, or t
tcagcgagagataccacgaccggtgctcgatttagtagtgtagatttgggtttgggggggtaaggagggaagactgacggtccgccaggctccagggaagggggctggagtggggtctcctttatttacagcagtggtagtacatattccgcagactccgtgaggggccgattcaccatctccagagacaactctaagaacacgctgtttcttcaaattgaacagcctgagagccgatgacacggccgttgtattacngtgcgagagatgggggccccagaacgttactacgctatggacgtcgtggggccaaggggaccacggtccaccgtcctcctcagccctccaccaacgggcccatccggtcctttcccccgnggccgtccctgcctccgaggacgccacctccggagacgccacaggccgggccccgtgggcctgcccgtggtcagggtacctacttcccgtatctctcgctgagcggcngcgaggcgnatacgnnnnnnnnnnnnnnnn

SEQ ID NO: 269632 - DNA, 574 bp, Homo sapiens
  misc_feature: GYAE6OF02GNWMZ.11.25.C03.1.454.CMB.1.raw
  modified_base (177)..(177): a, c, t, g, unknown or other
  misc_feature (177)..(177): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagcctggggggtcccgtgagactctcctgtgcagcctctgggttcaccgtcagtcacacctacatgagttgggtccgccaggctccagggaaggggcgtggagtgggtctcctttattacagcagtggtagtacatattccgcagactccgtggagggccgattcaccatctccagagacaactctaaagaacacgcttgtttactacaaatgaaacagtcctgagacgccgatgaccgaccgggccgttgtactttacgtgtgcgagagtacgtcgggggaccccaacggtaaccgttacctaacgctaagtcgggacgtccgtgggggaccctaaggggacccaccggg

SEQ ID NO: 269633 - DNA, 549 bp, Homo sapiens
  misc_feature: GYAE6OF02FGES2.11.25.C03.1.454.CMB.1.raw
  modified_base (255)..(255): a, c, t, g, unknown or other
  misc_feature (255)..(255): n is a, c, g, or t
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
  modified_base (430)..(430): a, c, t, g, unknown or other
  misc_feature (430)..(430): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcgtggtttcgtgttagcgtatttaaaggagtccagtgtgaggtgcgtctggtggagtctggagaggcctgatccagccctggggggtcctgagactctctgtgcagcctntgggttcaccgtcagtcacactacatgagttggtccgcaggctccgaggggaagggctggagtgggtctcctttatttacagcagtgtagtacntattccnagactccgtggaggggccagttccaccatctaccagagacaactcaagaacacgctgtttctacaaatgaaacncgcgagagacgaccgagcgacgaccggcgttagtacttacgtgtgacgagagcgcgggacccgaacggtaacgttacacgtgtagtcggacgtcggtcgggaccgacgggaccgtacgg

SEQ ID NO: 269634 - DNA, 635 bp, Homo sapiens
  misc_feature: GYAE6OF02F5KAT.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaggggctggagtgggtctcctttattacagcagtggtagtacatattccgcagactccgtggacggggccattcaccatcctccagagacaactctaagaacacgcttgtttcctacaaatcgaacacgcctaggacgacggcccgatacggaccgaccgggccgttgttaatttaccgtggttcggacgaacggaggtacggtcggggggaccccctaacgggtaaacccggtttaccgtaaccggtacgttaacggtacggggtaaccggttaccgggtacggggggaacccgtaacggggggacccctaacccgggg

SEQ ID NO: 269635 - DNA, 566 bp, Homo sapiens
  misc_feature: GYAE6OF02G4NRN.11.25.C03.1.454.CMB.1.raw
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaagggctggaggtgggtctccttttattacagcagtggtagtacatattccgnagactcgtgacggggcattcacatcctcaganacaactctaaagacacgctgtttctacaaatgaacacgcctagagacgccgaatcgaccgacggccgtagttacttactggtcgacgagagagtcggggaccctaacggtaaccgttactacgactagtcggacgtcggtacggggacctaaggggaccctaccggg

SEQ ID NO: 269636 - DNA, 470 bp, Homo sapiens
  misc_feature: GYAE6OF02GT43E.11.25.C03.1.454.CMB.1.raw
  modified_base (463)..(470): a, c, t, g, unknown or other
  misc_feature (463)..(470): n is a, c, g, or t
tcagcgagagataccacgaccggtgctcgatttagtagtgtagatttgggtttgggggggaagaggaagactgacggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggctacttccgtatctctcgctgagcgggctggcaaggcgcatagnnnnnnnn

SEQ ID NO: 269637 - DNA, 637 bp, Homo sapiens
  misc_feature: GYAE6OF02F2Q76.11.25.C03.1.454.CMB.1.raw
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (410)..(410): a, c, t, g, unknown or other
  misc_feature (410)..(410): n is a, c, g, or t
tcagcgagagataccacgaccggtgctcgatttagtagtgtagatttgggtttggggggagaggagcccagcactgggattccgagggtcgtttccattcggtgatcaggcactgaaaacagaggactcaccatgggagttttggctgagctgggttttccttgttgctattttaaaacggagtccagtgtcgacggtgcgtctggtggagtcgtgggaggaggcctgatccagccgtggggggtccctggagactctcctgtgcagcctctgggttacaccgtcagtcaaccaacctacatcgagttcgggtccgcaggctccgaggggagggctggagtggtctctttatacgngcagtgtagtacatntccgnagacctcggtggacgggcctattccacctatccnccagacgacaactcgtaagaaccacgtcttagtttacttacaaatcgaaacctgtccctaggaacgacgtaccggaagttcgaacccgtacgggtcccgttagtaacttaaccgtgtacgacggaagagaacgtacggggacccctaaggtaaaccgttacgtaccgacttaacggtcgggtaccgttccggtacggggacccaacggggtacccctacgggtaccc

SEQ ID NO: 269638 - DNA, 554 bp, Homo sapiens
  misc_feature: GYAE6OF02HOOZW.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctggttcaccgtcagtcacacctacatgagttgggtccgccaggctccgagggaaggggctggagtggtctcctttattacagcagtggtagtacatattccgcagactccgtgacgggccgaattcaccatctccagacgacaactacaagaacacgctcgtttcttacaaatgaacagcctgagagccgatgacacggcgtgtattactgtgcgagagagtcggggacccaacggtaaccgttacgacgtcctaagtcggaccgtcgtcgggggaccaaggggaccctaaccggg

SEQ ID NO: 269639 - DNA, 585 bp, Homo sapiens
  misc_feature: GYAE6OF02G3WZD.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgagggagggctggagtgggtctctttattacagcagtggtagtacatattccgcagactccgtggacggggccagttccacctatcctaccagacgacaactactaaagaccacgtcttagtttctacaatgaacacgcctgagacgccgagtcgaaccgacggtccgtagtacttacgtggtgcgagagaggtccggggaccctaacggtaaccgttactaaccgacttaggtcggtaccggttcggcgggggaccgaacggggaccctacccggg

SEQ ID NO: 269640 - DNA, 681 bp, Homo sapiens
  misc_feature: GYAE6OF02H0OZH.11.25.C03.1.454.CMB.1.raw
  modified_base (372)..(372): a, c, t, g, unknown or other
  misc_feature (372)..(372): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccgccgaggcctccgaggggaaggggctgggagtgggtcttcctttattacagcagtggtagtacatacttccgnacgacctccggtggacggggccattccacctatcctccagacgacctaactacgtaaagaaccacgtcttagtttacctactaaaatgaaacctagccgtagaagacgaccgaagtcgaacccgaccgggtccgttaggttaactttaccgtggtacgaccggaagacgggtacgttccggggggaccccctaaaccgggttaaacccggtttaccgtaaccccggtacgttaacggttaccggggaacccggttaccgggttaccgggggggaaccccgtaaaccggggggaacccctaaccccgggg

SEQ ID NO: 269641 - DNA, 666 bp, Homo sapiens
  misc_feature: GYAE6OF02GE1CS.11.25.C03.1.454.CMB.1.raw
  modified_base (501)..(501): a, c, t, g, unknown or other
  misc_feature (501)..(501): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttcttgttgctatttaaaaggagtccagtgtgaggtgcgtctggtggagtcgtggaggaggcctgatccagccgtgggggtccctgagactctcctgtgcagcctcgtggttcaccgtcagtcacacctacatgaggttcgggtcccgccgaggcctccgagggggaaggggctgggaggtgggtcttccgtttatttacagtctaggtggtagtactatacttccgacacgcctccggtggacggggtccgtaattcccacctacttccctaccgaaggtaccgaacctaaaccgttaacgtaaaacggaacctaaccgtctttcgttttactacaaaagttcgaaaccncggtaccctaggaacgtacgcccgtaatcgaaccgaccggtacgttagttaacttaccgtgtcgaccgtaagacggacgtaccggggacccaaacgggtaaccttaccgtacgtcgttaaggtcggaccggttcgtacggggaccctaacgggacccgtaccggg

SEQ ID NO: 269642 - DNA, 593 bp, Homo sapiens
  misc_feature: GYAE6OF02GJ5AF.11.25.C03.1.454.CMB.1.raw
  modified_base (489)..(489): a, c, t, g, unknown or other
  misc_feature (489)..(489): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggcctccgaggggaaggggctggaggtgggtctcctttattacagcagtggtagtacatattccgcagactcgtgacgggcattcaccatctccagagacaactctaaagaacacgcttgtttactacaaatgaaacagcctagagacgcccgaatcgaaccgacgggccgttaggtaactttacgnggtcgacggagaggacggtcggggaccccaacgggtaaccgttaccgtacggtccttaggtcgggaccgttccggtacgggggacccaaggggaccctaccggg

SEQ ID NO: 269643 - DNA, 686 bp, Homo sapiens
  misc_feature: GYAE6OF02FXGUN.11.25.C03.1.454.CMB.1.raw
  modified_base (294)..(294): a, c, t, g, unknown or other
  misc_feature (294)..(294): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcgtggtttcgtgtaggctattaaagagtcagtgtgaggtgcgtctggtggagtctggaggaggcctgatccagccgtggggggtccctgagactctcctgtgcagcctctgggttcaccgtcagtcacacctacatgagttgggtccnccgaggcctcgaggggagggctgggagtcgggtctcctttattacagctagtggtagtacagttacttccgactacgaccgttccggtagggaacggggccctaatttccgaacctatccctaccgaggaacgacctaaacttctaaaggaacctacgtcttcgtttcttacgaaattcgaaacacgcctaggaagaccggtccaagtacgaccgtaccgggtacccgttaggtacttttaccgtggtacggacgtaaggacggtacgggtaccgggggaaccccttaaccgggtaaacccggtttacgtaacccggtacgtttacggtacgggttacccggttaccggggttaccgggggaacccgtaacggggacccccttaacccgggg

SEQ ID NO: 269644 - DNA, 622 bp, Homo sapiens
  misc_feature: GYAE6OF02H34BX.11.25.C03.1.454.CMB.1.raw
  modified_base (428)..(428): a, c, t, g, unknown or other
  misc_feature (428)..(428): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtggttcaccgtcagtcacacctacatgagttgggtccgccaggcctccgaggggaaggggctggagtggtctccttttattacagcagtggtagtacatacttccgcagcctcgtggacggggccattccacctatcctaccagacgaacaactactaaacgaaccncgtcttgtttacctacaaaatcgaaacagtcctagaacgacgccgagtcgaaccgaccgggtccttaggttaactttcgtggtcggaccgtaagacggaggtccgggggaccccaaacgggtaaccgtttacaaccgtacttaggtcgggaccgtcggttacgggggacccaacgggggacccctaacccgggg

SEQ ID NO: 269645 - DNA, 632 bp, Homo sapiens
  misc_feature: GYAE6OF02H1WLD.11.25.C03.1.454.CMB.1.raw
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
  modified_base (419)..(419): a, c, t, g, unknown or other
  misc_feature (419)..(419): n is a, c, g, or t
  modified_base (473)..(473): a, c, t, g, unknown or other
  misc_feature (473)..(473): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggtctgagctgggtttttccttgttgtctattttaaaaggtagtcctagtgtgaggtgcgtntggtggagtctggaggaggcctgatccgagccgtggggggtccctagagactcgtccngtgacagcctcgttggttcaccgtcacgtcacacctacatgagttgggtccgccagctcaggggaagggtcnggtagtcggtcttccttttattangtcagtggtatacatattcgnagctcgngagggtcatcnccatctcagagacactactaagaacncgactgtttacttacaaatagaactagaccttgaagcgacgacgtaggaacccnccggaccgttgttaacgtttacctggtcgacggtaacggacggtaagttccgggggacccctaaaccggttaaaccgtttaccgaaccggttactaacgggttaggaaccccggttccggtacggggggtaacccaaccgggggaacctacccccgggg

SEQ ID NO: 269646 - DNA, 569 bp, Homo sapiens
  misc_feature: GYAE6OF02G60JW.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtggttcaccgtcagtcacacctacatgagttgggtccgccgaggctccgaggggaaggggcgtggagtgggtcttcctttatttacagcagtggtagtacatacttccgcagactccgtgacggggccattcacatctcagagacaactactaagaacacgctagtttctacaaatgaacagcctgagacgcgatgacacggcgtagtacttactggtgcgagagacgtcggggaccctaacggtaaccgttacgtaccgacgtagtcggacgtcggtcggggacccgtaacggggaccctaccggg

SEQ ID NO: 269647 - DNA, 551 bp, Homo sapiens
  misc_feature: GYAE6OF02GX6WU.11.25.C03.1.454.CMB.1.raw
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgagggaaggggctgggagtgggtctcctttattacagcaggtggtagtacatattccgcagactccgtggaggggccattcaccatctccagacgacaactcaaagaacacgctgtttctacaaatgaaacagcctgagagccgatgaccacggccgtgtattactgtgcgagagagtcggggacccaggtaacgttactacgcttagtcggacgtcgtggggaccaagggccctaaccgg

SEQ ID NO: 269648 - DNA, 599 bp, Homo sapiens
  misc_feature: GYAE6OF02JMJIJ.11.25.C03.1.454.CMB.1.raw
  modified_base (299)..(299): a, c, t, g, unknown or other
  misc_feature (299)..(299): n is a, c, g, or t
  modified_base (373)..(373): a, c, t, g, unknown or other
  misc_feature (373)..(373): n is a, c, g, or t
  modified_base (497)..(497): a, c, t, g, unknown or other
  misc_feature (497)..(497): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactcgtcctgtgcagcctctgggtcaccgtcagtcacacctacatgagttgggtccnccagtctccgaggggaacgggctgggagtgggtcctcctttattaccagctaagtggtagtacatacttccggntagactccgtaggacggggtcctagttcaaccatctaccgagacgaacaactcgtaaagaacacgtctagtttctacaaatgaacacgcctgagacgccgatcgacacggcctagtattaccgngtacgacgtaggagtacgtacggggaccctaacggtaacgttaccgtaacgccgttagtccgggaacgttccgaggggtaacccaacggggcccctaacggg

SEQ ID NO: 269649 - DNA, 633 bp, Homo sapiens
  misc_feature: GYAE6OF02G1H8M.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgagggagggctggagtgggtctctttattacagcagtggtagtacatattccgcagactcgtggagggccattcacatctccagacgacaactctaaagaacacgtctgtttctacaaatgaactagccctagagacgccgaatcggaaccgaccggtcccgttagttacttaacgtgggtagaccgagaacggtacggttaccgggggaccccctaacgggtaaaccggttttaaccgtacccggtaacgttacggttacggggtaacccgggttccggtaaccgggggggaccccgtaaagggggtacccccgtaacccgggg

SEQ ID NO: 269650 - DNA, 650 bp, Homo sapiens
  misc_feature: GYAE6OF02JF3PJ.11.25.C03.1.454.CMB.1.raw
  modified_base (297)..(297): a, c, t, g, unknown or other
  misc_feature (297)..(297): n is a, c, g, or t
  modified_base (401)..(401): a, c, t, g, unknown or other
  misc_feature (401)..(401): n is a, c, g, or t
  modified_base (552)..(552): a, c, t, g, unknown or other
  misc_feature (552)..(552): n is a, c, g, or t
  modified_base (565)..(565): a, c, t, g, unknown or other
  misc_feature (565)..(565): n is a, c, g, or t
  modified_base (598)..(598): a, c, t, g, unknown or other
  misc_feature (598)..(598): n is a, c, g, or t
tcagcgagagataccacgaccggtgctcgatttagtagtgtagattgggtttggggagaggagcccagcactgggattccgaggtgtttccattcggtgatcagcactgaacacagaggactcaccatgagttttggctgagctggttttcctgttgctattttaaaaggagtaccagtgtgaggtgcgtctggtggagtctgggaggacgctgatccagccgtgggggtccctggagacctctcctgtgcagcctcgtggttcaccgtcagtcacaccttacatgagtttcggccnccaggctccgaggggacggggctgggatcgggtctcctttagttacagcagtgtagtacattactcgacagtactccggaggacggggacctatttccgaaccnttccgtacccagtacgaacctaaaccttcgaaaacgaacctccggtactttacgttttacccgttaacaaaagttacgaaacctacggtaccctggaacgacgaccgtaactaggaccctaagggtcccgttagtacgttaactcggtaanccgggagtacggngaccgggtacccaacgttaaccgttaggtaccnccgttaagtcgggtccgttggaccccggggtagaacccggacgtaacccggg

SEQ ID NO: 269651 - DNA, 581 bp, Homo sapiens
  misc_feature: GYAE6OF02HILO7.11.25.C03.1.454.CMB.1.raw
  modified_base (343)..(343): a, c, t, g, unknown or other
  misc_feature (343)..(343): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctcgtgggttcaccgtcagtcacacctacatgagttgggtccgccaggctccgaggggaagggctggagtggtctcctttattacngcagtggtagtacatatccgcagactcgtggaggggccattcaccatctccagacgacaactctaaagaaccacgtcttgtttctacaaatgaaacagcctagagacgccgatcgaccacgggccgttgtaacttacgtggtcgacgaagagacggtcggggacccctaaggtaaccgttacgtaccgtactaggtcggaccgtcggtacgggggacccaacggggaccctaaccggg

SEQ ID NO: 269652 - DNA, 647 bp, Homo sapiens
  misc_feature: GYAE6OF02HQ598.11.25.C03.1.454.CMB.1.raw
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagcgagagataccacgaccggtgctcgatttagtagtgtagatttgggtttggggggagaggagcccagcactgggattccgaggtgtttccattcggtgatcagcactgaaaacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttccaccgtcagtcacacctacatgagttggccgcaggcgtccggggagggctggagtggtctctttattacngcagtggtatacatatccgnagactccgnggacgggcattccaccatcctaccagacgaccaactactaagaacacgcttgtttcttacaaatacgaacacgtacctagaagacgaccgagtaccccccgagaccgggtaccgttacgtaacttacgtagttacggacggaaggaaggtacggtaccgggggacccgtaaccggtaaaccggtttaaccgtaaccgtacgttaacggttacgggaccggttaccgggtacgggggacccggaaaccggggaacccggtaccgggtaccgtaaccccgg

SEQ ID NO: 269653 - DNA, 744 bp, Homo sapiens
  misc_feature: GYAE6OF02HWNC0.11.25.C03.1.454.CMB.1.raw
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtcgtgggaggaggcctgatccagccgtggggggtccctgagactctcctgtgcagccttcgtgggttccaccgtcagtcacacctacatgagttcgggtccgcaggcctccgaggggaacggggctgggagtggtctccttttattacagcaggtggtagtactataacttccgacgagtaccgtccggtaggacgggggcctaatttccgaacctatcctccgagaacgaccaaactactaaagacctacgtcgtttagtttccttaacaaaagttacgaaaccgtacgcccgttaggaacgtacggacccgtaagtaccggaaccgtacccgggtacccgtttaacggttaacgtttaacctcgggtacggtaccggtaagggtacggtaacgggtcccgggggaacccccgttaaacgggttaaaaccccggtttaccgtaaacccggtaccgttaacgggtttaccgggaacccgggtttccgggtacccgggggggtaacccgtaaacccgggggaaccccgttaacccccgggg

SEQ ID NO: 269654 - DNA, 560 bp, Homo sapiens
  misc_feature: GYAE6OF02GLP3J.11.25.C03.1.454.CMB.1.raw
  modified_base (364)..(364): a, c, t, g, unknown or other
  misc_feature (364)..(364): n is a, c, g, or t
  modified_base (493)..(493): a, c, t, g, unknown or other
  misc_feature (493)..(493): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctatgcagcctctgggttcaccgtcagtcacacctacatgagttgggtccgccaggctccgaggggagggctggagtgggtctccgtttatttacagcagtggtagtacatattccgnagactccgtggacggggccgtattccaccatcctaccagacgaacaactctaagaacacgtcttgtttcttacaaatcgaaacacgcctaggacgagccgatcgacagtggccgttgtattcgtgtcgngagagagtcgggcccaagtaaccgttacacgtctagtcggaccgtcgcggggtaccaagggtacccg

SEQ ID NO: 269655 - DNA, 603 bp, Homo sapiens
  misc_feature: GYAE6OF02FXOJ0.11.25.C03.1.454.CMB.1.raw
  modified_base (303)..(303): a, c, t, g, unknown or other
  misc_feature (303)..(303): n is a, c, g, or t
  modified_base (399)..(399): a, c, t, g, unknown or other
  misc_feature (399)..(399): n is a, c, g, or t
  modified_base (450)..(450): a, c, t, g, unknown or other
  misc_feature (450)..(450): n is a, c, g, or t
  modified_base (502)..(502): a, c, t, g, unknown or other
  misc_feature (502)..(502): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctattttaaaaggagtccagtgtgaggtgcgtctgggtggagtctggaggaggcctgatccagccgtggggggtccctgagactctcctgtgcacgcctcgtgggttcaccgtcagtcacacctacatgagttgggccnccaggctccgaggggaagggctggagtgggtctcctttattacagcagtgtatacatatccgcagactccggtggacgggcctattccaccatccncagacgaacaactacaaagaaccacgtcttgtttactacaaattgaaaccncgcctagaagaccgccgaatcggaaccgacgggtccgttagttactttacgngtacgacgagagacggtcggggaccctaacggtaaccgttaccacggtacttaggtacgggtaccggtccggacggggacccaacggggccctaacccggg

SEQ ID NO: 269656 - DNA, 600 bp, Homo sapiens
  misc_feature: GYAE6OF02FLIBC.11.25.C03.1.454.CMB.1.raw
  modified_base (361)..(361): a, c, t, g, unknown or other
  misc_feature (361)..(361): n is a, c, g, or t
  modified_base (500)..(500): a, c, t, g, unknown or other
  misc_feature (500)..(500): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttcgtgtaggctatttaaagagtcagtgtgagtgcgtctggtggagtctggaggaggcccgatccgagccgttggggggtccctggagactctcctgtgcagcctcgtgggttcaccgtcagtcacacctacatgagttggtccgctaggctccaggggaagggctgggagtgggtctccgtttattacagcagtggtatacattatccgnagactcgtaggaggggccagttcacatcgtccagacgtacaacgttctaaagaactacggaccttgtttactacaaactgaaacctaggcctagagaacgcccgtaatcgtaccaaccgggtccgtagttactacgttnacggtcgaagtcgagttcggggaccccaacggtaacgtttacacgtactaacggtcggtacgttccgggagggtcccaacggggtacccaccggtaccgg

SEQ ID NO: 269657 - DNA, 630 bp, Homo sapiens
  misc_feature: GYAE6OF02HE382.11.25.C03.1.454.CMB.1.raw
  modified_base (284)..(284): a, c, t, g, unknown or other
  misc_feature (284)..(284): n is a, c, g, or t
  modified_base (361)..(361): a, c, t, g, unknown or other
  misc_feature (361)..(361): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctanatgagttcgggccgccaggcctccgagggagggctggagtggtctctttattacagctagtgtagtacatatccganacgacgtccgtggacgggcctattccaccatcctccgagacgactaactactaaacgaacacgtcgttacgtttactaacaaagtcgaaccacgcccgttaaggacgaccgtacccgaagttccggaaccgtaccgggtcccgttagttaaccgtttaccgtggtcggacggtagtacggacgttcggggaacccctaaggaaccgtttacaccggacttagtacgggtaccttacgggtacggggaccctaacggggtccctaccggg

SEQ ID NO: 269658 - DNA, 794 bp, Homo sapiens
  misc_feature: GYAE6OF02H89AH.11.25.C03.1.454.CMB.1.raw
  modified_base (177)..(177): a, c, t, g, unknown or other
  misc_feature (177)..(177): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagccgtggggggtccctgagactctcctgtgcagcctctgggttcaccgtcagtcaccacctacatgagttcgggtccgccaggctccgaaggggaaggggctgggaggtgggtccttccttttaattttacgagtcgaggttggtaagtacctaattacttccgacaacgacctccggttggacgggggtccgatttacccgaacctacttcccgtaccgtaacggaacgaacctaaaccttaacgtaaaacggtaaaccaaccggttccttacgttttaacttactaaaactacgaaactacgaccttaggaacggacggacccgtaagtacggaaccgaacccgggtccgttaacggttacgttttaaccgttaggtacggtaaacggttaaaacgttactttttaccgttaaggttaacgggtaacggggtttaaccgggtaaaccggggtttaaccccggggggggttaccgttttaccggtttttaacgggtaaacccggtttaacccgggttaccggggggaacccccgggttaaccgggggtaacccccggtttaacccgggg

SEQ ID NO: 269659 - DNA, 617 bp, Homo sapiens
  misc_feature: GYAE6OF02F9Y5N.11.25.C03.1.454.CMB.1.raw
  modified_base (466)..(466): a, c, t, g, unknown or other
  misc_feature (466)..(466): n is a, c, g, or t
  modified_base (511)..(511): a, c, t, g, unknown or other
  misc_feature (511)..(511): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtcccgcaggctccgaggggaagggctgggagtcgggtcttcctttatttacgagtcaggttaggtagtactatacttccgcaagtactcggtgacggggccattccaccgatcctaccaggacgtaaaccactacaaagaacacgtcttcgtttactacaaatggaaaccngtcctagacgacgcgagtcgaacgacggtccgtgttaattaccgngtcggagagaggacgtcggggaccctaacggtaaccgttaccgaacgttgtaacggttcgggtacgtaccgggttggggaccccgaagggggtcccctaaccgggg

SEQ ID NO: 269660 - DNA, 656 bp, Homo sapiens
  misc_feature: GYAE6OF02H1YQT.11.25.C03.1.454.CMB.1.raw
  modified_base (343)..(343): a, c, t, g, unknown or other
  misc_feature (343)..(343): n is a, c, g, or t
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgactattttaaaaaggagtccagtgtgaggtgcgtctggtggagtcgtggaggaggcctgactccaggccgtggggggtcccctgacgactctcctgtgcagcctcgtcgggttcaccgtcagtccacacctacatgaggttcgggccgccaggcctcggaagggggacggggcgtgggnggttcggtcctttaccgttttattacagctaggtggtaagtactatacttccganacgactccggtggacgggcattccaactntcctacagacaacactactaaagaccacgtcttgttacctacgaaatacgaacagtccgtagagacgccgtatacggaacctaccgggtaccgttgttaacttacgtggcgtaacggaagttacgagggtccggggtaccccaaagggttaaaccgttacgtaaccgtcgttaacggtcggtaccggttacggaccgggggtaacccgtaacggggaccctaaccgggg

SEQ ID NO: 269661 - DNA, 686 bp, Homo sapiens
  misc_feature: GYAE6OF02IQ2R7.11.25.C03.1.454.CMB.1.raw
  modified_base (180)..(180): a, c, t, g, unknown or other
  misc_feature (180)..(180): n is a, c, g, or t
  modified_base (306)..(306): a, c, t, g, unknown or other
  misc_feature (306)..(306): n is a, c, g, or t
tcagcgagagataccacgaccggtgctcgatttagtagtgtagatttgggtttgggggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgactccagccgtggggggtccctgagactctcctgtgcagcctcgtggttcaccgtcagtcaccacctacatgaggttgggtccnccgaggctccgaggggaagggctggagtgggtctctttattacagcgagtggtatactatacttccgcagtacctccggtaggacgggggacctattccacctatcccgtacaggacgacctaaactctaaagaaccacgtcgttagtttacctacgaaactagtaacacgcctagacgacgccgaatcggaaccaccgggtacgttacggttacttaacgttggtacggacgaagggaacgttacgggtaccggggtaacccccgtaacgggtttaaaaccggttaacccgttaacggtaccgttaacggttaccggggtacgggttccggttaccggggggggacccctaaaacggggggtaccccgtaaccccgggg

SEQ ID NO: 269662 - DNA, 657 bp, Homo sapiens
  misc_feature: GYAE6OF02JCFM1.11.25.C03.1.454.CMB.1.raw
  modified_base (403)..(403): a, c, t, g, unknown or other
  misc_feature (403)..(403): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagtttggctgagctgggttttccttgttgctattttaaaaggagtccagtgtgaggtgcgtctggtggagtcgtggaggaggcctgatccagccgtcgggggtcctgagctctcctgtgcagcctcgtgggttccaccgtcacgtcactacctacatgtaggttcgggtccgccgaggccgtaccggaacggggaaggggccgtgggaggttcgggttccttccgtttaagtttacgagtcgtaggttggtacgtactagttactccganacgactccgtggacgggacctatcacctatctccgagacgaacctaaactactaagaacctacgctttacgttctaacaagtgaactacgactaggagacgtacgatcggaaccacggtccgtagttaacgtacgtcgtagaacgtacgtaaggtcgtaccggggaccctaaacgggtaactttaccggtaaccgtacgtaggtaccgggtaccgtcgggtaaccgggccggtaaaccggggccccgtaccggg

SEQ ID NO: 269663 - DNA, 575 bp, Homo sapiens
  misc_feature: GYAE6OF02FR6PJ.11.25.C03.1.454.CMB.1.raw
  modified_base (299)..(299): a, c, t, g, unknown or other
  misc_feature (299)..(299): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (439)..(439): a, c, t, g, unknown or other
  misc_feature (439)..(439): n is a, c, g, or t
  modified_base (486)..(486): a, c, t, g, unknown or other
  misc_feature (486)..(486): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccnccgaggctccgaggggagggctggagtgggtctcctttatttacgagcagtggtagtacatattccgcacgactccggtgacggggccattcaccntcctcaganacactcaaagacacgcttgtttctacaaatgaacngccctagacgaggccgagtgaaccaccgggccgttagtactttacgngtcgacgagagtacgtcggggaccctaggaaccgtttaccacgacgtatacgggactcggttacggggccgtaaggggaccctaccggg

SEQ ID NO: 269664 - DNA, 599 bp, Homo sapiens
  misc_feature: GYAE6OF02G2HQE.11.25.C03.1.454.CMB.1.raw
  modified_base (368)..(368): a, c, t, g, unknown or other
  misc_feature (368)..(368): n is a, c, g, or t
  modified_base (451)..(451): a, c, t, g, unknown or other
  misc_feature (451)..(451): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccgccaggctccgaggggaagggctggagtgggtctcctttattacagcaggtggtatacattattccgnagactccggtggacggggccattcaccatcctaccagacgaacaactactaaagaaccacgcttcgtttctacaaatgaaacngcctgagacgccgatcgaaccgaccgggtccgttagttacttacgtggtacggacgagagacgtcgggggacccaacggtaaccgttactaaccggtacgttagtcgggtacgttccggacgggggacccaacggggaccctaccggg

SEQ ID NO: 269665 - DNA, 707 bp, Homo sapiens
  misc_feature: GYAE6OF02JBTPQ.11.25.C03.1.454.CMB.1.raw
  modified_base (413)..(413): a, c, t, g, unknown or other
  misc_feature (413)..(413): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggtttttccttgttgctattttaaaaggagtccagtgtgaggtgcgtctggtggagtctggaggaggcctgatccagccgtgggggtccctgagactctcctgtgcagcctctcgggttcaccgtcagtcacacctacatgagttcgggtccgccacggctccggagggaacgggctggaggtcggtctaccttttattacagcgtagtggtatacattactccgacacgtacgtccgtaggacggggacctattaccaacctntacctaccgtaagacggtaaccctaaactacgtaaacgaaaccgtaccgtcgtttacgtttctaacgtaaaatacgtaaaccacgtcccttaggaacgtacggacccggtagtaccggtaaccgacccgggtccgttaacggtttaaccttacgttcggtacggtaccgaaggtaacgtaggttaccgggggaacccctaaacggggtaaccttaaccggtaaccgtaccgttaggttaacgggtaccggtacggttacccggggacccgttaacgggggacccctaacccggg

SEQ ID NO: 269666 - DNA, 859 bp, Homo sapiens
  misc_feature: GYAE6OF02HUVWU.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgtcttaagttttaaaaggagtccagtgtaggtaggtgcgttcgtggtggagtgtagggaggacggtcctgactaccgacgggtccggtcgggggtccctagacgtaccttcctccgtgtcgacgtaccgtccgttcggttcggtaccctaccggtacacgtaccaaccgtacctaacgtagtacggtaccgggttcccgggtaccgacccggtaccggacccggtacggggaaagggggtacgggtcggtaggttacggtttccggttaccttttaccgttttaacgacgtacggttacggtaagttacggttaagtacttaaccgtaccgttccgacggtacgttacccgggtacggtaccgggtaccggtacctaaccttaacgacccgttataccgaacctaacgaacgtaacctaaccgtaacgtaaaccgtaccgttaacgtttacgttaactttaaccgaacgttaagaaccgacgttaaccgcgtaaaccgggtaccgacggaccgtaacgtaccgtaccgggttacgtacggttacgtaaccggttagaaccgggtacgaaacgggacgttaacccgggaccgggttaacccgtaccgtaacggttaaccgtaccggtccggtaaccggtacggtccgtaaccgggaccgggtaccggtaaccccgtacccgggtacgttacccccgg

SEQ ID NO: 269667 - DNA, 635 bp, Homo sapiens
  misc_feature: GYAE6OF02HR6PA.11.25.C03.1.454.CMB.1.raw
  modified_base (302)..(302): a, c, t, g, unknown or other
  misc_feature (302)..(302): n is a, c, g, or t
  modified_base (442)..(442): a, c, t, g, unknown or other
  misc_feature (442)..(442): n is a, c, g, or t
  modified_base (494)..(494): a, c, t, g, unknown or other
  misc_feature (494)..(494): n is a, c, g, or t
  modified_base (518)..(518): a, c, t, g, unknown or other
  misc_feature (518)..(518): n is a, c, g, or t
  modified_base (569)..(569): a, c, t, g, unknown or other
  misc_feature (569)..(569): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccnccgaggcctccgaggggaaggggctgggaggttcgggtccttccttttatttacagtcaggtggtagtacattactccgcacgctccggtggcggggcctattcaccatcctccaagacaacaactacgtaaagaaaccncgtcttgtttctaacaaatcgaaacagcctagacgagcccgtatcggaaccncgggtaccgtaggttactttacgnggttcgacgtagacggaggtccggggacccctaaaggtaacccggtttaanacccggtacgttacgtcgggtaccggttcggtacgggggacccgtaacggggacccctaacccggg

SEQ ID NO: 269668 - DNA, 607 bp, Homo sapiens
  misc_feature: GYAE6OF02H6V33.11.25.C03.1.454.CMB.1.raw
  modified_base (260)..(260): a, c, t, g, unknown or other
  misc_feature (260)..(260): n is a, c, g, or t
  modified_base (386)..(386): a, c, t, g, unknown or other
  misc_feature (386)..(386): n is a, c, g, or t
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagcccacctcagtgtccgtgtccccaggacagacagccagaactccctgctctggattgattgagagaataatattacttgttggtatacaanaagaacgccagcctacgtcccttgtattggtcatctatacaagtatgtaggaacggccggtccccacgacgggtactccccgtgacgtcgtacttctcgtcggcctacctactcgtacgggaaccncgacgaccctacctcgtacgacctacgtccgacgggcccggaacccgtaggtactagtgggatggaggtctagtacttatttagtcgtacgcggggtcggtagggactacggcgtacgcctacgtccggtacccgtttaagtcgttaccgttacggaacgtcgggaacctaggtccctaccgtgtcgacggtacaccggaccctaccggaccctaaccccg

SEQ ID NO: 269669 - DNA, 599 bp, Homo sapiens
  misc_feature: GYAE6OF02JGPQI.11.25.C03.1.454.CMB.1.raw
  modified_base (273)..(273): a, c, t, g, unknown or other
  misc_feature (273)..(273): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
  modified_base (438)..(438): a, c, t, g, unknown or other
  misc_feature (438)..(438): n is a, c, g, or t
  modified_base (474)..(474): a, c, t, g, unknown or other
  misc_feature (474)..(474): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggagggaggcctgatccagcctggggggtccctgagactctcctgtgcagcctctgggttcaccgtnagtcacacctacatgagttgggtccgccaggcctcgagggaagggctggagtgggtctcctttattacagcagtggtagtacatatccgacagactccgngagggcctatccacatcncagacacactcaaagacacgctgttctacaaatgaacagcctgaagngaccgatcgacgaccgggccgttagtaactttacgngtcggtacgaggtacggagtccgggggaccccaaccgggtaaaccgtttaccgaaccggtacgttaacgttggggaacccgttacgggtacgggggacccgtaacggggaccccgtaacccgggg

SEQ ID NO: 269670 - DNA, 547 bp, Homo sapiens
  misc_feature: GYAE6OF02GVBJP.11.25.C03.1.454.CMB.1.raw
  modified_base (340)..(340): a, c, t, g, unknown or other
  misc_feature (340)..(340): n is a, c, g, or t
  modified_base (436)..(436): a, c, t, g, unknown or other
  misc_feature (436)..(436): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggcctccgagggagggctggagtgggtctcctttattacngcaggtgtagtacatattccgcagactccgtgaggggccattccaccatcctcagacgacaactctaaacgaacacgcttgttctacaaatgaacngcctgagagccgatcgacgacggccgtgtattactgtgacgagagagtcggggacccaaggtaacgttaccacgtctagtggacgtcgtggggcccaagggccctaaccgg

SEQ ID NO: 269671 - DNA, 569 bp, Homo sapiens
  misc_feature: GYAE6OF02FHH3W.11.25.C03.1.454.CMB.1.raw
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
  modified_base (446)..(446): a, c, t, g, unknown or other
  misc_feature (446)..(446): n is a, c, g, or t
  modified_base (485)..(485): a, c, t, g, unknown or other
  misc_feature (485)..(485): n is a, c, g, or t
tcagcgagagataccacgaccggtgctcgatttagtagtgtagatttgggtttggggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctggggttcaccgtcagtcacacctacatgagttgggtccgccaggctccgagggaaggggctggagtgggtctcctttatttacagcagtggtagtacatacttccgcagactccgtggacggggccgattcaccatccncagagacaactctaaagaacacnctgtttctacaaatgaaacngcctgacgagccgatcgacaccgggcgtgttaacttcgngttgacgaggagtagcggggacccaacgtaaccgttactacgctagtcggacgtccggtaggggaccctaaggggccctacggg

SEQ ID NO: 269672 - DNA, 614 bp, Homo sapiens
  misc_feature: GYAE6OF02JF9VY.11.25.C03.1.454.CMB.1.raw
  modified_base (297)..(297): a, c, t, g, unknown or other
  misc_feature (297)..(297): n is a, c, g, or t
tcagcgagagataccacgaccggtgctcgatttagtagtgtagatttgggtttggggagaggagcccagcactgggattccgaggtgttccattcggtgatcagcactgaacacagaggactcaccatggagttttggctgagctgggttttccttgttgctattttaaaaaggagtccagtgtgaggtgcgtctggtggagtctggaggaggcctgatccagcctggggggtccctgagactctcctgtgcagcctctgggttcaccgtcagtcacacctacatgagttgggtccncaggctccgagggagggctggagtggtctcttattacagcagtgtagtacatatccgcagactcgagaggggccattccacgatctccagagacaactctaaagaacagcttgtttactacgaaatcgaacagtccctaggagtacggccgtaagtacgaccaccgggtccgttacggttaacttaccgtagtacgacggagaacggagtaccggggggacccctaaacggtaaaccgtttacgtaaccggtaccttaaggtaccgggtacggttaccgggtccgggggaaccctaacggggaacccgtaacccggg

SEQ ID NO: 269673 - DNA, 713 bp, Homo sapiens
  misc_feature: GYAE6OF02HTLE2.11.25.C03.1.454.CMB.1.raw
  modified_base (179)..(179): a, c, t, g, unknown or other
  misc_feature (179)..(179): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggttttccttgttgctattttaaaaggngtccagtgtgaggtgcgtctgggtggagtctggaggaggcctgatccagccgtggggggtccctgagactctcctgtgcagcctcgtggttccaccgtcacgtcacacctacatgagttgggtccgcaggctccgagggaaggggctgggagtgggtcttctttattacagctaggtggtagtacatattccgcagtacctcggtggacggggcctattccgaacctactcctaccgaaggaagtaacccaaacgttacgtaaagaaaccgtaccgtactttagtttacctttaaccgaaaattccggaaaacctaggtacccgtaggtaaacgggaacggacccggtaagttacggaacccgtaccgggtacccggttagtttaacgtttaacccgttgggtacggacggtaaggtacggtacgggtaccgggggtaccccaacgggttaaaccgtttaccgtaaccgtacgtaacggttgggacccggttacggtaacgggggaccgaaacccggggtaccctaaccccggg

SEQ ID NO: 269674 - DNA, 651 bp, Homo sapiens
  misc_feature: GYAE6OF02HR3CO.11.25.C03.1.454.CMB.1.raw
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtcgggttcaccgtcacgtcacacctacatgaggttcgggtccgccgaggcctccgaggggaacggggctgggagtcggggttcttccgtttatttacagtcaggtggtagtactatacttccgcacgacgtccgtggacggggccgtattccaaccatctaccgagacgacaactactaaagaaccacgtacttgtttaccttacaaatacgaaactacgacctgaagacgaccgagtacgaaccgaccgggtccgttagttaacttacgttggtacgacggagaggacggtaccggggtaccccgaacggtaaaccgtttaccgtaacggtacgttaagtacggggtacgtaccggtacgggggaacccacggggtaccctaccggg

SEQ ID NO: 269675 - DNA, 614 bp, Homo sapiens
  misc_feature: GYAE6OF02GYD6A.11.25.C03.1.454.CMB.1.raw
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
  modified_base (446)..(446): a, c, t, g, unknown or other
  misc_feature (446)..(446): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtctggaggaggcctgatccagccgtggggggtccctgagactctcctgtgcagcctcgtgggttcaccgtcagtcaacacctacatgagttcgggtccgcaggctcgagggaagggctggaggtggtctcctttattacagnagtgtagtacatattccgnagcgttccgnggacgggcctattccaccatcctcaganacaactctaagaaccacgtctcgtttcttacgaaattcgaaacngacctgagacgccgatacggactaccggccgttagttaacttacgtgtggacgtaagtaggacgtcggggaccccgtaacggtaaccgttaaccgtaacggtaccgtaacgttggggtaacccgttacggggacgggggaccccgtaaacgggggacccgtaacccgg

SEQ ID NO: 269676 - DNA, 562 bp, Homo sapiens
  misc_feature: GYAE6OF02FJNLI.11.25.C03.1.454.CMB.1.raw
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (470)..(470): a, c, t, g, unknown or other
  misc_feature (470)..(470): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcccgtgggggggtccctgagactctcctgtgcagcctctgggttcaccgtcagtcacacctacatgagttgggtccgcaggctccgagggagggctggagngggtctccttatttacngcagtgtagtacntattccgnagactcgtggagggccgtattcaccatcctccagagacaactcaaagaacacgctgtttctanaatnaacngcctganagccagtgacacggccgtgtacttacgngttgcgagagtacgcggggacccaacgtaacgttaacgtaccgattagacggtaccgtcggtcggggacccgtaaggggaccccgtaaccgg

SEQ ID NO: 269677 - DNA, 644 bp, Homo sapiens
  misc_feature: GYAE6OF02FVF7H.11.25.C03.1.454.CMB.1.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttagtatacaacagaacgccaggcctacgtccctgttagttggtactattctatacaagtagtaggtaggaacggccggccctcggacgggtactcccgtggacggtcgtacttccgtcgtcgcctacctaactcggtacgggaacgcacgccctactctacgaccatcgacgggccgggaccgaggtctaggaggagtgggaggtctagtacttagtttagttcggtacgacgggtcggtacgggacgacggcgacgtaccgaacgtccggttacccgttagttcggttacgttaccgggtaaccggtcggggtaaccgtaacgggttcccgtaccggtttacgttacggtaccgtaccgaacccggtacccgtaaccggacccctaacccgg

SEQ ID NO: 269678 - DNA, 575 bp, Homo sapiens
  misc_feature: GYAE6OF02HIINP.11.25.C03.1.454.CMB.1.raw
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctccctgtgcagcctcgtgggttcaccgtcagtcacacctacatgagttgggtccgcaggcctccgagggagggctggagtgggtctctttattacagtcagtgtagtacatattccgcagactcccggtggacggggcctacttcaccctatcctccgagacgacaactactaaagaaccacgtcttgtttactacaaatcgaacagcctgacgagccgtaangaacncgggtccgttagtattactggtgcgaagaggagtcggggaccctaaggtaaccggttactacggctagtcggacgtcgtcggggacctacgggacctaccgg

SEQ ID NO: 269679 - DNA, 625 bp, Homo sapiens
  misc_feature: GYAE6OF02GJO6E.11.25.C03.1.454.CMB.1.raw
  modified_base (385)..(385): a, c, t, g, unknown or other
  misc_feature (385)..(385): n is a, c, g, or t
  modified_base (452)..(452): a, c, t, g, unknown or other
  misc_feature (452)..(452): n is a, c, g, or t
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagcccaccctcagtgtcccgtgtcccccaggacagacagccagaactcccctgctcgtggaattgaattgagagaataaatatacttgttaggtatcaacagaaagccaggccagtcccctgtattggtcatctatcaagtatgtgaacgccggccctgacgggactcccgtggagccgtattcctcgtcggtcctaccaacgtcgtacggggaaccncgacgcctacctcgtacgaccacgtcgacggccgggacccaggctacgtagggtactagggacggtntacggtaacttattacgttgtacggacggtcggttagggaccgacgccgagacctacgtcgtaccgttagtcgttaccgttacgggtaaccgttcgggtaaccgtacggtcccgtaccggttcgttacggacgttaccgtaccggacccgaaccgggtaccccctaaaccccg

SEQ ID NO: 269680 - DNA, 621 bp, Homo sapiens
  misc_feature: GYAE6OF02JX1LO.11.25.C03.1.454.CMB.1.raw
  modified_base (299)..(299): a, c, t, g, unknown or other
  misc_feature (299)..(299): n is a, c, g, or t
  modified_base (524)..(524): a, c, t, g, unknown or other
  misc_feature (524)..(524): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctatttaaaaggagtcagtgtgaggtgcgtctggtggagtctggaggaggcctgatccagccgtgggggtccctgagactctcctgtgcagcctcgtgggttcaccgtcagtcacacctacatgagttcgggtccnccaggctccgagggaagggctgggagtgggtcttcctttattacagcaggttgtagtacattactccgcagactccggtggacggggctattccaccatcctaccgagaacgaacccaacttcgtaaaacgaaccacggtctttgtttacctacaaagttcgaacagcctggaacgacgtccgatcggaccgaaccgggtcttacgtattaccgtgtcgaacggngtaagcggtccgggacccgtaacgttaaccggttacacggtactacggtcgggtaccgttcgggaccggggacccgaacgggtacccgtaacccggg

SEQ ID NO: 269681 - DNA, 667 bp, Homo sapiens
  misc_feature: GYAE6OF02IT5DO.11.25.C03.1.454.CMB.1.raw
  modified_base (341)..(341): a, c, t, g, unknown or other
  misc_feature (341)..(341): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgcaggctccgaggggagggctggagtgggtctctttattacngcagtggtatacatatccgcaacgacttcccggtggaagggggcccgtattccgacctactcctaccgaaggaactaacctaaacttacctaaaagaaccaacggttcctttacgtttaccttaaacctaaagtacgtaaaccgaacgttcccgtaggaacggtacggacccggtaataccggaaccgtaccgggtccgttaaggtttaaccgttacgttaggtcgaaccgggtagtacggtacgtaccggggacccaaacggttaacgttaacgacctagttacgtcgggtacgttcggacggggaccgtaacgggacctaccgg

SEQ ID NO: 269682 - DNA, 670 bp, Homo sapiens
  misc_feature: GYAE6OF02JFDDI.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactcctcctgtgcagcctcgtgggttccaccgtcagtcacacctacatgagttcggtccgccaggctccgaggggagggctggaggtgggtcttctttattacagtcaggtggtagtacattactccgcacgacctcggtggacggggcctaattccacccatcctacccgaaggtacgaaccaaacgttacctaaaagaacccgtaaccggtcctttacggttttaccttacgaaaaagttcgaaaacctacggtcccgtagaacgaacggacccgtaagtacggaaccgacccgggtacccgttggttacttaccgttggtcgtacggaaggtacgacggtccggggaccctaacggtaaccggttaccacggtctaagtcgggtacgtaccggtacggggacccgtacggggtaccctaccggg

SEQ ID NO: 269683 - DNA, 662 bp, Homo sapiens
  misc_feature: GYAE6OF02ITGKX.11.25.C03.1.454.CMB.1.raw
  modified_base (348)..(348): a, c, t, g, unknown or other
  misc_feature (348)..(348): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactcctcctgtgcagcctcgtgggttcaccgtcagtccacacctacatgagttgggtccgccgaggcctccgagggagggctgggagtgggtcttctttattacngctagtggtagtacattacttccgcacgtacgtccggtggacggggacctatttccacctacttaccgtccagaacgaaccaaactacgtaaacgaacaccggtcttacgtttactacaaagtacgaaactcgacccgttaggacgacggaccgtaagtcggaacccgaccgggtccgttagttaaccgttacgtgacggtacggaagtcggtaggtccggggaccctaacggttaaaccgttacgtaaccggtaccgttaaggtcgggtacggttccggtacggggacccgtaaccggggaccctaacccggg

SEQ ID NO: 269684 - DNA, 602 bp, Homo sapiens
  misc_feature: GYAE6OF02JG48B.11.25.C03.1.454.CMB.1.raw
  modified_base (464)..(464): a, c, t, g, unknown or other
  misc_feature (464)..(464): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctcgtgggttcaccgtcagtcacacctacatgagttgggtccgccaggctccgagggagggctggagtgggtctctttattacagctagtggtagtactatacttccgcagtactccggtggacggggtccgtagttaccacctactcctccaggaacgaaacctaaacgtactaaagaaccacgtcttcgtttactacaaatcgaacncgtcctgaagcgccgatcggaccacgggccgttagtaacttctggtacgcgagaggtcgtacggggaccctaacggtaaccgttacaacggtctaggtcgggtaccgtggtaccggggacaccgggacccgtaccggg

SEQ ID NO: 269685 - DNA, 562 bp, Homo sapiens
  misc_feature: GYAE6OF02H7VES.11.25.C03.1.454.CMB.1.raw
  modified_base (296)..(296): a, c, t, g, unknown or other
  misc_feature (296)..(296): n is a, c, g, or t
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
  modified_base (516)..(516): a, c, t, g, unknown or other
  misc_feature (516)..(516): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctgtggtcaccgtcagtcacacctacatgaggttggtccncgaggctccgagggaaggctggagtggctctttatcngcagtgtananatatccgnagctcgtggnggccattcacatcncagagacaacgtacaagaacacgcttagttacctacaaatcgaaaactcgccgtagaagacgccggatcggaccacggtccgtagtacttacgtggtcgacggaagtacgaggtcgggtacccaaaggtaaccggttacncgtactagtcggtacgtcggtacggggaccaaacggccgtaaccgg

SEQ ID NO: 269686 - DNA, 732 bp, Homo sapiens
  misc_feature: GYAE6OF02F20LJ.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcacgcctcgtgggttccaccgtcagtcacacctacatggagttcggtccgccgaggcctaccggaggggacgggcgtgggtaggtcgggtccttaccgtttattacagtcgtaggtaggtagtactattacgttccgacacgtaccgtccggtgggacggggtacctacgttaccaaccgtattcccgtaccgaaggaacgaacctaaacgtaaccgtaaacgaaaccgtaccgtcctttacgtttaccttaacgtaaatacgaaacacgtacccgtaggaacgacgaccgtaacgtacggaccgtacgggtccgttagttacgttaacgtgtacggtacggaaggtacggtacgggtacccggggtacccgtaaaccggtaaaccggtttaccgtaaccggttacgttaacgggtacgggttacccgggtccgggtaaccgggggtaacccggtaaccggggtaccccgtaaccccggg

SEQ ID NO: 269687 - DNA, 773 bp, Homo sapiens
  misc_feature: GYAE6OF02JSR8Q.11.25.C03.1.454.CMB.1.raw
  modified_base (178)..(178): a, c, t, g, unknown or other
  misc_feature (178)..(178): n is a, c, g, or t
  modified_base (256)..(256): a, c, t, g, unknown or other
  misc_feature (256)..(256): n is a, c, g, or t
  modified_base (287)..(287): a, c, t, g, unknown or other
  misc_feature (287)..(287): n is a, c, g, or t
tcagcgagagataccacgaccggtgctcgatttagtagtgtagatttgggtttggggggaggaggagcccgagcactgggattccgaggtgtttccattcggtgatcagcactgaacacagaggactcaccatggagttttggctgagctgggttttccttgttgctatttaaaaggngtccagtgtgaggtgcgtctggtggagtcgtggaggaggcctggatccagccgtgggggtccctgagctctcctagtncgagcctcgtgggtcaccgtcagtccgaacncctaagatggagttcgggtaccgccacgggccttccggaaggggtaaacgggccttggggaacgttcgggggtcctttacccgttttaaagttttaacccgaggtacgttacgggtacgggttaacgtaaccgacgtttaacgtttcccgggactaacggtaaccgtttccggtacgggtaacgggggccctaaggtttcccaaacctcgtcctaccgtagaacggtaacaacgttacgtaaagaaacccgacgtaacgtttcggttaccttaacggaaatacggtaaacgacgttaccgtacggaaacgtacggaccccgttaagtcggaaccgccgggtaaccgtttaccggtacttaacgttcggacggttaccggaagtaccgtagtccggggtaaccctaacgggtaaaccgttacgaaccggttcgtaatacggggtaactcccggttaaggggaccccggttaagggaaccccggtcgg

SEQ ID NO: 269688 - DNA, 630 bp, Homo sapiens
  misc_feature: GYAE6OF02G9EFU.11.25.C03.1.454.CMB.1.raw
  modified_base (388)..(388): a, c, t, g, unknown or other
  misc_feature (388)..(388): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttccaccgtcagtcacacctacatgagttcgggtcccgccgaggcctccgaaggggaacggggctggagtgggtccttcctttatttacagtcaggtggtatacgatattccgcagtacctcgnggacggggccattccaccatcctaccagacgacaactctaaagaacacgcttgttcttacaaatgaacacgcctagacgacgacccgagtacgaaccgtaccgggtaccgttagttaactttacgtaggtacgaccggtaggacggtacgtaccgggggacccctaaacggtaacccgttacgtaccgtacgttagtcgggaccgttcggacgggggacccgtaacggggaccctacccggg

SEQ ID NO: 269689 - DNA, 843 bp, Homo sapiens
  misc_feature: GYAE6OF02JSLSN.11.25.C03.1.454.CMB.1.raw
  modified_base (623)..(623): a, c, t, g, unknown or other
  misc_feature (623)..(623): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggagggaggcctggactaccgagcccggttgggggggtccccttaggacggtaccttccgttcccgttggttcggccacggtcccgttacggttcggggttaccacccgttctaacggttcccaacctaaccccttaccagtagggtaacggttccggggttaccccgaccgtaagggtcccgttaccgggaagggggtaaacgggggtccgtacggggtaggttcggggttccctttaccgttttaagtttacgaggtaccgtaggttaggtatacgtaatacttcccgatacgacctccggtaggacggggtccgtaacgttccgaaccttactccgtaccgaaggtacgtaacctaactaacgtaaacgaaccgtaccgtacgtttcgtttactaacgtaaactcggtaaaacncggtaaccgtcgggaagtaccggtacgaacgtttccggaacccgtaccgggttcccgtagtttaaccttaaccggttcggtacggtaaccgggtagtaaccggggtacgtaccccgggggtaacccaacgggtttaaaccgttaccgtaacggtaccgtaggttaccgggtacgttcccgggtacgggggaacccgttacggggaaccccttacccgggg

SEQ ID NO: 269690 - DNA, 716 bp, Homo sapiens
  misc_feature: GYAE6OF02JCLJ7.11.25.C03.1.454.CMB.1.raw
  modified_base (306)..(306): a, c, t, g, unknown or other
  misc_feature (306)..(306): n is a, c, g, or t
  modified_base (659)..(659): a, c, t, g, unknown or other
  misc_feature (659)..(659): n is a, c, g, or t
tcagcgagagataccacgaccggtgctcgatttagtagtgtagatttgggtttggggggtaggagggagcccagcactgggattccgaggtgtttccattcggtgatcagcactgaacacagaggactcaccatggagttttggctgagctgggttttccttgttgctatttaaaggagtaccagtgtgaggtgcgtctggtggagtctggaggaggctgatcgagccgtggggggtccctgaggactctccgtgtgcagtcctcgtggttcaccgtcagtccacacctacatgagttcgggtccncgaggcctacgagggaagggctgggaggttcgggtccttacgtttacttacgagtcgtaaggttcgggtaagttacacttagttccgactacgtaccgtcggtagggaacgggggtacctagtttacccgacctacgttccaccgtaggaacgtacctaaaccgtacttaaacggaaacctccggtacttcgtttaacctttacgaaaatcggtaaaactcggtacccttaggaacgtacgaacccgtagtaccgaaccggtacccgggtactacggttatttaccgtgggtacggcgaagggtaacggacggtcgggtacccgtaaacggttaaccgtttaacgaaccggtnttaaccggtgggttaacccggtcgtaccgggggaccctaagggggacccctaacggg

SEQ ID NO: 269691 - DNA, 596 bp, Homo sapiens
  misc_feature: GYAE6OF02HI3SI.11.25.C03.1.454.CMB.1.raw
  modified_base (321)..(321): a, c, t, g, unknown or other
  misc_feature (321)..(321): n is a, c, g, or t
  modified_base (409)..(409): a, c, t, g, unknown or other
  misc_feature (409)..(409): n is a, c, g, or t
  modified_base (468)..(468): a, c, t, g, unknown or other
  misc_feature (468)..(468): n is a, c, g, or t
  modified_base (489)..(489): a, c, t, g, unknown or other
  misc_feature (489)..(489): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggtcaccgtcagtcaccacctacatgaggtggtccgccaggcctccgaagggacgggntagggagtgggtccttactttattacagtctaggtggtagtacattactccgcagtaccgtccggtggacgggacctattccaacctntcctaccgagacgaacactactaaacgaacctcgtactttgttactacaaatcgaaacncgtcctagacgtacgccgtancggaccgacgtcgtagtacttcgtgtacgagtagaggtcggtacgggacctaacgacgttacacgtgtaagtcggcggtacggacggacggtaccggaccgtaccgg

SEQ ID NO: 269692 - DNA, 718 bp, Homo sapiens
  misc_feature: GYAE6OF02GOYZG.11.25.C03.1.454.CMB.1.raw
  modified_base (609)..(609): a, c, t, g, unknown or other
  misc_feature (609)..(609): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctgggtggagtctgggagggaggcctgactccagccgtggggggtccctgagactctcctgtgcacgtcctcgtcggttccaccgtcacgtccacacctacagtgtaggttcgggtccgccgacggtccgtaccggagggggacgggcgtgggaggtgggtcctttaccttttattacgagcgtaggtggtaagtactattacgttccgacgtacgaccgtcggtagggacggggtacctaattacccaacctacgtcccgtaccgaaggaacgtaacctaaaccttaacgtaaaacgaaacctcgtaccttttagtttaccttaaacgaaagttaacgaaccgtaggtacccgttaggaaccggacgaccgtaagtaccggaccgtaccggtacgttagttactttacgngtacggacgagacggtaggtcccgggaacccgtaacggtaaccgttaccgacgtacgttaggtacggtaccggtcgggtacgggaccgtaaccggggtacctacccggg

SEQ ID NO: 269693 - DNA, 583 bp, Homo sapiens
  misc_feature: GYAE6OF02IXKMP.11.25.C03.1.454.CMB.1.raw
  modified_base (178)..(178): a, c, t, g, unknown or other
  misc_feature (178)..(178): n is a, c, g, or t
  modified_base (257)..(257): a, c, t, g, unknown or other
  misc_feature (257)..(257): n is a, c, g, or t
  modified_base (303)..(303): a, c, t, g, unknown or other
  misc_feature (303)..(303): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (428)..(428): a, c, t, g, unknown or other
  misc_feature (428)..(428): n is a, c, g, or t
  modified_base (448)..(448): a, c, t, g, unknown or other
  misc_feature (448)..(448): n is a, c, g, or t
  modified_base (503)..(503): a, c, t, g, unknown or other
  misc_feature (503)..(503): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagccgtgggggtccctggagactctcctgtgcngcctcgtggtccaccgtcagtcacacctacatgtagttcgggtccncgaggctccgaggggaggggctgggagtgggtccttctttattacagtcgtaggtggtagtacattactccgactacgcgtcgtggacgggctatcacntcctacngacacactcaagacacgtnttcgttacacaaatcgaacncgcctagacgacgcgtatcggaacaccgggtcttagtattaccgtgtgacgaggngtacggtacgggacccaagtaaccgttacgcgtacgtagtcgggtacgtcgggacgggaccgtaacgggacctacccggg

SEQ ID NO: 269694 - DNA, 522 bp, Homo sapiens
  misc_feature: GYAE6OF02HXSCV.11.25.C03.1.454.CMB.1.raw
  modified_base (330)..(330): a, c, t, g, unknown or other
  misc_feature (330)..(330): n is a, c, g, or t
  modified_base (498)..(522): a, c, t, g, unknown or other
  misc_feature (498)..(522): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggtttttccttgttgcttattttaaaagcctgagagccgatgacacggccgtgtattactgtgcgagagagtgggggcccaacgtaacgttactacgctagtgggacgtcgtggggccaagggaccacggtcaccggtctcctcagcctccacacggcccatccggtcttccccctggccnccctgcctccgagacgccacctccgagacgccacacgccggccccgtggggcctcgcccgttcgggtaccgaaacgggtaccttaccgtttacccggtattcccgttcctaccggtcttgggaaccggccgggggtcttacgggcgaaacgggccgcgaagttagcgnnnnnnnnnnnnnnnnnnnnnnnnn

SEQ ID NO: 269695 - DNA, 541 bp, Homo sapiens
  misc_feature: GYAE6OF02GZARX.11.25.C03.1.454.CMB.1.raw
  modified_base (370)..(370): a, c, t, g, unknown or other
  misc_feature (370)..(370): n is a, c, g, or t
  modified_base (514)..(516): a, c, t, g, unknown or other
  misc_feature (514)..(516): n is a, c, g, or t
  modified_base (518)..(541): a, c, t, g, unknown or other
  misc_feature (518)..(541): n is a, c, g, or t
tcagcgagagataccacgaccggtgctcgatttagtagtgtagatttgggtttgggggggaagaggaagactgacggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtggggcccacgaacgttactacgctatggacgtctggggccaggggaccacggtcacccgtctcctcacgcctccaccaacgggcccatccggtcttccccctggccnccctgcctccaggcgccacctccgagacgcacgacgccggcccgtgggctcgcccgttggtccgaaagggtaccttaccgttcccgtattccgtcttccgctggacggccgggtgtcggccgtaaacggccgactaacgtacgnnngnnnnnnnnnnnnnnnnnnnnnnnn

SEQ ID NO: 269696 - DNA, 695 bp, Homo sapiens
  misc_feature: GYAE6OF02FTZRH.11.25.C03.1.454.CMB.1.raw
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtggtcaccgtcngtcacacctanatgagttcgggtccgcaggctccgaggggagggctggagtcgggtcttcctttattacagctaggtggtagtactatacgttccgacacgtaccgttcggtagggacggggtccctaattacccgaccctagttccctaccgaaggaacgtaaccaaaccgttactaaacggaaacctaccggtctttacgttttccttaacaaaagttcgaaaccgtacggtacccgtaggtaacggacggacccggaagttaccggaaccgtacccgggtcccgttaggttaactttaccggtgtcggacgtaaggaggtacgggtccggggaccctaacggtaaaccgttaccgtaccgtacgttaggtcggtaccggttccgggtaggggacccgtaacggggcccgtaacccggg

SEQ ID NO: 269697 - DNA, 683 bp, Homo sapiens
  misc_feature: GYAE6OF02JYPVZ.11.25.C03.1.454.CMB.1.raw
  modified_base (406)..(406): a, c, t, g, unknown or other
  misc_feature (406)..(406): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtcgtggaggacggcctgatccgaggccgtggggggtccctaggagactctcctgtgcagcctctggttcaccgtcagtcacacctacagtaggtagttcgggtccaccacggctccggaggtaaggggctgggaggtcgggttaccttacctttagttacgagcgtaggtcggtagtacattacgttccgcaagtacctacgggnggtacggggccaattccaaccgtactccgtaccgagacgacctaacgtacgtaaacgacctacgtcgtttcgtttaacctactaaagacgtaaacagcccgtagtacggacgccgaagtacggacgaccgggtcttaaggttacttaccgtggtaaggaccgtaggacggacgggtaccggggtacccaaacggttaaggttacccttaacggaaccgtaccgtttaagttccggggtaaccggtttccgggacgggtaaaccggaacggtacccgg

SEQ ID NO: 269698 - DNA, 708 bp, Homo sapiens
  misc_feature: GYAE6OF02I92S9.11.25.C03.1.454.CMB.1.raw
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (368)..(368): a, c, t, g, unknown or other
  misc_feature (368)..(368): n is a, c, g, or t
tcagcgagagataccacgaccggtgctcgatttagtagtgtagatttgggtttggggggaggaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctgtggtcaccgtcagtcacacctacatgagttgggtccncgaggctccgagggagggctggacgtgggtcctcctttattacngactggtggtatacatacgttccganagtacctccggtggacggggtcctaattccgaacctagttcccgtaccgaggaacgaacctaacgttaccgtaaaacgtaacccaacggtctttacggttttacctaacgtaaaagttacggaaaccgtaggtcccgttaggaaaggtaccgaacccgggtattaaccggaacccgttaccggggtacccgtttagttaaccgtttaccgtggaaccggtacggaacgtaggaccgggttacggggaccccctaaaggttaaacccgttaccgtaacgtacgttaacggacgggttacggtcccgggtacggggaacccaacgggggtacccctaccggg

SEQ ID NO: 269699 - DNA, 848 bp, Homo sapiens
  misc_feature: GYAE6OF02GDBQ7.11.25.C03.1.454.CMB.1.raw
tcagcgagagataccacgaccggtgctcgatttagtagtgtagatttgggtttggggggaggaggagcccagcactgggattccgaggtgtttccattcggtgatcagcactgaacacagaggactcaccatggagttttggctgagcttgggttttccttgttgcttattttaaaaggagtccagtgtgaggtgcgtctggtggagtcgtggaggaggtcctgatccgagccgtggggggtccctgacggtactccgtcctggtcgcgacgcccttgtcggggttaccacccgtcgtacgtcctaccgtaaccctactagtaggtacggtttccggggtccccgcccggtaaggggtaccctccccgggaaaggggggaaacgggggtccggtaggggtaacggtttccgggggttccttttacccggttttaaagtttttaaccgagggtacgttaacggggttaggttaacggttaacctaactttacgtttacccggacgtaacgtaccgttacccgggttggggaaccgggggtccgtaacgtttccaaaccgttacgttcctacccgtaaggaacgtaactaacccgtaacgaaaacggtaacctaaccggtatttccggtttaactttaaccgaaacgttacggtaaacaccgttaccgtaggtacgtaaagcccggtatacccgggtaacaccgggtacccgttagtatttaccggtgtcggaagtacgggagtaccggtaggacccccgtaaagggtaaacccgttacgtaacccggtagttaacctcggggttaaccctccggggtacggggacccgaaaggggttacccccgacggg

SEQ ID NO: 269700 - DNA, 858 bp, Homo sapiens
  misc_feature: GYAE6OF02IMSS3.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccagtggagtttggctgagtcgtgggttttccttgttgcttaagttttaaaaaggagtccagtgtgaggtgcgtcgtggtggagtcgtggaggaggcctgactccgagccgtcgggggtccctagacgactctccgtggtcgcgacgtccgttcgttcgggttaccaacccggtctaacgtccaaccgtaacctaacagttggacggttcgggtcccgccgacggcctaccggagggggaacgggtcgtagggtaggtcgggtttcccgtttacccgttttaaagttaccgtacgggtacgttaaagggtttcgggtaaaccgttaacgtaaacgtttacccgtttacccgggacgtaaaccggttaacccggtttaccgggttcgggaaccgggggttacccgtactttacccgaacccgttacttccgtaaccgaacggtaacgaccgtaaaacctacgtaaaacgtacgaccgttacttacgtttaccttaaccgaaagttaacgaaaccgacgttacccgtaggaaacgtacggacccggtaacgtaacggaacccgtacccgggtaccgttaacgtttaacgttacccggttaggtaggaccggtaaaggtaaccgtacgggtacccgggtacccgtaaaaccgggttaacgttacccggtaacgttacgtacggttacggtaccggttaccgggacggggtaaccgtacggggaaccctaaccgggg

SEQ ID NO: 269701 - DNA, 170 bp, Homo sapiens
  misc_feature: GYAE6OF02IQSE6.11.25.C03.1.454.CMB.1.raw
  modified_base (147)..(170): a, c, t, g, unknown or other
  misc_feature (147)..(170): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagtnnnnnnnnnnnnnnnnnnnnnnnn

SEQ ID NO: 269702 - DNA, 630 bp, Homo sapiens
  misc_feature: GYAE6OF02JDAAN.11.25.C03.1.454.CMB.1.raw
  modified_base (177)..(177): a, c, t, g, unknown or other
  misc_feature (177)..(177): n is a, c, g, or t
  modified_base (252)..(252): a, c, t, g, unknown or other
  misc_feature (252)..(252): n is a, c, g, or t
  modified_base (406)..(406): a, c, t, g, unknown or other
  misc_feature (406)..(406): n is a, c, g, or t
  modified_base (459)..(459): a, c, t, g, unknown or other
  misc_feature (459)..(459): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagccgtggggggtccctgagacctctccngtgcagcctcgtgggttcaccgtcagtcacacctacatgaggttcgggtccgccaggctccgaggggaacggggctgggagtgggtccttctttattacagcaggtggtagtacatattccgcagactccgaggacggggtcctattcaccgtnttcctaccagagaacctaactctaaagacacgtctcgtttactacaatgaacncgaccttgaagtcgaccgtatacgaccgtacggccgttagttaagttactggtcgaacgaggacgtacggttcgggaccccgtaaaggtaaaccgtttacctacggaccgttaagttccgggtaacggtttcccggacgggggaacccgtaacggggtacccctaaccggg

SEQ ID NO: 269703 - DNA, 605 bp, Homo sapiens
  misc_feature: GYAE6OF02F9V84.11.25.C03.1.454.CMB.1.raw
  modified_base (327)..(327): a, c, t, g, unknown or other
  misc_feature (327)..(327): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
  modified_base (458)..(458): a, c, t, g, unknown or other
  misc_feature (458)..(458): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctggggttcaccgtcagtcacacctacatgagttcgggtccgccgaggcctccgaggggaagggcgnggagtggtcttctttattacagctagtggtagtacattactccgacagacctccggtggacggggccattccacctatccnccgaagngaaccaactacaagaacacgcttgttacctacaaatcgaaacncgcctaggacgacgccgtatcgaacgaccgggccgttagttacttacgtgcgtagacgagaggtccggggacccaaccggtaacggttaacaccgtactacgtcgggtaccgtccgggtacggggacccaacggggacccgtaccgg

SEQ ID NO: 269704 - DNA, 900 bp, Homo sapiens
  misc_feature: GYAE6OF02HW52F.11.25.C03.1.454.CMB.1.raw
  modified_base (349)..(349): a, c, t, g, unknown or other
  misc_feature (349)..(349): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggtagttttggctgagtcgttgggttttccttgttgtacttaagttttaaaaggagtcctagtgtggaggtgcgtcgtggtggagtcgtgggagggacggcctggtactaccgacggtccggtcgggggggtcccctggacgtactccgttccgtggtcgacctacgtccgtccggtttacgggttcccgaaccggttcacggttaccaacctaccctanacgttgtacgggttcggggtcccgtacccgacgggtccctaccgggaacgggggtaacggggtccgtgggtacgggttcgggttacccgttttcgtttttaacgttaccgaaggtcgttaacggttagggttaaccgttaaactaactttaccggttaccgacgttaaccggtaaccgttccccgggtaaggggcccggggtaccgtaaccttcccgtaacccgtacgttccgtacccgaaaggtacgtaaaccaacccgtttaaaagtaaaccggaaaccgtaaccggtttcgttttaccgtttaacctaaactaaaaggtccgtaaaacgtccggtacgtagaaaccggcgaccggtaagttaccgaaccggtaccggtccgttaggttaactttacggtcggtgaacgtaagggcccgttaacggggtcccggaaccccgttaaacggggttttaactacccgggttaccgtacggttaaacgggtaccgggtaccggttcccggggtaaacgggggaccccgtaacccgggccccggttaacccggg

SEQ ID NO: 269705 - DNA, 771 bp, Homo sapiens
  misc_feature: GYAE6OF02F2PXS.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaaaacagaggactcaccatggagttttggctgagcgtggtttcgtgtagctatttaaaagagtccagtgtgaggtgcgtcgtggtggagtcgtggaggaggcctgactccagccgtgggggtcctgagacctctccgtgtcgctacgcccttcgttacgggttccaacccggttcaacgttccaaccaaccttaacctagttggtaacggtttcggggtcccgcccgtaagggtccttacccggaaggggggaaacgggggtcgttacggggaacggtttcggggttcctttacccgttttaagtttacccgagtcctaaggttacggtagttacctaagttacttcccggactacggtaccctacgggtaggacggggtaccgactttaccgacccttcgtacctaccgaagtacgaaccaaaccttccgaaaagaccgtaaccgtctttacgtttacttacgtaaacgtacgtaaccacgtacgtacgaagaccgtacgacgttagacccgtacggtaccgtagttacgttaccgttggtacggaccggtagaacggtacggtaccggggcccctaaaggggttaaccaaccggttacaccttacggtacggaccgttcggtaccgggaacccgtaacgggtaccgacccggtcccg

SEQ ID NO: 269706 - DNA, 716 bp, Homo sapiens
  misc_feature: GYAE6OF02G675B.11.25.C03.1.454.CMB.1.raw
  modified_base (288)..(288): a, c, t, g, unknown or other
  misc_feature (288)..(288): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggtttttccttgttgcttattttaaaaggagtccagtgtgaggtgcgttcgtggtggagtctggaggaggcctgatccagccgtgggggtccctgagactctctgtgcagcctcgtggttcaccgtcagtcaccacctanatgtagttcgggtccgaccgaggtcgtccgaggggaagggggtcctagggaggtcgggttcttccgttttaacttacgagcgtaggttggtagtactatacgttccgacgtagtaccgtccggtagggacggggtacctaacgtttccaaccgacttccgtacccgaaggtaaccgacctaaaccttacgtaaacggaacctaacgtcgtttacgtttactactaaagtacgaaactacgtaccgtagacgacggtaccgtacgacggaaccgaccggtaccgttacgtttaactttacgttggtacggaggaacggtaggacgggttaccgggaacccgtaaacggtaaccgttaacctacccggtacgtaaggttccgggtaccgttacgggtacggggaacccgtaacggggaccccgtaccggg

SEQ ID NO: 269707 - DNA, 684 bp, Homo sapiens
  misc_feature: GYAE6OF02IF9UP.11.25.C03.1.454.CMB.1.raw
  modified_base (455)..(455): a, c, t, g, unknown or other
  misc_feature (455)..(455): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagcctgggggtccctgagactctcctgtgcagcctctgggttccaccgtcagtcacacctacatgagttgggtccgccaggcctaccgaaggggtaagggctgggagtgggtcttcctttattacagtcaggtggtatacatattccgcacgtacctcggtagacggggcctattccgaccatcctaccgagagacctaaactcgtaaaagacctacgtcgttgtttaccttanaaaacttcggaaaactcggacctagggacgagacccgagtacggaaccgaccgggaccgttggttaactttaccgttagggtacggtaccgggtaaggacggtaaccggttccggggggaccccctaaagggttaaacccggtttactaacccggtacgttaaacggttcggggtaacctttcccggggacggggggaacccctaaaccggggtccccgtaacccgggg

SEQ ID NO: 269708 - DNA, 655 bp, Homo sapiens
  misc_feature: GYAE6OF02HNJ4T.11.25.C03.1.454.CMB.1.raw
  modified_base (284)..(284): a, c, t, g, unknown or other
  misc_feature (284)..(284): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctccgtgtgcagcctcgtggttcaccgtcagtcacacctanatgaggttcggtccgccaggctccgagggagggctggaggtggtctcgtttattacagcagtggtatactatactccgcacgacgtccgtggacggggtcctacgttacaacctgtacctaccgagacgaacctaaacgtaccgtaaaacgaaccacgtacgtttagtttaccttaacgaaagtacgaaacgtacgtacccttaggacgacggtaccgagtaccggaccgacgggtccgttacggttaacttaccgtggtacgacgaggaacgagtccggggaaccctaacgggtaaccgtttaccgtacggtacgttaagtacgggtccgttacgggtacgggaaccggtaaccgggtacccgtacccgg

SEQ ID NO: 269709 - DNA, 636 bp, Homo sapiens
  misc_feature: GYAE6OF02FMNEZ.11.25.C03.1.454.CMB.1.raw
  modified_base (452)..(452): a, c, t, g, unknown or other
  misc_feature (452)..(452): n is a, c, g, or t
  modified_base (538)..(538): a, c, t, g, unknown or other
  misc_feature (538)..(538): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtggttcaccgtcagtcacacctacatgagttgggtccgccgaggctccgaggggagggctggaggtgggtctctttattacagcaggtggtagtactatacttccgacgacgtacgttcccgtgggacggggtccgtacgttccaacctagttcctaccgaagacgaacctaacgtactaaaggaaaccncggtactttacgtttacctactaaacttgaaacacgtcctaggacgacgccgaatcggaaccgcgggtaccgttagtactttacgngtcggacgaggagacgggtccgggaccctaacgggtaacgttaccgtaacgtcttaaggtcggtacgtccggacggggacccgacgggaccctacggg

SEQ ID NO: 269710 - DNA, 659 bp, Homo sapiens
  misc_feature: GYAE6OF02GJLMU.11.25.C03.1.454.CMB.1.raw
  modified_base (303)..(303): a, c, t, g, unknown or other
  misc_feature (303)..(303): n is a, c, g, or t
tcagcgagagataccacgaccggtgctcgatttagtagtgtagatttgggtttggggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtggttcaccgtcagtcacacctacatgagttgggtcccnccaggctccgaggggaaggggctgggagtgggtctcctttattacagcaggtggtatacatacgttccgcagacctccggtggacggggccattccacctatcctccagacgaacctaactacgtaaagaactacgtctttcgtttacttaaccaaaagttcggaaacctacgacccgttaggaacggacgtacccgtaagtcggaaccgtaccgggtccgttagttaactttacggtgtacggtacggagtacggacggtccggggacccctaaacgggttaaccgttaccggtaacgacgtttaaggtccggaccggttcggaccggggaaccgaacggggaccctaacccggg

SEQ ID NO: 269711 - DNA, 835 bp, Homo sapiens
  misc_feature: GYAE6OF02F0YCK.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgactccgacggtccggtcgggggggtccctggacgtacctcctccgtgtgcacggccttcgtcgggttccaccgtcacgtcaccacctacatggtaggttcgggtccgccgagggccgtaccggaagggggacggggtccgttggggacggttcggggttcctttaccgttttaacgttttacgacgtcgtaaggttggtaacgtaacgtactttacgttcccgacgtacgtacccgttccgggtacggggaccgggggacccttaagttcccaaccctacttccctacccgtaaggaaccgtaaacctaaaccgttaaccgtaaaacggaaacccgtaccgttaccgttttacgttttaaccgtaaaccgtaaaacgttaacggaaaaccgtaccgtaaccgttacggaaccgtaacggtaccgtaaggtacgaaccggtaccgggtaccgtttagttaacgttacgtcgtacggacgtaagggacggtacggtcccggggtaaccctaaacgggttaaaccgtttaacccgtaaccggtaacgtttacgggtacggggtaccggttaccggggccgggggaaaccccggtaacggggaccccgtaacccggg

SEQ ID NO: 269712 - DNA, 631 bp, Homo sapiens
  misc_feature: GYAE6OF02GNQJQ.11.25.C03.1.454.CMB.1.raw
  modified_base (175)..(175): a, c, t, g, unknown or other
  misc_feature (175)..(175): n is a, c, g, or t
  modified_base (303)..(303): a, c, t, g, unknown or other
  misc_feature (303)..(303): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgactccagccgtggggggtccctgagactctcctgtgcagcctctggttcaccgtcagtcacacctacatgtaggttgggtcccgcnggcctccgaggggagggctgggaggtggtctctttattacagcagtggtagtatatacttccgcagtacctccggtggacggggtcctagttccaccgtatccctaccgagacgaactaactctaaacggaacctaccgtcgttcgtttactactaaagtaggtaaaccacgaccgtgagaccgaccggattaccggaccgtaccgggcctttaggttactttaccgtggtacgtgacgtagacgtcggggaccccaacggtaaccggttactaaccggtctaggtacggtcggtccggtcggggaaccgtacgggccctaacccggg

SEQ ID NO: 269713 - DNA, 686 bp, Homo sapiens
  misc_feature: GYAE6OF02FF0KR.11.25.C03.1.454.CMB.1.raw
  modified_base (171)..(171): a, c, t, g, unknown or other
  misc_feature (171)..(171): n is a, c, g, or t
  modified_base (186)..(186): a, c, t, g, unknown or other
  misc_feature (186)..(186): n is a, c, g, or t
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctggtttcctgttgctatttaaaggngtccagtgtgaggtncgtctggtggagtctggaggaggcctgatccgagcccgtgggggtccctggacgacgtctcctgtgctacggcctcgtggttccaccggtcagtcacgcctacatgagtcggtccnccaggcctcgaggaggctggagtggtcttcttattacngtctaggtgtagtacattacgtccgcagtaccgtcggtacggacggtccgattccaccatccgtccaggtaacgactaaccgtcaaagacctacggtctttacggtttacctaacaaagttcgaaaccaggtacccgttagaacgtacgcccggtaatccgggaaccgtaccggggtccctttaggtaaccttttacgcgttacggacggttaagacggttaccgggacccggggaaccccgttaaacggttaaccggttaaccttaaccggtcgttaagtacccggggttacgtacccgggttacgggggaaccccgtaacggggttaaccccgtaaccccgggg

SEQ ID NO: 269714 - DNA, 859 bp, Homo sapiens
  misc_feature: GYAE6OF02JWBEY.11.25.C03.1.454.CMB.1.raw
tcagcgagagataccacgaccggtgctcgatttagtagtgtagatttgggtttggggggtaggaggagcccagcactgggattccgaggtgtttccattcggtgatcagcactgaacacagaggactcaccaatggagttttggctgagctgggttttccttgttgcttattttaaaggagtccagtgtgaggtgcgtctggtggagtcgtgggaggaggccgtgatccacggtccgtgggggggttcccctggacgtaccttcgtcccgtggttcggacctacgcccgttcgttcggggttccgtaacccggttccgtaggttacccaacctaccccgttaactacggttacggtaacggggttttcgggggaccccgtacccgtaacggggtcccgttacccgggaacgggggtaaacgggggggtccttaaggggggtacggttttaccggggggttttccccttaccgttttttaacgtttttaaccgaaccgggtccgttaagggttacgggttacggtttaaccaacgtttacgtttcccggacgtacggtacctttacccgggagggtaaccggggggtcccctaaagtttcccaaccgtaccgtccgtaccgaagaccgtaaccaaccgttacgtaaacgaaaccctacgttcgtttactttacttaccaaaacgttacggtaacctacggtactacgggtaaagtaccgaccgttagaccggaacgtaccgggtaccgttagttaacttaacgttggacgacgtagacggttgaccgggtaccacggttaaccttacgaacgtctaggtcggtaacgtccggtagggtaccgacgggtaccctaaccggg

SEQ ID NO: 269715 - DNA, 920 bp, Homo sapiens
  misc_feature: GYAE6OF02JC701.11.25.C03.1.454.CMB.1.raw
  modified_base (239)..(239): a, c, t, g, unknown or other
  misc_feature (239)..(239): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttgctgagctgggttttccttgttgcttatttaaaaggagtccagtgtgaggtgcgtcgtggtggagtcgtggaggaggcctgatccgagccggtcggggggtnaccccttggacgtaccgttcgtccctgttacggcctaaggtcccgttcctacgggggttttccaaacccggttccaaacggttccaaacctacccgtttaacgaacgtttcgggaaccgtttcgggggtacccggtcccctaaggggccggttaccccggaaggggtaaacgggggccgttggggtaacgtttcgggggtttaccttacccgttttaagttttaacccgaggttacgtaaggttcgggtaaagtaaccgtaacgttaacttacccggactaacgggtaccgttacccggggtacggtaacgggggtcccgtaacgttaccgaaccctaactaccgtaaccaaacggtaacgtaacctaaaaccgtaccgtaaaacgtaaccttaaccggttactttaacgtttaacgttaacgaaaaacgttggtaaaacccgtacggaacccgttacggaaccgtaaacggtacccgaaacgttaccgggtaaccgtaaccgggtacccgttaaggttaccgtttaaaccggtagggttaaccggacgtaaacgggtacggtaaccggtaacggggtaaccccttaaacggtaaacccggttaacgttaaccggtaaccgttaacggtacgggtaacccgggttacggtaccggggtaacccgtaaccggggtaaccccg

SEQ ID NO: 269716 - DNA, 714 bp, Homo sapiens
  misc_feature: GYAE6OF02IH38C.11.25.C03.1.454.CMB.1.raw
  modified_base (486)..(486): a, c, t, g, unknown or other
  misc_feature (486)..(486): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctggaggaggcctgatccagccgtggggggtccctgagactctcctgtgcagcctcgtgggttcaccgtcagtcacacctacatgagttcggtccgccgaggcctccgagggggaaggggctgggaggtggtctccttttattacagctaggtggtagtacattacttccgacacgactccggtggacggggtccaattccaacctatccaccgaagacgaacctaaactaccgtaaagaaacctacggtctttcgtttacctactaaaagtcgaaacncgtacctggaagaccgaccgagttcggaacgtccgggtaccttaggttaactttacgtcggtacggacggtaaggaggttacgggtcccggggggaacccctaaaccgggttaaaaccgtttaacccggaacccggttaacgttaacgggttccggggaacccggttttcccggggaacccggggggggaaaccccttaaaccgggggacccccgttaaccccggggg

SEQ ID NO: 269717 - DNA, 777 bp, Homo sapiens
  misc_feature: GYAE6OF02IMPLT.11.25.C03.1.454.CMB.1.raw
  modified_base (199)..(199): a, c, t, g, unknown or other
  misc_feature (199)..(199): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggtagtttggctgagtctgggttttccttgttgcttaattttaaaaggagtccagtgtgaggtgcgtntggtggagtcgtggaggaggcctgatccgagccgtcggggggtccctggacgactctcctgtcgcagccttcgtcgggttcaccgtcacgtcacacctaacagtggtaggttcgggtccgaccgacggcctaccggaggggaacggggcgtagggaggtcgggttccttacccttttaagtttacgagtcgtaagttacgggtaatacaagttacgttccgacaacgtaccgtccggtggacggggtaccgtacgtttaccacccgtattccgaccgtaagaacgaaccctaaacgtaacgtaaacgaaacctaccggtctttacggtttaccttaaacgtaaaacttaggaaacctagttaccctaggaaccgtaacgacccggttagtaccggaaaccggtacccgggtaccgtttaacgttaacttttacgaccggtttagggaacccgtaaggtaacgggtacggttaaccgggggacccccaaacgggttaaaccgttaaccgtaacggttacccgtaagtacggggtacctaccggggtacggggtaacccgaaccggggaccttaacccgg

SEQ ID NO: 269718 - DNA, 732 bp, Homo sapiens
  misc_feature: GYAE6OF02IV9LZ.11.25.C03.1.454.CMB.1.raw
  modified_base (189)..(189): a, c, t, g, unknown or other
  misc_feature (189)..(189): n is a, c, g, or t
  modified_base (294)..(294): a, c, t, g, unknown or other
  misc_feature (294)..(294): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttcgtgtaggctattaaaggagtcagtgtgaggtgcgtntggtggagtctggaggaggcctgatccagcgtgggggtcctgagactctctgtgcacgcctcgtggttcaccgtcagtcaccacctacagtgtagttcgggtccncgtaggccctccggaaggggaaggggtcgtggggtacggttgggtccttccttttattacaggtctaggtcggtataccgtattacgttccgacacgtacgttccggtagggaacgggccgtattccacgcttccgtccgaaggtacgaaacctaactaaccgtaaacgaaaccgtccgtacgtttttacgttacctttaacgaaaacttacggtaaacctaccggtacccgtaaggacgtaaccggtccgtaagttacggaaccgttaacgtcggggttaaccgttgttaacccgttttaacgggtggtaacgttacggaaacggtaggaccgggtttacgggggaaacccccttaaaacgggttacccggtttagaaccgttacgttaagttcggggcgttaacgggttccgggggaaacctacgggggtaacccc

SEQ ID NO: 269719 - DNA, 650 bp, Homo sapiens
  misc_feature: GYAE6OF02GJ33X.11.25.C03.1.454.CMB.1.raw
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccgagccgtggggggtccctgagacctctcctgtgcacgcctcgtgggttccaccgtcagtccacacctacatggtagttcgggtccgccaggctccgaggggaaggggctgggaggtcgggtcttccgtttattacgagctaggtggtagtactatacgtccgacacgtacgtccggtggacggggcctatccacctatcctacagacaaccaactactaaacgaaccgacgttctttacgtttactactaaagtacgaacgtacgtaccgtagaacgccgaccgtagtacggaccgtaccgggtccgttagttacgttacgtcggtcgacggaaggtacggacggtccggggacccgtaaggtaacccgttacgtaccgtacgttagcgggtacgttcggtcgggaccgtacgggaccgtacccgg

SEQ ID NO: 269720 - DNA, 778 bp, Homo sapiens
  misc_feature: GYAE6OF02G31MN.11.25.C03.1.454.CMB.1.raw
  modified_base (178)..(178): a, c, t, g, unknown or other
  misc_feature (178)..(178): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttattttaaaaggngtccagtgtgaggtgcgtctggtggagtctgggaggaggcctgactccagccggtggggggtccctgagactctcctgtgcagcctgtcggttcaccgtcagtcacacctacatgaggttcgggtccgccgacggcctaccggagggggtaacgggggccgtaggggacggttcggggttccttcccgttttaatttacgacgtacgtaggtcgggttaagtaacgtacgttacgttccgacgtaacggtaccgtccggttacgggacgggggtaccgtaacgtttcccaaccctacgttcctacccgaagggtaaccaaaccgtaaaccgttacgtaaaaacgaaccgtaaccgtaccgtttagttttaaccttaacgtaaaacttacggaaacctacggtaccttaggaacgtaccggtaccgagtcgaaccgccggtacccgttagttaacgttccgttaggtacgacggtaacgaacggtacggtaccggggtaaccccgaacgggttaaaccggttaaccgtaaccggttacgtacggttacgggtaccggttaccggtccgggggaacccgtaacggggacccgtaacccgggg

SEQ ID NO: 269721 - DNA, 808 bp, Homo sapiens
  misc_feature: GYAE6OF02GD0E8.11.25.C03.1.454.CMB.1.raw
  modified_base (374)..(374): a, c, t, g, unknown or other
  misc_feature (374)..(374): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggctgatccagccgtgggggtccctgagactctcctgtcgcagcctcgtgggtccaccgtcacgtcaccacctacatggtaggttcgggtcccgaccgacggccgtaccgaggggaagggcgtagggtacggtcggggttccttaccttttagttaaccgngtacgtaggttggttaacgtactattacgttcccgacacgtaccgttcccggtaggaacggggtccgtaacttcccaacccgtacgttccctaccgaaggtaacgaaccttaaaccgttacgtaaaacggaaacctaccggtaccgtttacggtttttacctaaaccgaaaacgttcggtaaaaccgtacggtaccctttaagggaacggtacggtacccggtaagtaccggaacccggtaccggggtccctttaacggttaacgttttacgtggttaccgggaacggtaaggtagggaaccgggttccgggggtaaacccccgtaacggttaaacccggttttaacccgaccgtttaaccgtacgggttaccgggtacccgggttacgggttaccccgggggaacgtaaccccgggggtacctaaccccgggg

SEQ ID NO: 269722 - DNA, 588 bp, Homo sapiens
  misc_feature: GYAE6OF02FHM61.11.25.C03.1.454.CMB.1.raw
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (325)..(325): a, c, t, g, unknown or other
  misc_feature (325)..(325): n is a, c, g, or t
  modified_base (377)..(377): a, c, t, g, unknown or other
  misc_feature (377)..(377): n is a, c, g, or t
  modified_base (405)..(405): a, c, t, g, unknown or other
  misc_feature (405)..(405): n is a, c, g, or t
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagactcccctgctctagaattgaattgagagataaatntacttgttggtatnaacagaagccaggccagtcccctgtattggtacatnatcaagtngtgagcgccctcgagggactccgngagctattctctacggtctaccctaactcgtacgggaacgtccagccctacncgtcgaccagtcgacggaccgggacccnggctacgtggacgtggacggctagtaacgttattagtttcgtgtacggggtccgtagggacgtacgacgacggacctcggtacgtcccgttagtcggtttcctaggtaaccggtgggtaaccgtacggtaccctaccggttcgttacggacgccgtacggaccctacggacccctaaccccgg

SEQ ID NO: 269723 - DNA, 793 bp, Homo sapiens
  misc_feature: GYAE6OF02JEMMH.11.25.C03.1.454.CMB.1.raw
  modified_base (176)..(176): a, c, t, g, unknown or other
  misc_feature (176)..(176): n is a, c, g, or t
  modified_base (309)..(309): a, c, t, g, unknown or other
  misc_feature (309)..(309): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttgctgagctgggttttccttgttgcttaattttaaaaggngtccagtgtgaggtgcgtctggtggtagtcgtgggaggaggtcctggactccgagcccggtggggggtcccctggagacgtcctccgtggtcgcgacgcccttcgtcgggttccaccgtcagtccacacctanactggtaggttcggtccgccaaggccgtccggaaggggagggctacggggtaggttcgggttctttccgttttaagtttacgagcgttaggtaggttaacgtactaagtttccttaccggactaacggtaccttcggtcggggaacgggtacccgtagttacccgaccctagttcccgtaccgaagtaacgaaccaaaccgttacgaaaacgacgtaccgttaccgttttagtttaaccctaacgtaaaacttaacggaaaccgtaccgtaccgttaacgggacggtacccgaacggttacgtacggtaccggtaaccccgggtacgttttaacgttacgttaaccgttggtaccggtaagggaaccggtagaccgggtcccggggaaacccctaagggttaaacccggttaaccttacggtaaccgtacgttcgggtacggtccgggtaaccggggaacccgtacgggtaacccgtacccggg

SEQ ID NO: 269724 - DNA, 557 bp, Homo sapiens
  misc_feature: GYAE6OF02GK7KX.11.25.C03.1.454.CMB.1.raw
  modified_base (177)..(177): a, c, t, g, unknown or other
  misc_feature (177)..(177): n is a, c, g, or t
  modified_base (287)..(287): a, c, t, g, unknown or other
  misc_feature (287)..(287): n is a, c, g, or t
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
  modified_base (483)..(483): a, c, t, g, unknown or other
  misc_feature (483)..(483): n is a, c, g, or t
  modified_base (537)..(537): a, c, t, g, unknown or other
  misc_feature (537)..(537): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagccgtggggggtccctgagactctcctgtgcagcctcgtggttccaccgtcagtcacacctanatgagttgggcccgcaggctccgagggagggctggagtggtctctttattacngcagtgtatacatactccgnagcctcgtggacggggctattcgacatccncgagacgacctaactcaagaaccncgtcttgttacctacaaacgtgaaaccngtcctgacgacncgatacgacgtacggcgttgtacttacgngtagcgagacgtcgcgggaccctaaggtaaccgttcacgtctagcggcgtccgngggaccacgggacctaccgg

SEQ ID NO: 269725 - DNA, 714 bp, Homo sapiens
  misc_feature: GYAE6OF02IBZFI.11.25.C03.1.454.CMB.1.raw
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctggagactctcctgtgcacgcctcgtgggttcaccgtcagtcacacctacatgagttgggtccgcaggctccgaaggggaacggggtctaggagtcggggtcttccgttttaatttaaccgagtctaacggtgggttaacgtacctaattacgttccggcaaggtacctcccggttagggacggggccgtaattccgaacctagtcctaccgagtaagacctaactactaaaggaaccacgtcttagtttaccttacaaaattcggaaactacgacccgtaggacgaacgcccgtaatcggaaccgtacccgggtaccgttagttaacgtttaccgtagtacggtacggaagtacggtacggtcgggggacccctaaacgggtaaaccgtttaccgtaaccggactttaacggtcgggtaaccggttccggttaccgggggggaaccctaaaccgggggtaccctaacccgggg

SEQ ID NO: 269726 - DNA, 840 bp, Homo sapiens
  misc_feature: GYAE6OF02IJRIV.11.25.C03.1.454.CMB.1.raw
  modified_base (260)..(260): a, c, t, g, unknown or other
  misc_feature (260)..(260): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgactccagccgtcggggggtccctggagacctctcctgtgcngcctcgtcggtcaccggtcagtccaccacctacagtgtaggttcgggtccgccgaaggtcctaccggaagggggaacggggtcgtgggaggttacgggttctttaccctttttaagtttaaccgagtaccgaggttagggttaacgtaactacttaacgttcccgcgtaacggtaccgttacccgggtagggaccgggggtacccgtaactttacccggaaccctacgttcccgttacccgaaaggtaaacccgaacctaaaaacccgttaccgtaaaaaacggaacccgttaacggtcccttttaaggttttacccttaactaaaaaccgttcggaaaacccgtacgtcccgttaagggaacgtaccggacccggtagttacccggaaaccggtacccggggtacgtttacgttaaacgtttacccgtgggttacggacccgggaaagtaaccgggtacggttaccccggggggaaccccctaaagggttaaacccgtttaacgtaaccgtacgttaacggtcggtaaccgggttccggtaaccgggggaaccccgtaacggggttaccccgacccggg

SEQ ID NO: 269727 - DNA, 695 bp, Homo sapiens
  misc_feature: GYAE6OF02FWTC7.11.25.C03.1.454.CMB.1.raw
  modified_base (288)..(288): a, c, t, g, unknown or other
  misc_feature (288)..(288): n is a, c, g, or t
  modified_base (574)..(574): a, c, t, g, unknown or other
  misc_feature (574)..(574): n is a, c, g, or t
tcagcgagagataccacgaccggtgctcgatttagtagtgtagatttgggttggggagaggagcccagcactgggattccgaggtgtttccattcggtgatcagcactgaacacagaggactcaccatggagtttggctgagctggttttccttgttgcttatttaaaggagtccagtgtgaggtgctctggtggagtcgtgggaggaggcctgatccgagccgtgggggtccctgagactctccgtgtgcagcctctggggttcaccgtcagtcacacctacatggngttggtccgccacggcctccgaggggagggcgtaggaggtgggtcgttccgttattactagtcgaggttggtagtacgtacttagtccgtcaacggtacgtaccggtgggacggggacgtagttacccaacgaccgtctaccgaaggaacgaactaacctaactaacggaaacccgtaacggtccttaggttttacctaacaaacgttgaaacgtacggtctacgagacgtacccgaagttacggaccgaaccggggtacccgtaggtttaacctttaccgggttntagccggtaaggaagcggggtaaccggaaccccgtagggtaaaccggtttccaccggttaacgttccgacggggttccgtacgggtacccggggaaccggtaccgggaccctaacccgggg

SEQ ID NO: 269728 - DNA, 535 bp, Homo sapiens
  misc_feature: GYAE6OF02H81Y5.11.25.C03.1.454.CMB.1.raw
  modified_base (226)..(226): a, c, t, g, unknown or other
  misc_feature (226)..(226): n is a, c, g, or t
  modified_base (327)..(327): a, c, t, g, unknown or other
  misc_feature (327)..(327): n is a, c, g, or t
  modified_base (510)..(514): a, c, t, g, unknown or other
  misc_feature (510)..(514): n is a, c, g, or t
  modified_base (516)..(535): a, c, t, g, unknown or other
  misc_feature (516)..(535): n is a, c, g, or t
tcagcgagagataccacgaccggtgctcgatttagtagtgtagatttgggtttggggggggaagaggaagactgacggtccgccaggctccagggaaggggctggagtgggtctcctttatttacagcagtggtagtacatattccgcagctccgtgaggggccgattcaccatctccagagacaactctaagaacacgctgtttcttcaaatgaacagcctgagngccgatgacacggccgtgtattactgtgcgagagagtggggcccacgaacgttaactacgctagtggacgtcgtggggcaagggccgacggtcacccgtcncctcacgcctccacgacgggcccagtcggtccttccccgtggccgccctgacctccgaggacgccacgtccgagacgcacgcgccggcccgtgggcctcgaccgtggtactaacggacttaccgttccgtatccgtcctgcgttggacggcggtcgtacggcgaagggtccgtgacgtagcgnnnnngnnnnnnnnnnnnnnnnnnnn

SEQ ID NO: 269729 - DNA, 744 bp, Homo sapiens
  misc_feature: GYAE6OF02JCMKE.11.25.C03.1.454.CMB.1.raw
  modified_base (420)..(420): a, c, t, g, unknown or other
  misc_feature (420)..(420): n is a, c, g, or t
tcagcgagagataccacgaccggtgctcgatttagtagtgtagatttggtttgggggaggaggagcccagcactgggattccgaggtgtttccattcggtgatcagcactgaacacagaggactcaccatggagttttggctgagcttgggttttccttgttgcttattttaaaaggagtccagtgtgaggtgcgtcgtggtggagtcgtggaggaggcctgatccagccgtgggggtccctggagactctccgtgtcgcacgcctcgtcgggttcaccgtcgacgtcaccgaccttacatggagttggtcccgaccgtggcctaccggaggggacgggtccgtagggaggtcggggtcctttaccgttttaacgttttacaaggcttaagggtcggtaataactagttaacttcccggntacgacgttcccggtagggacggggcccgttaattcccgtaaccctacgttcccgtacccagaacgaaccctaaccgtaactaaacgaacgaccgtacgttacgtttaccgtactaaactgaaacctgaccctagaacggacgtaccgagtacggtaaccaccgggtccgttacgttaacgtttaccgtaggttcggaaccggtagaaccgggtaggtaccgggaccccgtaacggttaacccgttaccggacccgttaccgttacggtacggtaccgtttccgggtacggggtaaccccggaccgggaacccggttacccggg

SEQ ID NO: 269730 - DNA, 917 bp, Homo sapiens
  misc_feature: GYAE6OF02GZKPD.11.25.C03.1.454.CMB.1.raw
  modified_base (212)..(212): a, c, t, g, unknown or other
  misc_feature (212)..(212): n is a, c, g, or t
tcagcgagagataccacgaccggtgctcgatttagtagtgtagatttgggtttggggggggagagggagcccagcactgggattccgaggtgtttccattcggtgatcagcactgaacacagaggactcaccatggagttttggctgagcggtggtttcgtgtagctatttaaagagtcagtgtgaggtgcgtctggtggagtcgtggaggnggtcctgactccaggtccgtggggggtccctgacgactcctccgtggtcgcacgccttcgtcggggttaccaccggtcacgtccaacaaccttacagtcgtacggtttcggggcccgacccggagggtcccgtaccggggaaggggggtaacgggggtccgttaaggggtaccgggtttggggtttaccttttacccggtttttaattaaccggacggttagttaacgggttaagggttaacgtaacctatttaaccggttcccgaacgtacgtacccgtttaccgggtacggggtaccggggtaccttagtcccgtaacctacgtaccgtaccgtaagaaccgtaactaaccgtaacggttaaaccgaaaccggtacgttaccgttttacgttttaaaccttaacgtaaaaccggttacgtaaaaccgtaaccgggttcccggttaaggaacgggttaacccgtacggaaccggttaccggtaaacccggacccgggttcggtttaacttacggtttaaaccgttcggggaccctaggggtaaacgtaaccggggtaccggttacgggggaaaacccccgtttcgggaaaaccccggtttttaacggtacccggttaaggtttaccggttaccgggggtaacccgggtttccggggtaaacggggggtaaccccggtaacccgggggaccgttaaaccccgggg

SEQ ID NO: 269731 - DNA, 749 bp, Homo sapiens
  misc_feature: GYAE6OF02G5Y4R.11.25.C03.1.454.CMB.1.raw
  modified_base (379)..(379): a, c, t, g, unknown or other
  misc_feature (379)..(379): n is a, c, g, or t
  modified_base (408)..(408): a, c, t, g, unknown or other
  misc_feature (408)..(408): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttattttaaaaggagtccagtgtgaggtgcgtcgtggtggtagtcgtggaggacggcctgatccgagccgtggggggtccctggacgactctcctgtcgcacgcctcgtcggttccaccgtcagtccacacctacatgtagttcgggtccgacgacggccgtaccggaagggggaacgggcgtgggaggttcgggttccttcgttttaacttacgngctaggtaggtaatacgattactccgganacgtaccgtccgtagggacggggtacctacgttaccacccgaattcccgtaacgtaaacgaacggtaaaccaaaccttaaccgtaaaacggtaaaccgtaaccgttaccgttttaccggttttaaccttaaaacgtaaacgttaacgtaaaaccgtaccggtaacccgtagggtaaaccgacggtaaccgtaacgtacggaaccggaccgggttaccgttaagttagttaaccgtgtacggcgtaagacggtacgttcggggaccctaacggtaaccgtttaacgtaccgtacgtagtacggtaccggtcgggtacgggaccggtacgggaccgtaaccgg

SEQ ID NO: 269732 - DNA, 846 bp, Homo sapiens
  misc_feature: GYAE6OF02IW9U5.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtggggggtccctgagactctcctgtgcacgcctcgtgggttccaccgtcagtcacacctacatgagttcgggtccgccgaggctaccgaggggacgggcgtagggaggtcgggttcttcctttatttacgagtcgtaggttaggtaacgtacgtaattacgttccgaccgtaacgtaccgttcccgggtagggacgggggtacccgtaacgtttccgaaccctaacgttcccgtacccgtaacggaacgtaaaccgtaaacccgtaaccgttaaaaccggtaaacccgtaacccggtaccgtttaaccggttttaacccgtttaacccgttaaaacgtaaccggtaaaccgtaaccggtaccgttacggtaacggaaccggaacccggtaacgtaccggtaaccgtcccggggttaaaaaaaacccggttcggttaaacgtttaccgttacggttacggtaaccgggtaacgggtaacgggtacggtacccggggtaccccggaaacccggttaaacccggttaaccgttaacccggttaccgttaaggttaccgggtaaccgggttaccgggtaccgggggtaacccgggtaacccggggtaacccggtaaccccggg

SEQ ID NO: 269733 - DNA, 836 bp, Homo sapiens
  misc_feature: GYAE6OF02I507Z.11.25.C03.1.454.CMB.1.raw
  modified_base (112)..(112): a, c, t, g, unknown or other
  misc_feature (112)..(112): n is a, c, g, or t
  modified_base (154)..(154): a, c, t, g, unknown or other
  misc_feature (154)..(154): n is a, c, g, or t
tcagcgagagataccacgaccggtgctcgatttagtagtgtagattttgggtttggggggagaggacgcccagcacgtgggattccgaggtgtttccattcggtgacccctnagcactagaacacagaggacctcaccagtggtagtttgctgngtcgtttgggtttttccttggttgtactttaagttttaaaaacggacgttccgtagttggtggagggtgtcgttcggttgggtggtacgttcgtggggaaggcggtccgtgacgtccgcggtcccgggttcggggggtccctaggtaccgtaccgttccgtccgtgtcgcgacggtccgttcggttccggttccgtaccgtcgtacgttaccacctaacccgtaactggtacggtacgggttccggtcccgacccgacgggtccgtaccgggaagggggtacgggtcgtaggggtcggttcggttacctttccgttttaacgtttacgaggttacggtacggttacgtagtaactacgttacgtcgacgtaacgtccgttcggagggtaccgggtcctaacgttccaaccgtcgtcctacgtagaaccacgtaaccgtaactaaacggactcggttacttcgtttaccaagtaaacgcgtaaacgtcgtaccgtagtacgccgaccggttacgacgaacccgtccggtaccgtttgttaaccgtgtttcggacgacgttacggcggttaccggcccgggtaaccgtaacccgggttaaaccgttccgtaaccggtgtttacccggtagggtacccgttaccggggtcccgggaaccggttaaccggcccggttaaccccggg

SEQ ID NO: 269734 - DNA, 676 bp, Homo sapiens
  misc_feature: GYAE6OF02F7TD7.11.25.C03.1.454.CMB.1.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcccgatccagccgtcggggggtccctgacgactctcctgtgcacgcctctggttcaccgtcagtcacacctacatgaggttcggtccgccgaggcctaccggaagggggaacgggggtcgtgggaggttcggggtccttccgttttatttaacgagtctaggtggtagtacatacttccgcacgactccggtggacggggtcactcacctactctaccgagacactaactctaaacgaaccacgtctttagtttccttaacaaagtacgaaacgtacgtccgtaggacgacgccgtaagcgaaccgaccggtccgttagttacttacggttcgtaggcggtaacgaggtacgggtcccggggaccctaaccgggtaaaccgttaccggtaaccggtcttaacggtcgggttaaccggtccgggtaaccggggacccgaaccgggggaccctacggggtacccc

SEQ ID NO: 269735 - DNA, 850 bp, Homo sapiens
  misc_feature: GYAE6OF02IUED1.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctgggtggagtctgggaggaggcctgactccagccgtggggggtccctggacgactctcctgtcgcacgtcctcgttcgggtcaccgtcagtccaccacctacagtgtaggttcggtcccgccgacggcctccggaaggggggaacggggtcggtaggggtagggtttcggggttccttttaccgtttttaacgtttaccgaggtaccggtaggttagggttaactaacgtaactttaccgttacccgtacgaacggtcccttacgggtcggggtaaccgggggtacccttacgtttacccaacccgttactacccgtacccgaaggaaccggtaaccctaaaaccgttaccgtaaaaaccgggtaaccctacggtttacctttacggttttaccttaaaccgtaaacgttaaccgaaacctaccgggttaccccgtaaggaccgggtaaccgtaccgggattaccgggaacccgtaccggggtaccgtttagttaacgtttaccgtaggttacggacggaaggggtacgtacggggtaccggggtaacccccgtaacgggttaaccgtttaccggtaacccgtagttttaacggccgggttaacggtcccggggtaggggtaacccggaacgggggtaccccgttaacccgggg

SEQ ID NO: 269736 - DNA, 734 bp, Homo sapiens
  misc_feature: GYAE6OF02GSUJL.11.25.C03.1.454.CMB.1.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtccacacctacatgagttcgggtccgccaggctccgaggggagggctggagtgggtctcctttattacagctagtggtatacatacttccgcagactccggtggacgggccgtagttccaacctatcctaccgaagacgaaccaaccttactaaaacgaacctaccggtctttacggttttaccttaacgaaaattcggaaaacccgtaggacccttagggaaacgtacgggacccggtaagtacgggaaccccgtaaccgggggtcccgttttaagggttaaacgttttaccgttagggttacggaaccgggaagggtaacggacgggttccggggggaaccccctaaaccgggtaaaccggttttaccccgtaacggtccctttaaggttacgggtaccgggttccgggtaccggggggaaccccttaaacggggggaccccttaaccccggggg

SEQ ID NO: 269737 - DNA, 682 bp, Homo sapiens
  misc_feature: GYAE6OF02I635H.11.25.C03.1.454.CMB.1.raw
  modified_base (315)..(315): a, c, t, g, unknown or other
  misc_feature (315)..(315): n is a, c, g, or t
  modified_base (546)..(546): a, c, t, g, unknown or other
  misc_feature (546)..(546): n is a, c, g, or t
  modified_base (628)..(628): a, c, t, g, unknown or other
  misc_feature (628)..(628): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgactccagccgtggggggtccctggagtacctctccgtgtcgcacgtcctcgtacgggttccaccgtcacgtccaccacctacagtgagttgggccnccgagctacgagggagggctgggcggtgggtccttaccgtttatttacgacgtcgtaggtagttacgtactaattactccgacacgtaccgtccggtaggacggggccgtattaccgacctactctaccgagaacgtaccaaactaccgtaaaacgaaccgtctcgtttaccgtttaaccttaagaaacgtacaaagtaccgccgtaaggagacgtaccaagtcggaaccnccgggtactacgttacttaccgtaggtcgacggacggtagtacggccgggtacccgtaaacggttaaccgttacgtaccgtnttaacggtacggtaccgttacgggccggggtaccgaaaccggtccgtaacccgg

SEQ ID NO: 269738 - DNA, 135 bp, Homo sapiens
  misc_feature: GYAE6OF02I0TMW.11.25.C03.1.454.CMB.1.raw
  modified_base (118)..(135): a, c, t, g, unknown or other
  misc_feature (118)..(135): n is a, c, g, or t
tcagcgagagataccacgaccggtgctcgatttagtagtgtagatttgggtttggggggagaggagcccagcactgggattccgaggtgtttccattcggtgatcagcactgaacacnnnnnnnnnnnnnnnnnn

SEQ ID NO: 269739 - DNA, 745 bp, Homo sapiens
  misc_feature: GYAE6OF02IMTQS.11.25.C03.1.454.CMB.1.raw
  modified_base (288)..(288): a, c, t, g, unknown or other
  misc_feature (288)..(288): n is a, c, g, or t
  modified_base (629)..(629): a, c, t, g, unknown or other
  misc_feature (629)..(629): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggagggacggcctggactccgacggtccgtcggggggtccctgacgtactctccgtgtgcagcctcgtggttcaccgtnagtccacacctacagtgtaggttcggtccgccgaggcctaccggagggggaacgggcgtggggtaggtggttccttaccgttttatttacgagtctaggtggttagtactagttaacttcccgcgtaacggtaccgttccgtgggaacggggtacccgtacgttccaaaccctcttaccgtacccgaaggtaaccgaaccctaaaaccgttaccgttaaaacgaccctaacgtcgtttacgttttacctaaataaacgtacgttaaccgaccgttacgtacggagtacggtaacccgtagttacgaacccggtccggtaaccgttagtaaccttttaacgngggttaccgacggacggtaggtccggtaaccgggtccctaaacggtaaccggtttacgacccgtacgttaggtcggtaaccggttcggaccggggtacccagggcccctaccgggg

SEQ ID NO: 269740 - DNA, 745 bp, Homo sapiens
  misc_feature: GYAE6OF02HL2NR.11.25.C03.1.454.CMB.1.raw
  modified_base (176)..(176): a, c, t, g, unknown or other
  misc_feature (176)..(176): n is a, c, g, or t
  modified_base (293)..(293): a, c, t, g, unknown or other
  misc_feature (293)..(293): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttattttaaaaggngtccagtgtgaggtgcgtctggtggagtcgtggaggaggcctgatccagccgtcggggggtccctgagctctcctgtgcacgccttcgtggggttcaccgtcagtccaccacctacntgaggttcgggtcccgccgaggcctaccggaggggacggggctagggacggttgggttccttaccttttagttacagtcgaggtggtacgtactatacgttccgactacgtaccgtccggtgggaccgggggtaccctaacgtttaccaacccgtacttcccgtacccgaaggaaccgtaaccctaaaccgtaaccgtaaaacggaaacctacggtacctttacggttttaccttaacaaagttacgaaacctacggtccgttagaacggtcgaccgtacttcggaaccgtccggtccgttaagtacgtttcgtaggtcgaccggagtacggtaggtacccgggggtaccccgtaaggttaaacccggtaccgtaaccggtaccgttaagggtaccgggtaccggttaccgggtaccgggggaacccgtaacggggtaccccgtaacccggg

SEQ ID NO: 269741 - DNA, 816 bp, Homo sapiens
  misc_feature: GYAE6OF02HPHDR.11.25.C03.1.454.CMB.1.raw
tcagcgagagataccacgaccggtgctcgatttagtagtgtagatttgggtttggggggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtcgtggaggaggcctgactccgacgccggtcggggggtccctggacgtactctcctgtgcagtcctcgtgggttccaccgtctacgtcaccacctacagtggtaggttcgggtccgccgacggtccgtaccgggaagggggaacgggggcgttaggggtacggttcggggttcctttaccgtttttaacgtttaacgacggtcgtaaggttagggtaacgtaacgtaacgttacgttcccgacgtaacggtacccgtcccgggtacgggtaacgggggtccgtaactttacccgaaccctacttacccgtaaccgaacggtaaccgaaacccgtaaaccctaaccggtaaaaccgaacccgttaccgttaccttttacgtttactaaactaacgtaaccgtacgtacctacggtgaacgaccggtaccgagtaccgacccggtaccggtacgttacggtttacgttacgtcggttacggacgtaaggaccggtacgggtaacccgggaacccggttaaaccgttaccgtaacgttaccggtacgttaaggtccggttacccgggtacggggtaccgggtaacccgggtacccgggtacccggtaaccccgg

SEQ ID NO: 269742 - DNA, 777 bp, Homo sapiens
  misc_feature: GYAE6OF02GHT1Z.11.25.C03.1.454.CMB.1.raw
  modified_base (179)..(179): a, c, t, g, unknown or other
  misc_feature (179)..(179): n is a, c, g, or t
  modified_base (300)..(300): a, c, t, g, unknown or other
  misc_feature (300)..(300): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgttgggttttccttgttgcttaattttaaaaggngtccagtgtgaggtgcgtctggtggagtcgtggaggaggctagactccgagccgtgggggtccctgacgacctcctcctgtgcacgccttcgtcggttccaccgtcacgtaccacacctanatgaggttcggtcccgaccgacggccgtaccggaagggggacgggtcgtgggtaggtcgggttcctttaccgtttacgttacgacgtacgtaggttaggtaacgtactacgtttaccgtaccggacgtaacgtaccggtttcccgggtagggtacggggtacccgttattacccgtacccgtattccctacgaacggacgtaacctaaccgtaacgtaaacggaaccctacgggttcctttacggtttaacctaacgtaaacgttacgaaaccgtacgttaccgtagaaccgtacggaccgttaaggaccggtaccggtaccggtaccgttaggttaacgttacgtggtacgtacggagtacggtaccgggtccgggaaccctaacggggtaaccctttaacggaccgtacttaacggggtccggttaccgggttaccggtacccggggaaccgtaacggggccccgttaacccggg

SEQ ID NO: 269743 - DNA, 779 bp, Homo sapiens
  misc_feature: GYAE6OF02G7QL6.11.25.C03.1.454.CMB.1.raw
  modified_base (177)..(177): a, c, t, g, unknown or other
  misc_feature (177)..(177): n is a, c, g, or t
  modified_base (312)..(312): a, c, t, g, unknown or other
  misc_feature (312)..(312): n is a, c, g, or t
  modified_base (580)..(580): a, c, t, g, unknown or other
  misc_feature (580)..(580): n is a, c, g, or t
  modified_base (589)..(589): a, c, t, g, unknown or other
  misc_feature (589)..(589): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgactccagccgtgggggtccctgagactctcctgtgcacgtcctcgtggggttccaccgtcacgtcaaccacctacatggaggttcgggtcccncgacggcctaccggagggggaacggggctaggggaggttcgggttcctttaccgttttatttaaccgagtcgtaaggttagggttaacgtaactatttacgttcccgactacggtaccgtcccggtaggggtaccgggggccccttaagtttacccacctacgtccctaccgaaggaacgaaccctaaactacgtaaacgaaaccctacggttctttacggtttaccctacaaaagttacgaaactacggtaccctaggacggtaccnccggttaanaacggtacccgaccggtccgttagttaacgtttacgtggtacggaacgtaaggtacgggtacggtacccggggaacccctaaacggggtttaaccgtttaaaccgtaaccgggtcttaaacgggtaccgggtaaccggttccggtaacccgggggggaaccctaacccgggggtaccccgtaacccgggg

SEQ ID NO: 269744 - DNA, 839 bp, Homo sapiens
  misc_feature: GYAE6OF02HIN0F.11.25.C03.1.454.CMB.1.raw
  modified_base (177)..(177): a, c, t, g, unknown or other
  misc_feature (177)..(177): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttatttaaaaggngtccagtgtgaggtgcgtctggtggagtcgtgggaggaggcctgactccagccgtggggggtccctgagctctcctgtgcagcctcgtgggttccaccgtcagtccaccacctacatggtaggttcgggtcccgaccgaggcctaccggaagggggaacggggtccgtaggggaggttcggggttacctttaccgttttaagtttaaccgacggtacgttaggggttagggtaacgtactaagttacgttcccggataccggtacccgttcccgggtagggaccgggggtaccctaacgtttacccaacccgtacttacccgtaacccgaagggtaaccgtaaaccctaaacccgtttaaccgtaaaaaccggaaacccgtaccgggttccttttacggttttaaccctaactaaaacgtacggaaaccgtacgtcccgtaagacgggtacgaccgtagtaccggaaccgtacccgggttaccgttagttaacttaccgtggtaccggacgtaacgggacggtacgggttaccggggacccccgttaaacgggttaaacccgtttaccggtaaacccggtacgtttaacggttccggggtaaccggtttcccgggtaaccggggggtaaccccggtaacggggtaaccccgtaaccccgggg

SEQ ID NO: 269745 - DNA, 945 bp, Homo sapiens
  misc_feature: GYAE6OF02INHMY.11.25.C03.1.454.CMB.1.raw
  modified_base (202)..(202): a, c, t, g, unknown or other
  misc_feature (202)..(202): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggngtctggaggaggcctgactccgagccgtcggggggtccctgagacctcctcctggtcgcacgcctcgtcgggttccaccgtcagtccacctaccctacatggtaggttcggggtcccgccgaggcccgtcccggaagggggaacgggggcgtaggggacggttcgggggttcctttacccgttttaacgttttaaccgtacggacgtaacgggttaggggttaacgttaacctaagttaccgtttacccggtacgaacggtaacccgtttcccgggtacggggtaacgggggggtaccccgttaagtttaccccgaaccctaaccgtttacccgtacccgtaacgaacggtaaacccgtaaaaccttaccgtaaaaaacggtaacctaaacccggttccgtttaccgttttaccgtttaaacccgtaaaaacgttaccggtaaaaccgtaaccggttcccggttaaggaaaccggaccggtacccgaacggttacgggtaacccggaaccggggtccccgtttaaggtttaaccgtttaaccgttaggtccggtaacgggaacggggtaacggtaacgggtaccccggggggtaacccccgaaaccgggtttaaaacccggtttaaaccggtaaaccggtacccgttaaagggttacccggggttaacccgggttcccggggttaacccggggggggtaacccccggttaaaaccggggggtacccccggttaaaccccgggg

SEQ ID NO: 269746 - DNA, 959 bp, Homo sapiens
  misc_feature: GYAE6OF02JFVEY.11.25.C03.1.454.CMB.1.raw
  modified_base (176)..(176): a, c, t, g, unknown or other
  misc_feature (176)..(176): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtgggttttccttgttgctattttaaaaggngtccagtgtgaggtgcgtcgtggtggagtcgtggaggaggccgtgactccgacgccggtcgggggtccctgagacctccgtccgtgtgcacgtcctcgtcggttccaccgtcacgtcgaccacctactatgaggttcggtcccgccgacggccgtccggaaggggaacggggcgtacggggtaggttccggggttcctttacccgtttttaacgtttaaccgtacggtaccgtaagggttacgggttaaacgttaaccgtaagtttaaccgttccccggtacgtaaccggtacccgtttaccccgggttagggaacccgggggggttacccctacgtttaccccgaaaccccgttacgtaccccgttaaccgtaaacggtaacggaaaaccccgttaaaacccgtttaacccgttaaaaaaccggtaaacccggtaacccggttacccgttttaacgggtttttaacccttaaacccgttaaaaagttaccggttaaaaaccgacccggttacccggttaacggaaacggtaacccggtaccggtaaaccgttcgggaaacccgtacccgggttaccggtttaaacgtttaacgtttaaccgttacgggtttaacgaccgggtaaaagggtacggtaaccgggttcccggggtaaacccccgttaaaccgggttaaacccgttttaccggttaaaccggtaccgttaacgggttacgggttacccggtaaccggggtacccggggtaaccgggtaaacccggggtaccccggttaacccgggg

SEQ ID NO: 269747 - DNA, 697 bp, Homo sapiens
  misc_feature: GYAE6OF02G1QJC.11.25.C03.1.454.CMB.1.raw
  modified_base (279)..(279): a, c, t, g, unknown or other
  misc_feature (279)..(279): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
  modified_base (377)..(377): a, c, t, g, unknown or other
  misc_feature (377)..(377): n is a, c, g, or t
  modified_base (607)..(607): a, c, t, g, unknown or other
  misc_feature (607)..(607): n is a, c, g, or t
  modified_base (668)..(668): a, c, t, g, unknown or other
  misc_feature (668)..(668): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccagtggtagttttggctgacgcgtttcgggttttcctttgttgtacgttaagtttttaaaaaggagtaccagtgtgaggtgtcgtcgtggtggagtcgtggaggagctgactccgagcggtcgggggtcctagacgtctcctctgtcgacncgtcgtcgtcggtcaccgtnacgcacactanagtgtggtcggccgacgcgtactcggaagggnggtacgtggaggttcgttacgttctttaacgtcgngtacgtgtaaggtactacgtagttaccgtacgcgacgttaccgtcggtaacgggcgggtaccgttactaccgtaccgtactaccgtacgacgaaacgactaacgttaacgtaaacgacgtacgttcgtttcgtttaacaacgtaaacgtcgaaagtacctacgagtaacgaccgttacgagttacgggaccctaccgggtactcgtttaacgtcggtactggaacgaagngttacccgggaaccggacccgtaaaccggtattacccggaatccgtaacgtcgggtaccgngggtaccggaacccggaggtacccctcgg

SEQ ID NO: 269748 - DNA, 764 bp, Homo sapiens
  misc_feature: GYAE6OF02G6MKB.11.25.C03.1.454.CMB.1.raw
  modified_base (179)..(179): a, c, t, g, unknown or other
  misc_feature (179)..(179): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggttttccttgttgctattttaaaaggngtccagtgtgaggtgcgtcgtggtggagtctgggaggaggcctgactccgagccggtgggggtccctggagacctctccgtgtgcacgcctcgtgggttccaccgtcacgtccaaccacctacacgttgtaggttcgggtcccgccgacgggtcctaccgggaaggggaacggggtcgttagggaggttcggggttcctttaccgttttaattacgacgtcgtaggttagggtaacgttacgtattaccgttccgactaacggtaccgtttccggtaggggaccggggtacccgttaacttaccgaaccgtacgttcccgtaccgaaggaacctaaaccctaacgtaacgtaaaacggaaacccgccgtttcgttttacgttttacctaacgaaagttccggaaaactcgtacgtaggaacgtacggaacctagtacggaacccgtacgggttccttaggttacgttacgtggtacggaacgtaggaccgtacggtccgggaaccctaacggttaccgttacaacggtacctttagggtacggtacccgggttgaacccggggaccgtaacgggtcccggtaccg

SEQ ID NO: 269749 - DNA, 797 bp, Homo sapiens
  misc_feature: GYAE6OF02IPAMA.11.25.C03.1.454.CMB.1.raw
  modified_base (347)..(347): a, c, t, g, unknown or other
  misc_feature (347)..(347): n is a, c, g, or t
tcagcgagagataccacgaccggtgctcgatttagtagtgtagatttgggtttgggggggaggaggagcccagcactgggacttccgaggtgtttccattcggtgatcagcactgaactacagaggacctcaccatggagttttggctgagcgtggttctgtagctattaaagagtcagtcgtgagtcgcgtactggtgtagtcgtaggagagcctagactccgagccgtcgggggtaccctagacgtaacgtcgtccgtagtacgtacacggtcctcggttaggttacctaccgtacgtacgtaccgaaacctaccgtacgaaagttcgaacggttcgggtacccncgtaacgtactaccggtaaggggtaacgggcgtacggacgttacggtaccgttaccgttttaactaacgacgtccgtaaggtaggtaactacgtagtaagttccgataacggtcgttacggtagaacgggtcctaacgttccaaccgtactaccgtaacgtaacgaacggtaacctaaacgttaccgaaacgaaaccgtacgttaccgtttacgttaaccgttaacgtaaacgtttaacgaaaccgttaaccgtacgttaaccggagtaaccgtacggtaacttaacggaacttaccgggtccgttaagtaaccgttacgttaacgtcggtaacgaacgggttacgacgggttaccggaaacgtaccggttaaaaccgtaccgtaacgttaccgttaacggtacggtaacgtaccggtaccgggaaccgttacggtacccgttaacccgg

SEQ ID NO: 269750 - DNA, 599 bp, Homo sapiens
  misc_feature: GYAE6OF02H29IE.11.25.C03.1.454.CMB.1.raw
  modified_base (306)..(306): a, c, t, g, unknown or other
  misc_feature (306)..(306): n is a, c, g, or t
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaaggagtccagtgtgaggtgcgtctggtggagtctggaggaggcctgatccagccgtggggggtccctgacgactcctcctgtgcagcctcgtgggttccaccgtcagtcacacctacatgtagttggtccnccaggcctccgaggggaggggntggngtggtcttctttattacngcagtggtatacatacttccgnacgctcgnggagggcctatccacatccacagagactaactctaaagaccacgtcttagtttactacaaatcgaactacgcctagaacgacgccgaatcgaaccacgggtccttagtactttaccggtacgcgaagagtagtccggggaccctaaacggtaacgtttacaacggtactaagtcgggtaccgttaccggtacggggaaccaacggggaccctaaccggg

SEQ ID NO: 269751 - DNA, 707 bp, Homo sapiens
  misc_feature: GYAE6OF02JARWL.11.25.C03.1.454.CMB.1.raw
  modified_base (249)..(249): a, c, t, g, unknown or other
  misc_feature (249)..(249): n is a, c, g, or t
  modified_base (461)..(461): a, c, t, g, unknown or other
  misc_feature (461)..(461): n is a, c, g, or t
  modified_base (545)..(545): a, c, t, g, unknown or other
  misc_feature (545)..(545): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccagtggagttttggctgagtcgttgggttttcctgttgcttaagttttaaaaggagtccaggtgtgaggtgcgtctgggtggagtctggaggaggtcctgatccgagccggtggggggtcccngacggactctccgtggtgcgagtccgtcgtcgggtcctaccgtcacgtcaccgtactacgatgtcggttcgggccgacgtacggcctacgggacgggagggtccgtaggcggttcggtccttttccttagttacgcgtagtaggtacggtactaacggcttacgtaccgtccacgtaccgtcggtggtaccgggtcgtaacttccgaaccgntacccgtaacagtaacgtaacgaccgttaacgtaaaacgtaccgattacgttactttaccgtaaacttaacgtaacggtaaccnccgtacgagtacgacgtaccgaaggtaccgtacgtaccggtacgttaagttcgtagttcgaggtcgtacggtagtacggtaccgggtacgtaaaccggtaacgtaccgtacggtattacggtaccggtcggtccgggtacggaaccggtacggacccgtccg

SEQ ID NO: 269752 - DNA, 852 bp, Homo sapiens
  misc_feature: GYAE6OF02IDIH9.11.25.C03.1.454.CMB.1.raw
tcagcgagagataccacgaccggtgctcgatttagtagtgtagatttgggtttgggggagaggagcccagcactgggattccgaggtgtttccattcggtgatcagcactgaaaacagaggactcaccatggattttggctgagctgggttttccttgttgctattttaaaggagtccagtgtgaggtgcgtctggtggagtctgggaggaggcctgatccagccgtgggggtccctgagactctcgtagtgcagcgtcgtggtatttccaacccgtttcgaagggtagccttaaagtcggaacctagttcggaccgtaacggttcgggggtaccccgcccgtaacggtccttaccggaacgggtaacggaacggggggtccgtaggggtacgggttcggggtagggccttaaagggtttacctaggttacgggtaagttcggaagttaggggtaaaagtttaaactaaaacttacgttaggtagggaaccgttaacgtcccgggttaagggaacggggcctttaacgttaccgaaacctacgttccgtacccggtaacggtaacgtaaccgttaaccgtttaaaccgaaaacgggttaacctaacggggtttaaccgttaagttaccggtttaacggaaacttaaaaggttaccggaaaaccgtacgggttaccgtaaggaacgggacccggaaccgggtaagacccggtaacgggttcctaagggttttacgttaacgtttacccggtagggtttccgggaaaccggggttaaacggggaaacgaccggaacgtaaccggttcgggtacgggaaaccgggtaggggacctttagggaacgttttaccggg

SEQ ID NO: 269753 - DNA, 864 bp, Homo sapiens
  misc_feature: GYAE6OF02FYTZ2.11.25.C03.1.454.CMB.1.raw
  modified_base (277)..(277): a, c, t, g, unknown or other
  misc_feature (277)..(277): n is a, c, g, or t
  modified_base (719)..(719): a, c, t, g, unknown or other
  misc_feature (719)..(719): n is a, c, g, or t
  modified_base (750)..(750): a, c, t, g, unknown or other
  misc_feature (750)..(750): n is a, c, g, or t
tcagcgagagataccacgaccggtgctcgatttagtagtgtagatttgggtttggggggagacggagcccagcactgggattccgaggtgtttccagttcggtgatcagcactgaacacagaggactcaccatggtagtttggctgagtcgttgggttttccgtttgttgtcttaagtttaaaaggtagtccagtgtgtaggtgtcgtcgttggtggtagtcgtggaggaggtccgtgactaccgacgccggtcgggggtcccgtcggacgtacctntccccccccccccccccccccccctgtcggcgacgccgtccgttcgggttccgaccgtccgacgtacctaccgtaccgtaacctactacggtacggttacgggttccccggtcccgtaaccggtaccgtaccggtaacggggaacgggggtacggtacgggtaacgggttcggggttaccgtttaccgttttaacgtttaacgtacggacggtaacggttacggttaggttaactaacgttaacgttacccggtaccgtaccgtaccggttccggtacgggtaacggggtaccggtacttaccgtaacctacttaccttaccgaacggtaaccggtaactaaacccgttactaaaacggaaaccctcggttctttacgtttaccttaacaaaagttacgaaacgttaccgccgttagaaacgcggtaccgacttaggacccnggggtacccttagttatttaccgggttacgnggaacggtagtacgtcccggggaacccttaacggtaaacccgtttaacgtccggtacttaggtacggtacccggttcgggtaccggggaccccgtaagggtacccctacccggg

SEQ ID NO: 269754 - DNA, 833 bp, Homo sapiens
  misc_feature: GYAE6OF02HA527.11.25.C03.1.454.CMB.1.raw
  modified_base (174)..(174): a, c, t, g, unknown or other
  misc_feature (174)..(174): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttatttaaaggngtccagtgtgaggtgcgtcgtggtggagtcgtgggaggacggtcctagactaccgaggtccgggttacggggggtccctagaacggtaccttccgtccgtggtcgaccgtacggtacccgttccggttacgggttaccgtacccggttacctacggttaccaacccgtaaccgttacgtaacgttacggtacggttccgggtacccgaccggtacgggtccgtaaccgggtaagggggaacgggtcggtaaggggtacggttacggtttacctttaccgtttaactacgtacgtcgtaacgggtacggttacgtaacgtattaccgtaccgtacgtacggtacgtcgggtacgggtaccgggtactactacctaaccgtcgtaccgacgtaacgaacgtacctaacttaaccgaacgtaccgtacgttccgtttagttaaccgttactaacggtcgaaaccgtcgttaccgtaggaacccgtacggtaacgtaccggttacggtaccgtacccggtttcggtaactttacgttacggttggcgtaacggtagtaaccgggtcggtaacccggtaccgttaaccgggtacttacggtacgtacggttaggtaccgggttacggttccggaaccgggtaaccggtaccggaccgttaccgg

SEQ ID NO: 269755 - DNA, 663 bp, Homo sapiens
  misc_feature: GYAE6OF02IA0LE.11.25.C03.1.454.CMB.1.raw
  modified_base (307)..(307): a, c, t, g, unknown or other
  misc_feature (307)..(307): n is a, c, g, or t
  modified_base (606)..(606): a, c, t, g, unknown or other
  misc_feature (606)..(606): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtctggaggaggcctgactccagccgtcggggggtccctgagactctcctgtgcagcctcgtcggttcaccgtcagtcacacctacatgtagttcgggtccnccgaggcctccgaagggggaggggctgggacggttgggtcttacgttttattacgagctaggtgtagtactactacttccgacagtacctcggtaggacgggcctatccaccatcctaccagacgaactaactacgtaaagacccgtagtcgtttacgtttaccttaacaaaagttcgaaactcgtccgtagacgtacgaccggataccggaaccaccgggtcgttagttaattaccgttggacggcgaaggtcgaacggttccggggaccctaagggtaaaccgttaccgtaaccggngttaacgtccgggtaccgttcgggaccggggaacccgacggggtaccctaaccgggg

SEQ ID NO: 269756 - DNA, 757 bp, Homo sapiens
  misc_feature: GYAE6OF02HAVWN.11.25.C03.1.454.CMB.1.raw
tcagcgagagataccacgaccggtgctcgatttagtagtgtagatttgggtttgggggggagaggagcccagcactgggattccgaggtgtttccattcggtgatcagcactgaacacagaggactcaccatggagtttgggctgagcttgggttttcctcgttgcttacttttaagaggtgtccagtgtcaggtgcaacgtggtgagtcgtgggggaggcgtggtccaggccgtagggacgtccctagacgtacctctcctgtcgcaggtcgtcgtaggtacttccgaccttacgaaggacgtaccttaagtcggaactagtcggacctacgggtaccggtcccggaccgtaacgggtcctacccggaacgggtacccggaacgggggtccgttaaggggtaagggttcggggtaaggaccgttaaaggttaacgtacggttaggttaagtacggttaaacgtacgggttaaattaaagtaaacgttactaaggtacggtaacgtacccgtacggtaaggtaaccgggtaccgtacttaccggaccctaacgtccctaaccgaaggtaccgtaaccgtaccgttaaccggaaacgtaaccggtacggttaacgttacgtacgtacggtaaacctaacgtacgaacgacggtaccgaaggtacgacggacgacgacgtacgtacgttgtacgtagtcgtacggcggtaacggaacggaacgacgcgtacggacgcggacggtaggtacgtggtaacg

SEQ ID NO: 269757 - DNA, 725 bp, Homo sapiens
  misc_feature: GYAE6OF02G4H0X.11.25.C03.1.454.CMB.1.raw
  modified_base (679)..(679): a, c, t, g, unknown or other
  misc_feature (679)..(679): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggtagttttggctgagctgggttttccttgttgctattttaaaaggagtccagtgtgaggtgcgtctggtggagtctggaggaggcctgatccagccgtggggggtccctgagtctctccgtgtgcacgtcctcgtcggttccaccgtcagtccaccacctacacgtggtaggttcgggtcccgccgacggtcctaccgggaggggacggggtccgtaggggtaggtcggggttcctttccgttttaagtttaccgagtcgtaggttacggttaagtaaccgtagttaccgttccgacgtacgtaccgttccggtaggggaccggggtacccgtactttaccgaacctacgttcccttaccgaaggaactaaccgtaaaccgtactaaaaccggaacctaccgtcgttttcgtttaactaaacgtaaagttacgaacctacgcccgttaagaccgacggtaccgagtccggaaccgtcggtaccgttagttacgttacgtggtcgaaccgagtagaccgggtcgggaaccctaacggttaacgttaccgngaacttaggtcggtacgtcgggacgggacccgacggaccgtacccg

SEQ ID NO: 269758 - DNA, 850 bp, Homo sapiens
  misc_feature: GYAE6OF02FZNO3.11.25.C03.1.454.CMB.1.raw
  modified_base (180)..(180): a, c, t, g, unknown or other
  misc_feature (180)..(180): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgttgggttttccttgttgcttaattttaaaaaggngtccagtgtgaggtgcgtcgtggtggagtcgtggaggaggcctgatccagccggtcgggggtccctaggacgacctctccgtggtcgcgacgccttcgtcgggttccaccgtcgacgtccacacctacgatggtacggttcggggtacccgccgacggtccgtaccggaagggggacggggtacgtgggacggttcgggttcctttaccgttttaacgtttaccgaggtcgtaacgggtttagggtaacgtaacctaagttacgttacccgacggtaacgtaccgtttccgggtacggggaacgggggtacccgtaacgttacccgaacccttaacgttcccgtaaccgaaggtaacgtaacccaaaacgtttaccgtaaaaacgaaccccgtagttcccttttaggttttacctaaaccgtaaaagttccgaaaacccgtggtacccgttaagggaaaccgtccggtaacccggttaagtacccgggtaaacccgtcccgggtaccgttttaacttaacggttttacctcgggtacggtaacgaacgggtacgtaccgggtaccggggtaaccccaaacgggtttaaacccgttacgtaccccgtaggttaaggtccgggtaaccggttccgggaacgggttacccggaaccgggtacccgtaacccgg

SEQ ID NO: 269759 - DNA, 878 bp, Homo sapiens
  misc_feature: GYAE6OF02IH2TL.11.25.C03.1.454.CMB.1.raw
  modified_base (184)..(184): a, c, t, g, unknown or other
  misc_feature (184)..(184): n is a, c, g, or t
  modified_base (327)..(327): a, c, t, g, unknown or other
  misc_feature (327)..(327): n is a, c, g, or t
tcagcgagagataccacgaccggtgctcgatttagtagtgtagatttgggtttggggagaggagcccagcactgggattccgaggtgtttccattcggtgatcagcactgaacacagaggacctcaccatggagttttggctgagtcgttgggtttttccttgttgcttaattttaaaaagggngtccagttgtggtagggtcgcgttcgtggtggagttcgtgggaggacggcctggaactcccgaggtccggttcgggggggtccctaggacgtaccttctcccgtggtcgacgcgtcccgttcggttacggttccaacccggtnacgttccacctaacctatagtggtcggtttcgggccgcccgaggtcccgtaccggaagggggtacgggtcgtagggtacggttcggttccttttaccgttttaagttacgacgtcggtaggttaggtactatacttacgtccgacaacggtccgtacgggacggacgggtactacttaccgacctacttaccggacaacggaacgttaacctaaacgtaacgtaaaaccgtaccgtacgtttcttttacgtttaacctacgttaaaacgtaccggaaaccgttacggtacgtacgggtaacgacccggaacggttaacgttacccggaacggtaacccggggtttcgtttaaattaccggtttacgtaagggtacggtaaccgggtaagggtaccgggttacccgggtacccggggtaaccccttaaaaaccgggttacccggttttaaccgtaacccggtagttttaaacccggggtccggggttaaccggttacccgggggtaacccgggggtaacccgggtaaccgggtacccccggttaacccgggg

SEQ ID NO: 269760 - DNA, 749 bp, Homo sapiens
  misc_feature: GYAE6OF02G4YPY.11.25.C03.1.454.CMB.1.raw
  modified_base (183)..(183): a, c, t, g, unknown or other
  misc_feature (183)..(183): n is a, c, g, or t
  modified_base (287)..(287): a, c, t, g, unknown or other
  misc_feature (287)..(287): n is a, c, g, or t
  modified_base (520)..(520): a, c, t, g, unknown or other
  misc_feature (520)..(520): n is a, c, g, or t
  modified_base (600)..(600): a, c, t, g, unknown or other
  misc_feature (600)..(600): n is a, c, g, or t
  modified_base (605)..(605): a, c, t, g, unknown or other
  misc_feature (605)..(605): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggtttttccttgttgacttattttaaaaagggngtccgagtgtgagggtgcgtctggtggagtcgtgggaggacggcctggactcccgagcccggttcgggggggttcccctggacgaccttccgtcctgtcgaccncggtccttcggttcggggttaccctcccggttcgacgtaccaccctacccctaatagttaggtacggtttccgggtccccgcccgacgggtcccgtacccggaaggggggtaaccggggtcgttacggggagggtttccggggtttcccttttacctttttaaagtttaacgcgtacgttaggggtacggttaagttacgactttaacgtccggactacggtaccgttcgggngaccggggtctacttaccgctactcctaccgagactaacgaaccttacgaaacgaactcgtctttgttaccactaaacgngaacngtccgagacgacgcgtgtcgaacctgggtccgtagttattcgtggagtcagacggtcggtacgggacccctaagggtaacttaccggtccgtagtacgggtacgccggttcgggacgggacccggttaacggaccctaaccggg

SEQ ID NO: 269761 - DNA, 892 bp, Homo sapiens
  misc_feature: GYAE6OF02GXLOS.11.25.C03.1.454.CMB.1.raw
tcagcgagagataccacgaccggtgctcgatttagtagtgtagatttgggtttgggggggagaggagcccagcactgggattccgaggtgtttccattcggtgatcagcactgaacacagaggactcaccatggagttttggccgagctggttttccttgttgtcttaattttaaaagtagtccagtgtgaggtgtcgtctggtggagtcgtgggaggacggtcgtgataccacggccggtcgggggtcccgtgagtactctcctgtgcacgccgtcgttcggtactaccggtactacgtacacctaacctaacagtcgtaggttcgggtcccgacctacggccgtaccggaagggggaacggggtcggtagggtagggttacgggttcccttttaccttttaacgttttaacgtaacggtacgtaaggttacgggttaacgtaacgttaaacttacgtttcccgtaaccgaacggtaacccgttacgggtacggggtacggggtacccgttaaccttacccgaaccctaccttacctacccggaaagacctaaaccaaacctttaaactaaaaccgggaaaccctaccggtttaccctttcggttttttaaccctaaaacggtaaacgtacggtaaacgtaaccggtccgtaagtaaccggacgtccggtacgtacggtaacccgcggggttaccgtttacgtttaacgtttaccgtagggttaccgaacggttaaaccggagggttacccggtaccgggggtaaccctaaacccgggttaaaacgggtttacccctaccggttaacccgttaggttaaccgggaccgggtttaccgggggttacggggaaccccggtttaaccggggacccggtttacccggtaaccccg

SEQ ID NO: 269762 - DNA, 782 bp, Homo sapiens
  misc_feature: GYAE6OF02HDL5C.11.25.C03.1.454.CMB.1.raw
  modified_base (388)..(388): a, c, t, g, unknown or other
  misc_feature (388)..(388): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggttttccttgttgtcttaattttaaaaggagtccagtgtgaggtgcgtctgggtggagtcgtgggaggacggcctgactccgagccgtcgggggggtccctgagacctctctgtgcagcctcgtcggtcctaccgtcacgtccacacctacatgtaggttcgggccgaccgacggccgtaccggagggggaacgggtcggtagggtcggtgggttcccttacgttttactttacgngtacgtagtaggttacttaactagttaacgttcccgagtaaccggtaccctcgggtacgggtacgggggccctaacgtttacccaaccgtactacccgtacgaacggaaccggtaacccaaaaccggttacctaaaacgtacctaaccggttctttacgttttacctaactaaaacgtacggaaacctacggtacctacggaaggtccgtaacgtaccggtacggtaacccgtacccgggggtcctttaaggttaccgttacgtacggggtcaacgggggtaacgtaaggaccggggttccggggaaccccttaaaggttacccggttactaaccgtcgtacggttacggtccggtacgggccgggaaccgtaaaccggggtcccctaaccggg

SEQ ID NO: 269763 - DNA, 716 bp, Homo sapiens
  misc_feature: GYAE6OF02FNGE1.11.25.C03.1.454.CMB.1.raw
  modified_base (310)..(310): a, c, t, g, unknown or other
  misc_feature (310)..(310): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcgtggtttcctgtagctatttaaaaggagtcagtgtgaggtgcgtctggtggagtctggaggagcctgactcagccggtgggggtccctgagactctccgtgtgcacgtcctcggtcggttccaccgtcacgtcaccacctaacatggtacggttcgggcccncgagcctacgaggggagggctggtaggtcgggtcttacgtttagtactagctaggtagtacgtactatacgttcgactacggtaccgtccggtagggtaccggggccttattccgaaccgtacttccctaccggaagaccgtaacctaaccgttactaaacgaaaccgcgttctttacgtttaccttaacaaagttacgaaacctacgtacctaggtaacgacgtaccgagtaccgaacggtacccgggtaccgttagttaactttacggtagtaccggtaggaacggtacgtaggtacccgggacccgtaaacgggttaaccgtttaaccgtaccggtaacgttcggttacggtaccggtttccggggaccgggtaaccggtaaccgggtaacccgttacccggg

SEQ ID NO: 269764 - DNA, 714 bp, Homo sapiens
  misc_feature: GYAE6OF02JMZ7S.11.25.C03.1.454.CMB.1.raw
  modified_base (177)..(177): a, c, t, g, unknown or other
  misc_feature (177)..(177): n is a, c, g, or t
  modified_base (275)..(275): a, c, t, g, unknown or other
  misc_feature (275)..(275): n is a, c, g, or t
  modified_base (404)..(404): a, c, t, g, unknown or other
  misc_feature (404)..(404): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggttttcctgttgctagtttaaaggngtccagtgtgaggtgcgtctggtggagtcgtggagggacggtcctagactccgagccggtcggggggtccctggacgactcctccgtggtacgcgacnccgttcgttcgggttccaccggtcacgtcgaccacctactatggtaggttccgggccgccgacgccgtaccggaggggacgggctagggcggtcggtccttacgtttagtacaggctaggtgtactacngtactccgactaccgtactcggtaggaccgggtactaactccgaaacctctaccgtccgaagacgtactaaccgtataaaccggaacgttaaccgtctttacggtttactaccgtaaagtacgtaaccgtacaccgtaagccgtaacgaccctagttacgaaccggtacgtttacccggagttaacgttttcgacgggtaccgaacggagtacgttccgggacggtaccccgtaacggttaaacgacccttacggacttaacgggtacgtccggaacggttcccgggaacgttacggcccgggtaaccgg

SEQ ID NO: 269765 - DNA, 677 bp, Homo sapiens
  misc_feature: GYAE6OF02F7IRY.11.25.C03.1.454.CMB.1.raw
  modified_base (443)..(443): a, c, t, g, unknown or other
  misc_feature (443)..(443): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggtttttccttgttgcttattttaaaaggagtccagtgtgaggtgcgtctggtggagtctgggaggaggcctgatccagccgtcggggggtccctgagactctcctgtcgcacgcctcgttgggttccaccgtcagtcacacctacatgagttgggtccgccaggctccgaggggaagggcgtggagtggtcttcctttattacagctagttggtagtacatattccgcacgacttccggtggacggggtccagttcccaccgatcctacaggacaacaactataaacgaacnccgtactttcgtttactaactaaataccggaaacacgtccgtaggaacgacggcccgtaagtacgaaccgtaccgggaccgtttagttaacgtttaaccgtggtacggaccgggagtaacggtacgggtcccgggggacccctaaacgggttaacccgtttaccgaacggttccttaaggttccggtaccgggttccggtaaccggggacccgaacggggtaccctaacccggg

SEQ ID NO: 269766 - DNA, 729 bp, Homo sapiens
  misc_feature: GYAE6OF02FHQEC.11.25.C03.1.454.CMB.1.raw
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
  modified_base (222)..(222): a, c, t, g, unknown or other
  misc_feature (222)..(222): n is a, c, g, or t
  modified_base (323)..(323): a, c, t, g, unknown or other
  misc_feature (323)..(323): n is a, c, g, or t
tcagcgagagataccacgaccggtgctcgatttagtagtgtagatttgggtttggggggggagaggagcccagcactgggattccgaggtgtttccattcggtgatcagcactgaacacagaggactcaccatggagttttggctgagcgtggttctgttagctatttaaagagtcagtgtgagtncgtntggtggtatcgtggacggaggcctagatccgngccgttcgggggtcctagacgtcctctacctgtcgctaacgtccgttcggttcggttacacggtactacgtacaacactacgtatagtacggttcggaccnccgtagacctacggacggaagggtcgtaggtaggtcggtacttacgttagttacagtacgtacggtacgtagtaactagttaacgttccgattaacggtaccgttaccggacggggtacgggaccggtactttaaccggacttaacgtactaccgtacggaacgtaacaaaccgttacgtaaaccgtaacctcggttacgttacgttacttacgtaaacgtagaaacgacgtacgtacgacgacggtacctaacggtacgaacgttaccgacgttagttaacttgcgttaacgaggaacgtcggtacggccggaaccgttaaaccggtaactaaaccggtaacccggtagtaacggttaccggtacggttacgggtaaccggacgggaaccggtaccggtaaccgg

SEQ ID NO: 269767 - DNA, 591 bp, Homo sapiens
  misc_feature: GYAE6OF02FT24N.11.25.C03.1.454.CMB.1.raw
  modified_base (176)..(176): a, c, t, g, unknown or other
  misc_feature (176)..(176): n is a, c, g, or t
  modified_base (383)..(383): a, c, t, g, unknown or other
  misc_feature (383)..(383): n is a, c, g, or t
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
  modified_base (489)..(489): a, c, t, g, unknown or other
  misc_feature (489)..(489): n is a, c, g, or t
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctgggaggaggcctgactccagccgtgggggggtccctgacgactctcctgtgcagcctcgtgggttcaccgtcacgtcacacctacatgagttcgggtccgccaggcctccgagggaaggggctggagtgggtctcctttatttacagcaggtgtagtacatactcgcacgacctcgnggaggggccattcacactctcagnacaactactaaagaacacncttagttcttacaaatnaacagctagagacggaccgatcggaacaccggtcgtgttacttacnggtcgacgagacggagtcggggacccaaacggtaaccgtttacgaccgtacgttagttcggacggttccggtcggggtaaccgacgggtacccgtacccggg

SEQ ID NO: 269768 - DNA, 775 bp, Homo sapiens
  misc_feature: GYAE6OF02I8HK9.11.25.C03.1.454.CMB.1.raw
  modified_base (179)..(179): a, c, t, g, unknown or other
  misc_feature (179)..(179): n is a, c, g, or t
  modified_base (349)..(349): a, c, t, g, unknown or other
  misc_feature (349)..(349): n is a, c, g, or t
  modified_base (658)..(658): a, c, t, g, unknown or other
  misc_feature (658)..(658): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggtagtttgctgagtcgtcggttttcctgttaggcttatttaaaaggngtccaggtgtgaggtgcgtcgtgggtggagtcgtggaggacggcctgactccgcggtccggtggggggtccctgacggcctccgtccgtgtcgcgtacgtcccgttcggtcgggttccaaccgtcgtacgtccaacccaaccttagatggttacggttcgggccgtccgnggtccgtacggaaggggacgggtctacgggaggttcgggtacctttcgttttaacgttccgaggtcgtaggtaggtactactaatccgtcgctacgtacgtccggttaagggcgggtactatacccaccttacgccctacgacggtaacaaccgtaaactaacgtaaacgtaacccgacgttacctttacgtttaacctaacgtaaacgtacgtaaacgtaccgtaccgtacgggaacgtaccggcgtaacggtaccggaccggtaccgggttaccgtagttacgttacgtcggtaggacggttacggnggtaccggtaccggggtaacccgtaacggtaaaccgttaccggtaaacgtcccggtaagttccgggtaccggttaccgggtaaccggggacccgtaaccgggttaaccgtacccggg

SEQ ID NO: 269769 - DNA, 652 bp, Homo sapiens
  misc_feature: GYAE6OF02H3TFX.11.25.C03.1.454.CMB.1.raw
  modified_base (322)..(322): a, c, t, g, unknown or other
  misc_feature (322)..(322): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctatttaaaaggagtccagtgtgaggtgcgtctggtggagtctggaggaggcctgatccagccgtggggggtccctgagactctcctgtgcagcctcgtcgggtcaccgtacagtcacacctacatgagttggccgacacgactccgagggagggcaggngttggtccttctttaagttacacgtctaggtggtaagtacaatacgttccgcaacgaccgtcggtaggaacggggtctacttaccaccgtaactccttaccaaggaacgtaactaacgtactaaaagaaccacgtaccgttgtttacttaaccgaaaattaggaacctaggtacctagtaacgaacgtaccgtaagtacggaaccgaccgggttccgtaagttactttaaccgtgggcgtaacgaaggtagcggtacgggcccgtaaggtaaaccgttacgtaccgactaggaggccgttacggtcggggaacaaccgggacgtaaccgg

SEQ ID NO: 269770 - DNA, 782 bp, Homo sapiens
  misc_feature: GYAE6OF02FP8NU.11.25.C03.1.454.CMB.1.raw
  modified_base (176)..(176): a, c, t, g, unknown or other
  misc_feature (176)..(176): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctattttaaaaggngtccagtgtgaggtgcgtctggtggagtctggaggaggcctgatccagccgtcggggggtccctgatacctctccgtgtcgcacgtcctcgtcgggttccaccgtcagtccacacctacgagtgtaggttcgggtcccgccgacggcctaccggaaggggaacggggtcgtaggggtacggtcgggttcctttccgtttaactttacgacggtacgtaggttaggtaacgtactaagttaccttaccgctaacggtaccgtcccgggtaggggtaaccggggtacccgtaatttacccgaacccgttacgttacccgtacccgaaacgggtaaccaaacccgtaaaccgtttacccgaaaaacgtaaacccgtaaccggttcccttttcggttttaaacccttaaccgtaaaaagttacggtaaaacctaccgtacccggtaagaaccggtaccgccggtaacgtacggaacccgtaccggtaccgtttagttacgttaacgtgtacggacggtagtacggtcggtacccgggacctaacggtaaccgttaacgtaccgtagtacgtcggtcgtaccggtacgggccgtaacgggccgtaaccggg

SEQ ID NO: 269771 - DNA, 729 bp, Homo sapiens
  misc_feature: GYAE6OF02I8A90.11.25.C03.1.454.CMB.1.raw
  modified_base (178)..(178): a, c, t, g, unknown or other
  misc_feature (178)..(178): n is a, c, g, or t
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (526)..(526): a, c, t, g, unknown or other
  misc_feature (526)..(526): n is a, c, g, or t
  modified_base (591)..(591): a, c, t, g, unknown or other
  misc_feature (591)..(591): n is a, c, g, or t
tcagcgagagataccacgaccggtgctcgatttagtagtgtagatttgggtttgggggagaggaacccagcactgggattccgaggtgtttccattcggtgatcagcactgaacacagaggactcaccatggagttttggctgagcttgggttttccttgttgcttaatttaaaaggngtccagtgtgaggtgcgtctggtggagtctggaggaggcctgatccagccgtcgggggtccctggacgacctctcctgtcgcagtcctgtcggttcgaccgtcncgtacaccgacctacagtacgngttcgggtccnccgaggcctaccgaggggaagggcctgggtaggtcgggttcttaccgtttatttacgagtccgaaggttgtaacgtactatacgttccgcgtaagccttcggcgggacgggtccgtaacgttcgaacctagtccgtccaaggaacaccttaaacgttccaaaaacggacctaacggttcttacgtttaacttaaccgtaaaagtcgaaacncggttaaccctgaacgtacgtccgagtacgaccggtacggtccgtaagttacgttaactcgggtntaccggtagaagtaccggttacccggggaccttaaaccgggtaacctttaacccggtaccgtaaccgtacgggttaacggttccccgggtgggttaacccgggaaccggtaacccgggtacggcccggttaaccccgg

SEQ ID NO: 269772 - DNA, 830 bp, Homo sapiens
  misc_feature: GYAE6OF02I9ZOK.11.25.C03.1.454.CMB.1.raw
  modified_base (376)..(376): a, c, t, g, unknown or other
  misc_feature (376)..(376): n is a, c, g, or t
tcagcgagagataccacgaccggtgctcgatttagtagtgtagatttgggtttgggggtaggaggagcccacgcactgggattccgaggtgtttccattcggtgatcagcactgaacacagaggactcaccatggtaggttttggcgtgagcgttcgggtttttcctttggtttgtcttaatttttaaaaagggtagtacctagtggtggtaggtgcgtctgggtggtagtcgtgggagggaggcctggactccgaggtccgggtcggggggtccctggacgtaccttcgttccgtggtcgacgacggtccgttcggttcgggttacccaccgtcgtacgtaccaccgtacctacgattggtacggttcgggtccnccgacggtccgtcggaggggaacgggtcgtggggtaggttcggggtctttacccgttttaagttacgacggtacgtacggttgggtacgtaacgtacttagtccgatcgtaaccgttcggtagggacgggtaccgtaagttcccacctacgttacccgcgtaacgaacgtaaccctaacgtaccgtaaagaaccctccggtacgttttacgtttacctaaccgtaaaacgtggtaaaacctcgacccggttaagaccggaaccggtaccgaagtttaccgggaaccgtaccgggttaccgttagtttaccgttccgtagggtaccaacgggtagtacgtacgggtaccgggaacccctaacggttaaccgttaacccgaagttaaccggtacggttaccgggtacgtttacccggggacgggggtaacccccgtaaggggtaccccgtacgggg

SEQ ID NO: 269773 - DNA, 780 bp, Homo sapiens
  misc_feature: GYAE6OF02HTVNM.11.25.C03.1.454.CMB.1.raw
  modified_base (272)..(272): a, c, t, g, unknown or other
  misc_feature (272)..(272): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtcgtggaggaggcctgatccagccgtggggggtccctgagactctcctgtgcagcctgtcggttcaccgtnagtcacacctatatgtaggttgggtcccgaccgaggtccgtaccggagggggaacgggggtccgtggggtaggtggggttcccttacgtttttaacttaacgagtcgtaaggttgggtaacgtaacgtattacttcccgatacggtaccgttccggtagggtacggggtaccgtacttaccgtacccgacttacctccgtaagaccgaaccgtaaaaccgttacgtaaaggaaaccctacggttaccgtttcttttaccgttactaaacgtaacggtaacaaccggtacgttaacggacggaacgtaccggaataccggtaaccgtaaccggggcccgtttaacggttaacgtttaaccgttagggtccgaacgggtaggtaacggtacgggttccgggtaaccccggactaaaacccgggtttcgtaaaccccgttggttaacggttacgggttaccgggtacgggttaccggggaacccggtaacccggggtaaccgtaacccggg

SEQ ID NO: 269774 - DNA, 766 bp, Homo sapiens
  misc_feature: GYAE6OF02IGB0Y.11.25.C03.1.454.CMB.1.raw
  modified_base (416)..(416): a, c, t, g, unknown or other
  misc_feature (416)..(416): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatgtagttttggctgagtcttgggttttccttgttgtacttattttaaaaggagtccagtgtgaggtgtcgttcgtggtggagtcgtgggaggaggtacctgactccgacggccgttcggggggtccctgagtacctccttccgtggtacgccacgtccccgtgttggttaccacccgtgtacgtaccaacctaccctatacgtggtaggtttcgggtcccaccggagcccgtccggaagggggacgggtcgtaggtgggtcggttcctttaccgttttaagttaacgngtcgaacgggtttgtacgtaatacgttacttcccgagtaacgtcctccgggtggacggggtaccctaagtcccaacctctactccaagtaacgacctaaacttacgaaaacgtaaccacgttccgttcgtttaacttaactaaactaacggaaacccgtacgtcgtagaaccggacgaccgttaagccgaaacccggtgacccttaggttagttacgtggtcgaagaagtacggacggttacccgggacccttaaacggtaaaccgtttcgtaaaccgtcgtttaaccgtcgggttaacccggtccggtaaccgggggtaacccggtaacccgggtacccgttaacccgg

SEQ ID NO: 269775 - DNA, 876 bp, Homo sapiens
  misc_feature: GYAE6OF02ICD5V.11.25.C03.1.454.CMB.1.raw
  modified_base (217)..(217): a, c, t, g, unknown or other
  misc_feature (217)..(217): n is a, c, g, or t
tcagcgagagataccacgaccggtgctcgatttagtagtgtagatttgggtttggggagaggagcccagcactgggattccgaggtgtttccattcggtgatcagcactgaacacagaggactcaaccatggtagttttggctgagcgttgggtttttccttgttgacttaagtttttaaaaaggagtccaggtgtggaggtgtcgtctgggtcggnggttcgtgggaggacggcctaggatccgacggcggttcgggggggtccctggacgtaccttcgtccgtggtcgcgacggtccgttccggttcgggggtttacccaacccggttgtaaacggttaccaaacctaacccgttaacgaacggttacgggtaacgggtttccgggggtaacccgcccggaggtaccccgtaaccgggaaagggggggtaacggggtcgtagggggtaacgggtttacggggttaacttttacccgttttaaacgttaacgacggttacggtaacgggtttacgggttaaacgtaactaaagtttaccgttaccgacgtaacggtacccgttcgggtaagggaccggggtacctaacttaccgaacctctacctacgaaggaataaccgtaaactacgaaaacgacgtacttcttagtttaacctaaggtaaatccggaaacacggtcaaggaccgagaaccggataaccgaaccggtaccgtgttaagttactttagggacgtggaacgtaggaggtaccgggtaccgggaaaccctacggttaaaccggttacgaaaccggtttctaagggggttacggaacccggtttacgggggtacccgggggaaaacccgtttaacccgggggaaccgttaccccggg

SEQ ID NO: 269776 - DNA, 960 bp, Homo sapiens
  misc_feature: GYAE6OF02HWL1Z.11.25.C03.1.454.CMB.1.raw
  modified_base (848)..(848): a, c, t, g, unknown or other
  misc_feature (848)..(848): n is a, c, g, or t
  modified_base (870)..(870): a, c, t, g, unknown or other
  misc_feature (870)..(870): n is a, c, g, or t
tcagcgagagataccacgaccggtgctcgatttagtagtgtagatttgggtttggggagaggagcccagcactgggattccgaggtgtttccattcggtgatcagcactgacacagaggactcaccatggtagttttggctggagtcgttgggtttttcctgttgacttaattttaaaacgcctaggagacgccgtagtacgaccgacggtccgttagtaacgttacgtaggtcggacggtaaggtaacggtaggtaccgggggtacccctaaaccggtaaaaccggtttaaccgtaaccggtacgttaacggttaccgggtaacggttccggttacggggggaccccgaaacgggggttaacccccgtaaccgggttacccggtaaccccggtttaccttacccccgtttaaccggaccgtacccccgttaacccgaaaccccgggtaaaccgggggtacccccctaaacgggttttccccccgggttaaccccccgttttcccccccggttacggggtacccccgtaccccccggtttaggaacccccgttacccggaacgggggtaccgaacccccttaaccccggttaaccggaaccgaacgggtacgaaacccgggtaccggacccggggtaccccgttcggggtaacctacccgggtcccggttaagggtaacccggtaaaacgtacccggtttacccttttacccgggtaatttacccccggtacgttacgggaccggtttaaccgggacggggttacccgggttcgtaacgggtaccgaacggggtacccgaagggtttaacacgggtatatacgaggaattaccggaattggaccgtanaccggttagtacgtacgtacgngtacgacgtacgtagaaccgttacgacgttacgtacgacgttagacgtagactagcgtaacgcgattacgacgtacgagtacgtacgacg

SEQ ID NO: 269777 - DNA, 815 bp, Homo sapiens
  misc_feature: GYAE6OF02HJ19T.11.25.C03.1.454.CMB.1.raw
  modified_base (763)..(763): a, c, t, g, unknown or other
  misc_feature (763)..(763): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggtagttttcggctgacgtcgttcgggtttttccttggttcgacttaagttttaaaaggagtccgtaagtggtcggaggtgtccgttcgtgggtaggtagttcgtagggaggtaacggcctaggaccgtaccgacggtccgggttcggggggtaccctaggacgtacctcgttccgtgtacgacgacgttcccgtcggttaccggttaccgaccgtaccgtaacgtacctaacctacctaacgtgtaaggtaccggttaccggacccgaccgtaggtccctaccggggaagggacgggtacgtagggtggtttaccgggtccttttaacgtttaacgttcgacgttagtaggttcggaactacgtaacgttcgtaccgtacgtaacgtcgtaccggtacgggtaacgggtactacgtccgaactcgtccacgaatacgtaacgtaaccctacgtaaaacgcgttacgtcgttttacttaaccgtaataaaccgtaggaaaccgcgtaccggtaagacgacggttaccgtaatccgggaaccgtacggtaccgtttaagcgtttacgacggttacgacggaacggtaaggcgtaacccgggtaacggtaaccctacgttacgcccggttttaaangggttacggtacggtccgggaaccgggtaacgtaaccgggccttaaccccgg

SEQ ID NO: 269778 - DNA, 986 bp, Homo sapiens
  misc_feature: GYAE6OF02FQBXS.11.25.C03.1.454.CMB.1.raw
  modified_base (176)..(176): a, c, t, g, unknown or other
  misc_feature (176)..(176): n is a, c, g, or t
  modified_base (277)..(277): a, c, t, g, unknown or other
  misc_feature (277)..(277): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttcctgttgctattttaaaaggngtccagtgtgaggtgcgtctggtggagtcgtggaggaggcctgactccagccgtggggggtccctgacgctactcctgtagcagcctctggggtcaccgtnacggttcaaccacctaacgatagtaggtttacggggtcccaccggtacggaccgttaccggaaggggggtaacgggggtctaggggtaaggttccgggggttaccttttaaccgttttaaacgtttacgtaacggtaccgttaaggggtttacgggtaaacgttacgtaactttaaccggtttacccggaaccgttaaaccgggttaaccgttaccccggggttacggggtaaaccggggggggtaccccttaaactttaccccggaaacccgtaaatttccccgtttaacccgaaagggtaaacccgggtaaaaccctaaaccgttaaacgtaaaacccggtaaaaccgtaacccggttacgtttaccggtttttaaccctaaaccccgtaaaaaggtttaccgggaaaacttacccgggtaacccgttagggaaacggggaccctacccgggtaaaggttccccgaaacccgggttttacccgggaacgggttttaaccttaaagtttaccgggttacggttaaccggaaccgggtaagtacggggttaaccgggttccgggggaaccccttaaaacccgggggggttaaacctttaaccgggttaacccgacggttttaaacccgggtacccgggggttacggtttaaccccgggggttacccggggggaaccgttaaaacccgggggtacccctaacccgggggg

SEQ ID NO: 269779 - DNA, 522 bp, Homo sapiens
  misc_feature: GYAE6OF02GQPXY.11.25.C03.1.454.CMB.1.raw
  modified_base (211)..(211): a, c, t, g, unknown or other
  misc_feature (211)..(211): n is a, c, g, or t
  modified_base (353)..(353): a, c, t, g, unknown or other
  misc_feature (353)..(353): n is a, c, g, or t
  modified_base (493)..(522): a, c, t, g, unknown or other
  misc_feature (493)..(522): n is a, c, g, or t
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggttttccttgttgctattttaaaagcctgagagccgatgacacggccgtgtattactgngcgagagagtcgggggcccacgtaacgttactacgtctagtggacgtcgtggggaccaagggccacggtcaccgtctctcacgcctccaaccgacggcccctagtccggtccttccccgtggccgccctgcctccgaggacncctaccgtcgacgagccagacggtccggcccgtggggtcctcgacccgtgggtaccgaacggtaccgttaaccgttcttaacgtccttccgtacgtcgttcggacgggtccgggtgtcggacggaacgcgaacgagtagnnnnnnnnnnnnnnnnnnnnnnnnnnnnnn

SEQ ID NO: 269780 - DNA, 794 bp, Homo sapiens
  misc_feature: GYAE6OF02JNRIR.11.25.C03.1.454.CMB.1.raw
  modified_base (178)..(178): a, c, t, g, unknown or other
  misc_feature (178)..(178): n is a, c, g, or t
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggtttttccttgttgcttaattttaaaaggngtccagtgtgaggtgcgtctggtggatcgtggggagcgtcgagtcctcgccggtcgggggttcccggtccgtaggaccgttccttccgtcgtcggcacgtccgtcctcgggtttccgacccgtcacgtcctaccaacctacctatacggtaggttccgggttcccggccgacgggtcctcccggtaagggggaagggggtccggtgggtaagggttccggggttaccgtttaccgttttaacttttacgacggtacgacggttacggtaaggttaaccttaaggttaccgtttaccggtaccgtaacgaaccggtttacccggttcggggaacggggggtaccggttacctttaaccacccgttaaccgttccttaacccgaacgacgaaacctaaacctaccgtaaaaccgtaaaacgaccttccgtttagtttaccttagtaaactagtaacaacggtcccttggaaacgcgtaacgcgtagaccgtacgtccggtatttacgtcgtagccggtgaaggacgaagggtcccggtaacccgtaaccggttaaccgtaagtcccgtagtacgtcgggtacgtcgggaccggtacgaacccgggttacgaccgtccg

SEQ ID NO: 269781 - DNA, 805 bp, Homo sapiens
  misc_feature: GYAE6OF02GBCO5.11.25.C03.1.454.CMB.1.raw
  modified_base (177)..(177): a, c, t, g, unknown or other
  misc_feature (177)..(177): n is a, c, g, or t
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtcgtggaggaggcctgatccagccgtggggggtccctgacgactcctcctgtgcacgcctcgtgggttccaccgtcagtcacacctacagtgaggttcgggtcccgccgaggcctccgaggggacgggcgtgggaggtcgggttccttccttttattacgagctaggttggtaacgtacagttacttccgacgacgaccgttccggtggacggggtccgtacgttcccacctacgtccgtaccgaggaaccgtaacctaaccgttaaccgtaaaacgtaacccgtacgttccgtttacggttttacctaaacgaaaagttcgaaaccgtacgtcccgtaaggaacgaccggtacccgaagttcccggaaaccgtacccggggttaccgtttaacggtttaacgtttaaccggttaggtacggtaaccgggtaagggtacggtaccggggttacccggggtaacccccggtaaacgggtttaaacccggttttaacccgtaaccgggttaacgttaccgggtttaccggggtaacccggtttcccgggggaacggggggtaacccccggtaaacccggggggttaccccgttaaccccgggg

SEQ ID NO: 269782 - DNA, 503 bp, Homo sapiens
  misc_feature: GYAE6OF01ANCPD.12.18.B07.1.454.CMB.1.raw
  modified_base (479)..(479): a, c, t, g, unknown or other
  misc_feature (479)..(479): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagtattttggaatttatactgtcaacagcgtagcaactggcctcccactttcggcggagggaccaaggtgagatcgaagcgaactgtggctgcncatctgtcttcatcttcccgctac

SEQ ID NO: 269783 - DNA, 596 bp, Homo sapiens
  misc_feature: GYAE6OF01BM0H7.12.18.B07.1.454.CMB.1.raw
  modified_base (197)..(197): a, c, t, g, unknown or other
  misc_feature (197)..(197): n is a, c, g, or t
  modified_base (305)..(305): a, c, t, g, unknown or other
  misc_feature (305)..(305): n is a, c, g, or t
  modified_base (418)..(418): a, c, t, g, unknown or other
  misc_feature (418)..(418): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccgaggggaaangcaaccctctcctgcagggccagtcagagtgttaacagatacttagcctggtaccagcagagacctggccaggcctcccaggcctcctcatctatgatacattgaagnggccacgtggcatctcaggcagattcaagtggacaggtgggtctagggacaggtacttcactctccaccctcaccagcctagacgtcctagtaagtattttaggaaacttttntaactgtaccaacgtagcgtagctaacgtcggtaccccttacccgtacgtttccgggacgggtaacgggtaacccgaagggttcggaagtacgtacgaaggtacgtaaacgtggtacgggtctaggacccaccgtattcctacggttaccttacgtacgttcccttccccggctaacg

SEQ ID NO: 269784 - DNA, 496 bp, Homo sapiens
  misc_feature: GYAE6OF01DX00D.12.18.B07.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctcctgcagggccagtcagagtgttagcaccaacctagcctggtatcaggagaaacctggccagactcccagacttctcatctatgctgcatcctcaggtccactgacatcccagacaggttcagtggcagtggtctgggacagacttcactctcaccatcaccagactgcagtctgatgtatttgactactttattactgtcagctactataatattggcctcggagtactacgttgccgagggaccaagctggatagtacgaaacgatgtgctgcacatctgtctctac

SEQ ID NO: 269785 - DNA, 587 bp, Homo sapiens
  misc_feature: GYAE6OF01BQ2HO.12.18.B07.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgacgcagtctccaggcaccctgtctttatctccaggggaaangccaccctctcctgcagggccagtgagaatgttaaacaacaggtatctggcctggtaccagcaagaacctggccaggctcccaggctcctcatgtacgttacttccagcagggccacgtggcatcccagacaggttcactggcaggtgggtctgggacagacttcactctcaccatccacagactggagccctagaagtatttgactagttgttaatttattgtactagtactagttagtaggtagcgactaccgttacgtaaccgttttcggacccgtagggggtacccaacggtcgtagggaagagtaggtaaaaccgtacgttaggtacgggtcgttaggcctaccgagttccgttacgttccttactacttcccttcccgcctaacg

SEQ ID NO: 269786 - DNA, 603 bp, Homo sapiens
  misc_feature: GYAE6OF01D9YMU.12.18.B07.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaangcaaccctctcctgcagggccagtcagagtgttaaacagatacttagcctggtaccagcagagacctggccaggctcccaggctcctcatctatgatacattgaagagggccactggcatctcaggcagattcaatggcagtgggtctgggacagacttcactctcaccctcaccagcctagacgcctagtaacgtattttaggaatttattactgtacaacgagtcgtagactaactcggccctcccgtacgtttccgggaccggacgggtaaccgaagggtggaacgacgttaccgaaaggccggtaaaccgttgggtacgggtccgttggacccgtaacccgtaacgttccgttacggtttaccctttacctaaccttttccccgttcccccggcccttaaccg

SEQ ID NO: 269787 - DNA, 518 bp, Homo sapiens
  misc_feature: GYAE6OF01CFWDX.12.18.B07.1.454.CMB.1.raw
  modified_base (196)..(196): a, c, t, g, unknown or other
  misc_feature (196)..(196): n is a, c, g, or t
  modified_base (361)..(361): a, c, t, g, unknown or other
  misc_feature (361)..(361): n is a, c, g, or t
  modified_base (425)..(425): a, c, t, g, unknown or other
  misc_feature (425)..(425): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagccaaccctctcctgcagggccagtcagagtgttaacagatacttagcctggtaccagcagagacctggccaggctcccaggctcctcatctatgatacattgaagaggccactggcatctcaggcagattcaatggcagtgggctgggacagacttcacttcncaccctcaccagcctagacgcctgaagtatttaggtaattttattactgttacaacagcgtaancaactgcctaccctacgtttcggcggagggaccgaaggtggagatacgaagcgaacgtgtggctgacacatctgtcttacattcctccgctac

SEQ ID NO: 269788 - DNA, 636 bp, Homo sapiens
  misc_feature: GYAE6OF01B51NI.12.18.B07.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaangcaaccctctcctgcagggccagtcagagtgttaacagatacttagcctggtaccagcagagacctggccaggctcccaggctcctcatctatgatacattgaagaggccacgtggcatctcaggcagattcaatggcaggtgggtctgggacaggtacttcactctccaccctcaccagcctagacgtcctagaacgtattttaggaaattttacttacttagtacaaacgtggtacgtacgacctaacgttcgggaccccttcccgtaacgttttccggggaccgggtaacggggtaacccgaaggggtttcggaacggtacgtaccgaaagggtaccggtaaacgttcggggtacggccgttacggaccctaacccgtagttcccgttcggttaccctttacccgaacgttttccccgtttacccccggccttaacg

SEQ ID NO: 269789 - DNA, 638 bp, Homo sapiens
  misc_feature: GYAE6OF01EBZH4.12.18.B07.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctcctgcagggccagtcagagtgttaacagatacttagcctggtaccagcagagacctggccaggctcccaggctcctcatctatgatacattggaagagggccagtggcatctcaggcagattcaagtggcaggtgggtctgggacagtacttcactctccaccctcacccagcctagacgtccctagaacgtagttttaggaaattttattactgtaccaaacgtgtaccggtagacctaaacgtcgggtaccccttcccgtaaccggttttcccgggacgggtaacggggtaaccctaaggggttcggaacgtacgttaccgaaaggccggtaaaccgttgggtacgggccgttacggacccgaaccctaagttcccgtttacggttccctttaccgaccgtttcccccgtttcccccggccctttaacg

SEQ ID NO: 269790 - DNA, 533 bp, Homo sapiens
  misc_feature: GYAE6OF01EOV8N.12.18.B07.1.454.CMB.1.raw
  modified_base (196)..(196): a, c, t, g, unknown or other
  misc_feature (196)..(196): n is a, c, g, or t
  modified_base (349)..(349): a, c, t, g, unknown or other
  misc_feature (349)..(349): n is a, c, g, or t
  modified_base (418)..(418): a, c, t, g, unknown or other
  misc_feature (418)..(418): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaangcaaccctctcctgcagggccagtcagagtgttaacagatacttagcctggtaccagcagagacctggccaggctcccaggctcctcatctatgatacattgaagagggccagtggcatctcaggcagattcaatggcagtgggtctgggacngacttcactctcacctcaccagcctagacgcctagaagtatttttggaaattttacttactgtactaanagcgtagacaactcggccctccctacgtttccgggacggagggacctaagggtggacgagtacgaacgcgaaactgtggctgacaccatctgtccttcacttccttcccgctacg

SEQ ID NO: 269791 - DNA, 704 bp, Homo sapiens
  misc_feature: GYAE6OF01BECD1.12.18.B07.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccgaggggaangcaaccctctcctgcagggccagtcagagtgttaacagatacttagcctggtaccagcagagacctggccaggcctcccgaggcctcctcattctatgatacattaggaagcgggccagtggacatctcgaggcagtacttacaagtggactaggtgggtctaggggactaggtaccttacaccttactcccaccctccgaaccgcgtacctaacgacgtaccgtaggtaacgttagttttaaggtaacttttaacgtttacgtacgttactaacgtacgtacgtacgaccgtaaccgtacggtaccccttacccgtaccgttttaccggggaccgggtaacgggtaacccggtaaggggttacggaacggttacgtaacggaaacgggtaccggtaaaccggttcgggtacgggtaccgttacggtacccgtaacccgttacgttacccgttaccggtttccgtttacccgtaacccgtttccccgtttccccgtcccgttaaccgg

SEQ ID NO: 269792 - DNA, 581 bp, Homo sapiens
  misc_feature: GYAE6OF01AIYYN.12.18.B07.1.454.CMB.1.raw
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccgaggggaaagagcaaccctctcctgcagggccagtcagagtgttaacagatacttagcctggtaccagcagagacctggccaggcctcccaggctcctcatctaatgatacattggaagagggccactggcatctcgaggcagtacttcaagtggcaggtgggtctgggacagtaccttcactctccaccctcaccacgcctagcgcctagtaagttagtttggtaattttacttactgtactaacgtagacgtacgctaacgtcggtacccttacccgtacggtttacgggaccgggtacgggaacccgtaaggggtggaacgtactacgacgacggtaacgtggtacggctgaccactactcttcgttccttacacttccttcccgtctacg

SEQ ID NO: 269793 - DNA, 562 bp, Homo sapiens
  misc_feature: GYAE6OF01ELQOJ.12.18.B07.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccgaggggaaanagcaaccctctcctgcagggccagtcagagtgttaacagatacttagcctggtaccagcagagacctggccaggctcccaggctcctnatctatgatacattgaaggagggccacgtggcatctcaggcagtattcaatggcaggtgggtctgggacagtacttcactctccaccctcaccagcctagacgcctagaagttagttttaggaattttattacgtagtactaacgagtcgtagctaacgtcggaccctcctacgtttcgggacggacgggtaccgaagggtggagactacgaacggcgtaaacgtggtcggcgtgaccactagttcctagttccttactacttcccttcccgctacg

SEQ ID NO: 269794 - DNA, 577 bp, Homo sapiens
  misc_feature: GYAE6OF01DPHCY.12.18.B07.1.454.CMB.1.raw
  modified_base (197)..(197): a, c, t, g, unknown or other
  misc_feature (197)..(197): n is a, c, g, or t
  modified_base (541)..(541): a, c, t, g, unknown or other
  misc_feature (541)..(541): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccgaggggaaangcaaccctctcctgcagggccagtcagagtgttaacagatacttagcctggtaccagcagacgacctggccaggctcccaggcctcctcatctatgatgacataccgaaaagggccaacgtcggacactcccagccaggttcaggtcgcgaggtgggtcgtggggcagtaccttcacgtctacaccatcagcacgcctagacgcctagaagtatttagacttagtttattactgtactagcgtagtcgtagacgtaacgtcggtccgttcggttcgtacgtttcggaccgtacggggtaccaggtcgtaggacgtacgtaaccgaaacgtaacgtgtacggtcncgaccaccgtacttactcgttcttcgtacttccccg

SEQ ID NO: 269795 - DNA, 602 bp, Homo sapiens
  misc_feature: GYAE6OF01B76XO.12.18.B07.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
  modified_base (303)..(303): a, c, t, g, unknown or other
  misc_feature (303)..(303): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (423)..(423): a, c, t, g, unknown or other
  misc_feature (423)..(423): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccactggagaaatagtgatgaagcagtcctccagccaccctgtctgtgtctccgaaggggaaancgcccacctctccngcaggccagtcagagtgttaangcgacttagcctaggtaccagcagactaccgtggccaggcctcccgaggtcctcctcatctatggtcncatctaccgagggccctagtggtaactcccgagccaggttcaggtcggcagggtcgggtcngggacngtagttcactctaccactatccagcacgccgtagccgtagtcgtagtaagttnttttagacttagtttattacgtgtacgtagtactaagtaactaagttaacgttcggttacctcgtcttacgttaccggtttacggggaccggggtaactagggtacggaagtaacgtaacgaaaacggtagtaggttcggacttcggacctaacctagttccttacgttccttctaccg

SEQ ID NO: 269796 - DNA, 644 bp, Homo sapiens
  misc_feature: GYAE6OF01A3KL7.12.18.B07.1.454.CMB.1.raw
  modified_base (195)..(195): a, c, t, g, unknown or other
  misc_feature (195)..(195): n is a, c, g, or t
  modified_base (373)..(373): a, c, t, g, unknown or other
  misc_feature (373)..(373): n is a, c, g, or t
  modified_base (429)..(429): a, c, t, g, unknown or other
  misc_feature (429)..(429): n is a, c, g, or t
tcagatacgacgtacacgaccggtgctcgatttagtcgctgcgtaagggggaggaactgctcagttaggacccagagggaacccatggaagccccagctcagcttctcttcctcctgctactctggctcccagataccaccggagaaattgtgttgactcagtctccagccaccctgtctttgtctcaggggaangcaaccctctcctgcagggccagtcagagtgttaacagatacttagcctggtaccagcagagacctggccaggcctcccaggctcctcatctatgatacattagaagagggaccagtggcatcctcgaggcagattcgaatggcaggtggtctgggacagtcttcactctacaccctnaaccctgaccctagacgtccgtagtaagttagttttaggaaattttacgttaagtntaccaacgtagtacgtaacgacctaacgtcggtacccttacccgtacggtttaccgggaccgggtaacgggtaacccgtaaaggggttcggaacggtacgtacggaaacggtacggtaaaccgttagggtacgggtaccttacgggaccctacccgtaacgttccgtttacggttaccttccgtaacctttcccgtttcccccgtaccgttaccg

SEQ ID NO: 269797 - DNA, 766 bp, Homo sapiens
  misc_feature: GYAE6OF01EAJKP.12.18.B07.1.454.CMB.1.raw
  modified_base (195)..(195): a, c, t, g, unknown or other
  misc_feature (195)..(195): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagactaccaccggagaaattgtgttgactcagtctccagccacctgtctttgtctccgagggaangccaaccctctcctgcgacgggccagtcagagttagttaacagtatacttacgcctggtaccagcagacgaccgtggccacggcctcccgaggtcctcctctatctatgaactactagttaggaacggacgggtccctacggttcggactacgtccgtacgaacggtactaagttaacgttacgtaaggtcgggacgtagggttgggtacgtaggggacctaggttaccttaccgaccttccctacccgtacccctccgaacccgtacgtaccgtaacgaccgtacccgtaagggttaacgtttaacgtttttaacggttaaacttttaacgttaaccgttaacgtaaccgttaacgtacggttaccgttaacgaccgtaacccggttcccggtaccccctttaccggtaccggtttaccgggggaccggtaacggggtaaccggtaagggtacgggaaccgtacgttaaccggaacggtaccggtaacgtacgggttacgaccgtacgaccgtaccgttgttccctacggtttcccttacgtaaccctttcccgttacccgccttaaccg

SEQ ID NO: 269798 - DNA, 689 bp, Homo sapiens
  misc_feature: GYAE6OF01DO1RU.12.18.B07.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccgaggggaaanagcaaccctctcctgcagggccagtcagagtagttaacagatacttagcctggtaccagcagagacctgccaggctccaggctcctcatctatgatactattagaaagcgggaccaacgtggactatctacgaggcaagtacttacaagttcggactagggtcgggtcgtaggggactaaggtacctttacactcctaccaccccttacaacccacggtaccctaggaaccgtaccgtaggtaaacgtttacgttttagggttaaaacttttaacgttaacttacgtaactaaacgtaacggtacgttaacgtaccaacgttcgggtaccccttacccgttacgtttaccggggaccgggtaaacgggtaacccgaaaggggttagaagtacgtaacgaacggtaaccgtaacgtaggtacggccgtacgaccgtaacctagttccgttacgttaccgtttacctacgtttccccgttccccgccttaacgg

SEQ ID NO: 269799 - DNA, 582 bp, Homo sapiens
  misc_feature: GYAE6OF01D0KDK.12.18.B07.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgctgcgtaagggggaggaacgtgctcagttaggacccagagggaaccatggaagccccagctcagcttctcttcctcctgctactctggctcccagataccaccggagaaattgtgttgactcagtctccagccaccctgtctttgtctccgaggggaangcaaccctctcctgcagggccagtcagagtgttaacagatacttagcctggtaccagcagacgacctggcccaggcctcccgaggcctcctcatctatgatacattggaagcgggccagtggcatctacaggcagacttcaagtggcaggtgggtctagggacagtacttcactctccaccctcaccacgtacctacgactcgtagtaagttattttgacttagtttacttacttgtactagtctaggtagtggggctacgtacgtcgtacttcgtacgtttccggtcccgttacggaaccgtaagtacgtacgtacgtaacgtaaacgtaacgtcgtagtctgacctactacttcttacgttacttctccgttccgttaccccg

SEQ ID NO: 269800 - DNA, 606 bp, Homo sapiens
  misc_feature: GYAE6OF01B9HII.12.18.B07.1.454.CMB.1.raw
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (275)..(275): a, c, t, g, unknown or other
  misc_feature (275)..(275): n is a, c, g, or t
  modified_base (318)..(318): a, c, t, g, unknown or other
  misc_feature (318)..(318): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctccagataccaccggagaaattgtgttgactcagtctccagccacctgtctttgtctcaggggaaangcaacctntcctgcagggccagtcagagtgttaacagatacttagcctaggtaccagcaagagacctggccaggctacccgnggctcctcatctatgattacattgaagacggccactggcatcncgaggcagtattcaagtcggacaggtggtacngggaacagacttnactctcaccctcgactagccnggacnccgtagaacggtatttgactagttagttattagttgactagctagtataggtacgcgacgtaaccgtacgtacgttttcggaccgacggggttaccgagtccgttagggaagtaggtaaacggtaaaaccggtaccgttagggtaccggggctttaacggacccttaaccggtacttacccgtttaggtacccttttccgtacttttaaccccccgg

SEQ ID NO: 269801 - DNA, 759 bp, Homo sapiens
  misc_feature: GYAE6OF01DRIP7.12.18.B07.1.454.CMB.1.raw
  modified_base (716)..(716): a, c, t, g, unknown or other
  misc_feature (716)..(716): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccgaggggaaagagccaaccctctcctgcagggccagtcagagtgttaacagatacttagcctggtaccagcagacgaccgtggccagggcctcccaggcctcctctatctatgtatactagttaggaaggacggggtaccaacgtgggacctattccgtaccgaagggcctaaggtactttacgaaagttgggacctagggttcggggttacgtaggggaaccaggttaaccttccgtactcccttaccgtacccccttacaaccgtacgtccccgtaaggaccgtccgtacggtaaggtttacttttacgggttaaattttaacgtttaccgtacggttacctaaaccgtacgttaacccggtaagtaccctaacgttcccgggtacccttacccccgttacggttttacccggggaccggggtaacggggaaccccgtaaagggggttcggtaacgggtacttaccggaacgggtaccggtaaaccgtttgggacgggtaccgttcggaccacccgtagtttcccgtntttacccggttacctacctttccccgttcccgtaccctaaccg

SEQ ID NO: 269802 - DNA, 687 bp, Homo sapiens
  misc_feature: GYAE6OF01COOO5.12.18.B07.1.454.CMB.1.raw
  modified_base (198)..(198): a, c, t, g, unknown or other
  misc_feature (198)..(198): n is a, c, g, or t
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
tcagatacgacgtacacgaccggtgctcgatttagtcgctgcgtaagggggaggaactgctcagttaggacccagagggaaccatggaagccccagctcagctttctcttccctcctgctactctggcctccagataccaccggagaaattgtgttgactcagtctccagccaccctgtctttgctccgaggggaaangaccaaccctctcctgcgaggcctagtcagagttagttaacaggtattacgttagccgtaggtaccaggacagtacgacctcggccgaggtcctaccgaggcttacccnctatactaagtgtaactacgtagtaggaacgagggccaacgtggactagtcacgacggnaacgtattacgaagtggacgtaggtcgggtagtcggggaacacggttaccttaccacctttctaccctacctaccgacgaccgtctaaccggactccgtagttaaacgtagttttacggaacttttactactgtacaacgtgacgtacgctaacgttcgcccttacgtcgttacgggacgggtaacgacgtaagggtacgaacgtcgtaacgaacgggttaccgaaccgttggtaccgggtacgtaccgtactaaccccggtagtttaaccttcgggtttacccttacgtaacccgtttcccgttccccgcgtttaacccg

SEQ ID NO: 269803 - DNA, 742 bp, Homo sapiens
  misc_feature: GYAE6OF01CTKW4.12.18.B07.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccgaggggaaanagcaaccctctcctgcgagggccagtcagagtgttaacagatacttagcctggtaccagcagacgacctcggccaggcctcccgacggcctcctcatctatgatacagttaggaaggtacgggccacgtggctatcctacgaggcagtactttcaagtcggctagggttgggtacgtggggactagtaccttcgtaaccttccctacccgaaccccttccaaccccgacgtacccgttaacggtaccggtacccgttaagggtaaacgtttacggtttttaaacgggtttaaacttttttaaacgtttaaccgtttacgttacccgtaaaaccggtaacggtaccgttaacgtaacccgtaaacccggttccggtacccccgtttacccgttaacccgggtttaccgggggaccggggtaaccggggaaccggtaacggggtacgggaaggtacgtaacgaacgggtaaccggtaacgtgggtacggctacggcctacttacgtcgttacgtcctttactaccgtttccccgtcccgtccgtacg

SEQ ID NO: 269804 - DNA, 756 bp, Homo sapiens
  misc_feature: GYAE6OF01DMBAW.12.18.B07.1.454.CMB.1.raw
  modified_base (195)..(195): a, c, t, g, unknown or other
  misc_feature (195)..(195): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccacggagtaaattgtgttgactcagtctccacgccacctgtctttgctaccgagggaangccaaccctctctgcagggccagtcagagtagtaacagtatacttagcctggtaccagcagacgacctggccaggcctcccgaggccttacctctaatctatagtatacgtagttgaaggacgggacctaacgtggacaactcgtacgaggccaagtactttacgaagtcggcgtacgggtgggtccgtaggggtaactacggaacctttcgacttaccctaccgtacccctacgaacccctaggacccgtaaggtacgtacccgttaagtaacgtttagtttttaacggtaaatttttaacgttaaccgttagtaaccgtaaacgtacgggtaaccgttaacgggaacccttaacccgttaccggggtaccccctttaccccgggttaacgggtttaccccgggacggggtaaaccggggtaacccggtaaggggttacggaaacggtacgtaaacggttaaacggaccggtaaacggttacggtcgggtactaccgggacctaacccgtacgtacctttacggttcttaaccgtccttaccccgttcccgaccgttaac

SEQ ID NO: 269805 - DNA, 797 bp, Homo sapiens
  misc_feature: GYAE6OF01CF2SB.12.18.B07.1.454.CMB.1.raw
tcagatacgacgtacacgaccggtgctcgatttagtcgctgcgtaaggggggaggaactgctcagttaggacccagagggaaccatggaagccccagctcagcttctcttcctcctgctactctggctccagactaccacggagaattgtgttgactcagtctccagcctacctgttctttgtctccgaaggggaagacgaccaaccctctcctgcgagggccagtcgagtagtagttaacagtaattacgttagcctggtaaccagacaggacgaccgtcggccacgggtcctacccgacgggtccttaccctactacgttcctaatacggtaattaccgtaagtttacggaaacggtacgggtacccaagttcgggacaacttcgacgaacggtacaggtaacttacgaaggtggacgtaggttcgggtacggtacgggtaacacggttacctttacaccttacgtacccactacgaccgaagccgtaacggtaccgttaggaaccggtacccgttaaggttaaaggtttacgttttaacgggtaaccttttaaggtttttaaccgtttaacgttacggtaccgttaaggtacggtaacgggttacgtaaccggtactaaccgggttcccgggttacccgtttaccggggttaccgtttacgggttttaccgggaacccgggacggggtaaaccgtaaggttccgggaacggtaaacgtacgtaaacggtaaaccggtagttaccggtacggtacctacggtaccaacggttacttcgttcggttaccttacccg

SEQ ID NO: 269806 - DNA, 738 bp, Homo sapiens
  misc_feature: GYAE6OF01CBAHB.12.18.B07.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
tcagatacgacgtacacgaccggtgctcgatttagtcgctgcgtaagggggaggaacgtgctcagttaggacccaggagggaaccatggaagccccagcctcagcttctcttcctcctgctactctggctcccagactaccaccggagaaattgtagttagacttcagtctccagcccaccctgtctttgtctccgaggggaaangcaaccctctcctgcagggccagtcagacgtgttaacngatactagcctaggtaccagtcagtagacctaggccagggtcctacccgacggcctacccgtcacttccgtatgaatactagtttaggaaacgtcggggacctaacgtcgggaccagttccgtacgacggctagggttcgaaggtcggcggtagggttcggggtccgtggggggactaacgggtacctttccaccttctacccaaaccattaccgaacggtccacggtaccccgtaaggaccgtacccgtaaggtaaacgtttacgtttttacgggacctttaaggtttttaacttaccgttacgttacgtacgactaacggtacgtaacgaccgtaagttccggtaccgttccggtttaccgttacggttttaccgggaccgtaacggggacccttaaggccggttaagggacgtaaacgtaaccggtaaacgtagggttacgtacggccgtacggaccctaaccgttcttaccgtcttaccgttcttaccccg

SEQ ID NO: 269807 - DNA, 724 bp, Homo sapiens
  misc_feature: GYAE6OF01CN3RD.12.18.B07.1.454.CMB.1.raw
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggcctcccaggctcctcatctatgatgcataccgaaaacgggccactggccactcccaagcccgtaaggttccaaggtcggacaggttgggtacgttgggggctaagtaccttcgtaacctccttacaccctatccaaggccacggtaccctaaggacgtcccgtagtaagttacgtttttcgtaccttaaggtttttaaacttacgtttacgtacgtacggtacgtacggtaccgtaaggtacccgtaaaccgttcgggttacccgttacccgggttttaccgttaccggttttttaccggggtacccggtaacgggggtaaccccgtaaggtaccggttacgggaacggtaaaccgtaacgtaaaacccggtaaccggttacgggttacgggtccgtaccggtaccaacccgttacttacccgttcttacccgtttccgtccgtttaccccccg

SEQ ID NO: 269808 - DNA, 744 bp, Homo sapiens
  misc_feature: GYAE6OF01B7WFI.12.18.B07.1.454.CMB.1.raw
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccgacgccctaccctgttctttgtcctaccggaaggggaaagacgacctaaccctcctcctgcgacgggccagtcgagtagttacgttaaacgagtacttaaccgttacgtccgttacgggtaaccaggacgaaggaccgacccgtcggacccgaacggtcccctaccccggacggtcccttaccccgtctaacttccttaagtagtaacttacgtaagtttaggaaacgggtacgggaccctaggtcggacctattccgtacgaggacaagtacttacgaaggtggacgtagggttgggtcggtacgggactacggttaccttacgaccgtcctaccctaccccgtaccaacccgtacgtaccgtaacgtaccgtaccgtaaggtaagtttaagtttaggttaaacttttagttactacgtacaacgtacgtacgtacgactacgtccgtaccctaccgtacggttaccgggacgggtaacgggtaacggtagggtacgagtacgacgaacggtacgtacgtggtcggactgaccctacgtattcgtttcgttacctacttccctacccgtctgtaccg

SEQ ID NO: 269809 - DNA, 727 bp, Homo sapiens
  misc_feature: GYAE6OF01BUVOR.12.18.B07.1.454.CMB.1.raw
  modified_base (199)..(199): a, c, t, g, unknown or other
  misc_feature (199)..(199): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagcccaccctgttctttgtctccgaggggaaanagcaaccctctcctgcgagggccagtcagagtgtaacagtatacttagcctggtaccagcagacgacctggccaggcctcccgaggtcctcctacatctatgatactagtaggaagacggccagtggactatctcgaggctagtacttacgaagtggactagggtgggtcgtagggactaggtaccttaccaacgttccctacccgtacccctccaacccgacgtaccgttaacggacgtacccgttaaggtaaacggttttacgtttttaagggtaaactttttacgttaaccgtcgttaaccaaacggtacggtaacgttaacgaacgtaaacccgtttccgggtaccccctttacccggttaaccggtttccgggggaacccgggtaacggggtaacccgtaaggggttccggtaaacggtacgttaaccggaaacggtaccggtacgttagggtcggtactacggaccctacgtacttccgttacgttaccctttaccgaacgtttccccttacccgcttaccg

SEQ ID NO: 269810 - DNA, 660 bp, Homo sapiens
  misc_feature: GYAE6OF01DAJ2A.12.18.B07.1.454.CMB.1.raw
  modified_base (203)..(203): a, c, t, g, unknown or other
  misc_feature (203)..(203): n is a, c, g, or t
  modified_base (653)..(653): a, c, t, g, unknown or other
  misc_feature (653)..(653): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagactaccaccggagtaaattgtgttgactcagtctccagcccaccctgttctttgtctaccgaaggggaaanacgccaaccctctccgtagcgacgggccagtcaagtagtagttaacagatacttacgcctaggtaccagcagacgtaccgtggaccgtaggcctcccgaggtccttcctactactactagtagacttaacagttaaggaacggcggacctacgtggacctacgtctacgacggacagtacttacgaagtggacgtaggtcggggtacgtacgggactacgtaccttcgacttcctaccgaccctcaacgacgtacctagactccgtaagtagtttaagtttggtaaacttttacgtacttagactaaacggcgtaacgtacacgtacgtcgtaccctacgtacggtcggacgggaacgtcgaagggtcgaatacgacggtaagcgacgttaggcggtactacgactaccttgtcccgttagttcccttaacgtcccttcccgttacccgnttaacgg

SEQ ID NO: 269811 - DNA, 813 bp, Homo sapiens
  misc_feature: GYAE6OF01DZUJI.12.18.B07.1.454.CMB.1.raw
tcagatacgacgtacacgaccggtgctcgatttagtcgctgcgtaagggggaggaactgctcagttaggacccagagggaaccatggaacgccccagctcagcttctcttccctcctgctactctcggcctcccagactaaccgaccggaagtaaatttgtgttgactctagtctccacgccctacccttgttcttttcgtcctaccggaagggggaaacacgaccctaacccttcctcctcggaccgacgggcctacgtacgaggtagttacgtaacagtactacgtacgccgtacggacagtacgaaggacgtaccgtcggaccgacggccttacccgacggtcccttcctactacttctacgtacgtaacttaccgttaggttaacggaaacgggaccggtaccgtacggtcggtacgtaactccggtagaacggtacgtaacgttactaacggaacgtcgggaaccggttagggtccgggttaggtacgggtaactaacccgttacgttacccaccgtttacctaccccgtaacctacccgaaactaccggtactaacggtacctaacgttaaggttagtttacgttttaacgttaattttacgtcgtaactacgaacgtgacgttacaccgttacgtctacccgttacgttacgggtacgggacggtaccgggtaacgtagggtacgtacgtaacgtaccgtaacgggtacgtcgttacggggtactccgaacgttaccgtaaccgtttaccgttcggttttactaccccgtttaactccccgttcccctttaaccgcgtttaaaccg

SEQ ID NO: 269812 - DNA, 809 bp, Homo sapiens
  misc_feature: GYAE6OF01BVW5P.12.18.B07.1.454.CMB.1.raw
  modified_base (199)..(199): a, c, t, g, unknown or other
  misc_feature (199)..(199): n is a, c, g, or t
tcagatacgacgtacacgaccggtgctcgatttagtcgctgcgtaaggggggaggaactgctcagttaggacccagagggaaccatggaagccccagctcagcttctcttcctcctgctactctggctcccagactaccacggagtaaattgtgttgactcagtctccacgcctacctgttctttgtctcgaggggaangcctaaccctctcctgcgagggccagtcagagttagttaacagtacttacttacgccgtaggtaccagctacggacgtaccgtcgggacccacgggtcccttaccccggaggtcccttaccctactacttccttaagttaggtaaacttaacgtaaggtttacgggaaaacgggtaccggggtacccaaggtcggtacctaacttccgtaccgaagggtactaaggttaactttacgaaggtcgggcgtaaggggttcgggtacggtacgggaacgtacgtaaccttccaaccgttcctacccacccgtaccaaaccgcgtaccctaaggaccgtacgtaagtaagttttagttttaaagttaacttttaacttacgttacgtaaccgtaaacgtcggtaccgtaacgtaccgtaaccggtccgtacccttacccggtaacgggtttaccggggacgggttaaccggggtaacggtaacggggttacgggaacgtacgtaaccggaaagggttaccgtaaacggtcgggtacggtcgtaaccggtaccgtaagttccttacccggtttacttccggttacctaccggtttccccgtaaccgtaccttacg

SEQ ID NO: 269813 - DNA, 854 bp, Homo sapiens
  misc_feature: GYAE6OF01DGS3R.12.18.B07.1.454.CMB.1.raw
  modified_base (203)..(203): a, c, t, g, unknown or other
  misc_feature (203)..(203): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccacgcccaccctgttctttgtcctaccgaaggggaaanacgaccaaccctctcctgcgacgggccagtcagtagtacttacgcctaccttacttacgccgtaggtaacccaacaacgaaaccgtcggaccgacggtcctacccgacggtcccttacctactacttaccttagtaggtactcgtaccaacgttaaaccccggaaaaaccgggcccgtaacgttcgggacccaaccgttaccccgaacggtacccggtaaggttttccggaaggggtcggtaccggtaggggttcggggttacgggtacgggggtacctaacgttaacccgttacctacctttacctaacccgtaaccgtacgtacccgtaaacgaacccgtaacggtaccctaagggtaccgtaaccgttaacggtaaacgttttacgttttaacggtaccgttttaagtttttaccgttaacgttacggtaacccgtacggtacgtaacggtaccggtacgtacccgtaacggttccggttacccgttttacggttacccttacgggttttaccgggaaccgggtacggggtaaccagggttacggtacggtaacgtaacgtaacccgtaaacggttacgtggtaccggtactaccgtcctaaccgtgttccgttacttccttaccgttaccttcccgttcccgtaacc

SEQ ID NO: 269814 - DNA, 695 bp, Homo sapiens
  misc_feature: GYAE6OF01D210J.12.18.B07.1.454.CMB.1.raw
  modified_base (183)..(183): a, c, t, g, unknown or other
  misc_feature (183)..(183): n is a, c, g, or t
  modified_base (194)..(194): a, c, t, g, unknown or other
  misc_feature (194)..(194): n is a, c, g, or t
  modified_base (268)..(268): a, c, t, g, unknown or other
  misc_feature (268)..(268): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgacgcagtctccaggcaccctgtctttanctcaggggaangccaccctctcctgcagggccagtgagaatgtaacaacaggtatctggcctggtacccagcagaacctgcagcnccaggctctcatgtacttactccagcaggccacgtggcactccagactaggttcacgtggactaggtcgggtctgggacaggtaccttcgaactcgtacaccgtaatcagccaagtccgtagactacgtacttacgaagtcgttttaggtccttaaggttttacttaaccttcggttactacggtactaacgtaagttaacttaacgtttccgggtttacctaggtccgtttaccggttaccggttttaccgggggtaaccgggggtaaccggttaaacgggtggggtaacgtaacgtttaaaccggaaaaaccggttacgttacgggttacggggtaccgttacggacgtaacccgttaagttcccgtttacgttaaccgttttacccgtaaccgttttaccccttccccggttaaccctacccgg

SEQ ID NO: 269815 - DNA, 898 bp, Homo sapiens
  misc_feature: GYAE6OF01C12QJ.12.18.B07.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctccagataccaccggagaaattgtgttgactcagtctccacgccaccctgttctttgctccgaaggggaanacgcaaccctctcctgcgagggccagtcagagtagttaacagtattacgtagccgtaggtaccagtacgagtacgaccgtcggacccgacggtccctacccgacggtccttaccctatacttactaatcgtaactaacgtaagttaacggaaacgggtaccgggtacctacggtacggacctaatttccgacgtaaccgggactaaacggtacgttttaacccgaaggttccggtacggtaacggggtttaccggggtaacgggtacggggaacctaacggttacccttaccgtaacccttcccgtacccgacccccgttaccaaaccccggtacgttacccggtaacggtaccgtaccgttaacgggttaaacgttttaacggttttaaacggtttaaactttttacgttaaaccggttacgtaacccgtaaacgttaaccggtaccggtaaaccgacccgttaaaccccggttccggttaacccccgtttaccccggtttaaccgggtttaccggggggaaacgggtaaccggggtaccggttaaaggggtaccggtaaacgtccggtaaacggtaaccgggtaaccggttacggttccgggtaccggtacccgtaggaaccccttacgtttacccgttcggtttacgtttacccccttaacgttcccgtttacccccgtcccgtaaccgtttaaccgg

SEQ ID NO: 269816 - DNA, 756 bp, Homo sapiens
  misc_feature: GYAE6OF01A86TH.12.18.B07.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccgaggggaaangccaaccctctcctgcgagggccagtcagagtgttaacagtatacttagcctggtaccagcagagaccgtggccaggcctacccgaggcctcctcatctatgatacagtagagacgggccagtggctatctcgaggactagtacttacaagttggactaggggttagggtcggtacggggactacggtacttccgtaccttacctccccgtaaccccgtacaacccgtaacgtccctaaggaccgtaccggttaaggtaaacgtttaacggttttaagttaaacgtttttaacgttaaccgttattaaccgtaaacgttacgtacgggtttaacgtaccctaaacccggtttcggtacccccgttacccgtttaaccggtttacccggggccgggggtaaaccggggttaaccgaagggggttaggaaacgggtaacgtaaccggaaacgggtacgtaaccgttaggggttccggtaccggtacggacgtaacccgttaatcccgtttaggtttaccttacgttacccgtttaccccgttcccccggtacccttaacgg

SEQ ID NO: 269817 - DNA, 814 bp, Homo sapiens
  misc_feature: GYAE6OF01C5L30.12.18.B07.1.454.CMB.1.raw
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaattgtgttgactcagtctccagccaccctgtctttgtctccgaaggggaaagacgaccaaaccctctccgtgcgagggccagtcagagtcgttaacagtatacgtagccctaggtaccagcagacgaccgtggccgaggcctcccgaggtcccttcctacgacttcctatagacttaacagtttaggaacggacgggccacgtggacctatcgtacagggctaagtacttacgaagttcgggtcgtaagggttgggttaccggtcggggaaacctacgggttaacctttacccgaccgtttcccgtaccccgtaaacccccgttaccgtaaccccgacggtaccccgttaacggaaccgttaccccggtttaaagtaacggtttaacgtttttacggttaaacgtttttaacgttaccgttacgttaacctaacggtaacggtacccggtaacgtaaccgttaaccggtcccgggtacccctttacccggttaaccgggtttccggggaacgggtaccggggtaacccgttaaaggggttccgaacgtacggaccgtaacggacccggttaacgttagggtccggttaccgtaccggtacccgtaccttagttacccgttcgttacgttttacccaccggtttccccgtttacccggtcccgttaaccg

SEQ ID NO: 269818 - DNA, 889 bp, Homo sapiens
  misc_feature: GYAE6OF01EF1CO.12.18.B07.1.454.CMB.1.raw
  modified_base (206)..(206): a, c, t, g, unknown or other
  misc_feature (206)..(206): n is a, c, g, or t
  modified_base (254)..(254): a, c, t, g, unknown or other
  misc_feature (254)..(254): n is a, c, g, or t
  modified_base (313)..(313): a, c, t, g, unknown or other
  misc_feature (313)..(313): n is a, c, g, or t
  modified_base (400)..(400): a, c, t, g, unknown or other
  misc_feature (400)..(400): n is a, c, g, or t
tcagatacgacgtacacgaccggtgctcgatttagtcgctgcgtaagggggaggaactgctcagttaggacccagaggaaccatggaagccccagctcagcttctcttcctcctgctactctggctcccagactaccacgtggaagaaatagtgatagaagcagtcctccacgcctaccctgtctgtcgtctaccggaagggaaancgccctaccctctccgtggccacgggccaggtcaagtagttagttaanacgacgtaccttaggcctaggaccagcacgtaacgtaccgtacggaccgtacggtcccncccgtacggtcccttaccgtacctattaccgtaagttcggtcgtacctactaccggtaaccggcgggtaccctacggttcgtaaccncccggagtacccgtaggttcgtacggtcggtacgtagggtcgggttaccgaggggtaacctagggttaccttccgtaacctacgtacctaaccgtacgtaccgtacggacgtaccgtcgtaccgtacgtcgttaacgttaaggttaaacgtttagttttaccggtaacgtttagtttttactttaccggttaacgttacgtaacggtactttaaacggtttaaaaccgtttaacgtttaaccggtttccgttttacccggttaccgttacccgtttaaacccggggtttcccgggggtttaaccgggggggtaaacccggggttaaccgggttaaaagggttaccgggttaaaccgtaaaccggttaaaaccggtaaaccgggttttaaccgggttcggggttaaacccgtacggttaaaccccggtaaacctttcccgtaaacggtttcctttaacccggttttaaccccttcggtttaaaccccccg

SEQ ID NO: 269819 - DNA, 908 bp, Homo sapiens
  misc_feature: GYAE6OF01CH0Q2.12.18.B07.1.454.CMB.1.raw
  modified_base (408)..(408): a, c, t, g, unknown or other
  misc_feature (408)..(408): n is a, c, g, or t
tcagatacgacgtacacgaccggtgctcgatttagtcgctgcgtaagggggaggaactgctcagttaggacccagagggaaccatggaacgccccagctcagtcttctcttccctcctgctactctggcctccagactaaccgacggaagtaattgtgttcgactcagtcctccacgccctacccttgttctttcgtccgtaccggaaggggaacacgacctaacccttcgtccgtacggaccggacgggaccagtaccgaaggtacggttacggttacggaccggtactaaaccgttacggtccgtaccgttaacggaaacccgaaacgaaccggtaaccggtcgggaccgaaccggtcccttccggacggtacccttacgtacaacttcggttagtcgggtactanaccctacggacgaccgggtcgcctaggccgactccgacgtaactacggtcggtacgtaggcggtagtaggggtcggacggaaggtactacggttaccacgtactccaccgtaactacacggtattaacgggaccggtgggtaccttaaggtaacggttaacgtttacgggtttagtaaccgtttttaaggttttacccggttaagtaccggtacgtaaaggttttaacccgttaaagtttaaccggtttaaaccgttttcggtttacccgtaccgtttacgggtacccgttttaaccggggtacccggggtttaaccgggggggaaaccgggttaacggtaaccgggttaagggtaaccctaacgggttaaaaaccggttacggtcggggtttaaccggacggtaccttaaccgggtaacccttacggttaaccttttcgggttaaccccgtttaccgttaacccgttttacccccgtaccggttccgttaaccgtaccg

SEQ ID NO: 269820 - DNA, 798 bp, Homo sapiens
  misc_feature: GYAE6OF01E5I4Q.12.18.B07.1.454.CMB.1.raw
tcagatacgacgtacacgaccggtgctcgatttagtcgctgcgtaagggggaggaactgctcagttaggacccagagggaaccatggaacgcccagctcagcttctcttcctctgctactctgcctcccagactaccgacggagtaattgtgttcgactcagtcctccgacgccctaccttgttctttacgtcctaccggaaggggtaaacacgacctaaccctctacgtcgacgacggcctagtacgagtagttacgtaacagtacttacgtacgccgtacgtacacgacgacgacgtccgtcggacgacgtacctccgacgtcctcctagtcttactagcgtactacgacctaaccgaaccgaaacggtcccaggtccggacctaccgtaccccgaggtaccgttacgtacggaacggtcggacggtaggggttcggacgggtcggtacgtaacgttcctacgtaccctactaccctaacgtctaacggtaccgtacgtaccgtacggttacgaacccgttacggttaacgtaacgtttttacgttacggtttaacgttttacgtttacggtttaacacggtactacgtacggttacgtaccgggtaccgtaacggttccgttcggtttacccggttttaccgttacggtttccgggttacccgggaacgggaaccggtacggtaacggtggtaaaccgtaacggtacctaaaccggttacgtaaccgggttgacggttaccaccggttacccgtactttcgtaccgtttaccttaccgttcggtccccttccccg

SEQ ID NO: 269821 - DNA, 903 bp, Homo sapiens
  misc_feature: GYAE6OF01BX0CR.12.18.B07.1.454.CMB.1.raw
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagcccacctgtctttgctccgaggggaaancncaaccctctccngcgagggccagtcagacgtagttaacagacttacttacgccgtacggtaaccagtacgagacgaccgtggcccgaacggcctacccgaggcccttacccgtactaacttaccgtaactacggtaaacttaccgtaagtttaacgggaaacgggtaaccgggtacccctaaacggttccgggacctaacggtttacccgtaaccggaaagggacctaaaggttaacgtttaaccgaaaaggtttccgggacggtacgggttacggggtcccggtaggaacccgaaggtaaccctttacgacccttaccgtacccacccccttaacaacccgtactaccggtaacgtaccgtacccgttaaggttaaacgttacggtttttaacggtaaactttttaacgttaactaacggttaaccaaacgttaacggtacgtttaacaccccgtttaaacgccgggttaccccttacccggtaaccggttttccggggaccggggtaaacccggggttaaacggtaaacgggggtcggtaaaacgttacggaaaccgtaaaccgggtaccggttaaactcccgggggtttaagggaaccccttttgggaaaacccttaccccggtacggttttacccttaacggggtttacccccttaggttaaacccgttcccccggttaacccccggtatttaaaccccgg

SEQ ID NO: 269822 - DNA, 505 bp, Homo sapiens
  misc_feature: GYAE6OF02HFO9F.12.18.B07.1.454.CMB.1.raw
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagccaccttctcctgcagggccagtcagagtcttagcacctacttagcctggtaccaacagaaacctggccaggctccaggctcctcatctatgatgcatccaaaagggccactggcatcccagccaggttcagtggcagtgggtctgggcagacttcactctcaccatcagcagcctagagcctgaagattttgcagtttattactgtcagcagcgtagcaactggcctcggttcacttttggcctaggggaccaagctaggagatcaacgactgtggctgcaccatctcgtcttcattcctccgtcc

SEQ ID NO: 269823 - DNA, 508 bp, Homo sapiens
  misc_feature: GYAE6OF02GC0GR.12.18.B07.1.454.CMB.1.raw
  modified_base (196)..(196): a, c, t, g, unknown or other
  misc_feature (196)..(196): n is a, c, g, or t
  modified_base (475)..(475): a, c, t, g, unknown or other
  misc_feature (475)..(475): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagacgcctgaagtattttggaattttattactgtacaactagcgtagcaactggcctccacttcggcggagggaccaagggtgagatacaagcgactgnggctgcaccatctgtcttcatccttcccgctac

SEQ ID NO: 269824 - DNA, 541 bp, Homo sapiens
  misc_feature: GYAE6OF02HYJHX.12.18.B07.1.454.CMB.1.raw
  modified_base (196)..(196): a, c, t, g, unknown or other
  misc_feature (196)..(196): n is a, c, g, or t
  modified_base (419)..(419): a, c, t, g, unknown or other
  misc_feature (419)..(419): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctcctgcagggccagtcagagtgttaacagatacttagcctggtaccagcagagacctggccaggctcccaggcctcctcatctatgatacattgaagagggccatggcatctcaggcagattcaatggcaggtgggtctgggacagacttcactctccaccctcaccagcctagacgcctagaagtattttaggaattttatactgtactaanagcgtaagcaaacgtcggccttacccacgtttccgggacggtagggaccgaagggtggaagagtcaagcgtaacgtggtaggctgaccacctactcgtgttcttcattccttcccgcctacg

SEQ ID NO: 269825 - DNA, 612 bp, Homo sapiens
  misc_feature: GYAE6OF02HZ2KO.12.18.B07.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtatttgtctccaggggaaanagcaaccctntcctgcagggccagtcagagtgttaacagatacttagcctggtaccagcagagacctggccaggctcccaggctcctcatctatgatacattgaagagggccaactggcatctcaaggcagattcaatggcagtgggctgggacagacttcactctcaaccctcaccagcctagagccctgaagtatttaggtaaatttagttaactgttacaaactagtacgttagactaaactggacccttcccgaacgttttcgggaccggtaacggggtacccgaaaggggttcggaaggtaactacgtaaacggacgtaaccgtggttcgggaacgttcggccgaacccgtaacgttccgttacggttaccttaccggttaacctttcccgttaccccgtacccttaaccg

SEQ ID NO: 269826 - DNA, 534 bp, Homo sapiens
  misc_feature: GYAE6OF02GTQ2S.12.18.B07.1.454.CMB.1.raw
  modified_base (195)..(195): a, c, t, g, unknown or other
  misc_feature (195)..(195): n is a, c, g, or t
  modified_base (381)..(381): a, c, t, g, unknown or other
  misc_feature (381)..(381): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccacctgtctttgtctccaggggaaanagcaaccctctcctgcagggccagtcagagtgttaacagatacttagcctggtaccagcagagacctggccaggctcccaggctcctcatctatgatacattgaagagggccatggcatctcaggcagattcaatggcaggtgggtctgggacaggacttcactctccaccctcaccagcctagcncctgaagtatttggaatttatactgtacaacagcgtagcaactcgccttaccctacgtttccgggcggtaacgggaccgtaagggtggaagacgtcgaagcgtaacgtggtggacttcgcacctatctcgttcttcactccttcccgcctacg

SEQ ID NO: 269827 - DNA, 546 bp, Homo sapiens
  misc_feature: GYAE6OF02IWCFW.12.18.B07.1.454.CMB.1.raw
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaagagcaaccctctcctgcagggccagtcagagtgttaacagatacttagcctggtaccagcagacgacctggccaggcctcccgaggcctcctcatctatgatacattgaagagggccacgtggcatctcaggcagattcaatggcaggtgggtctgggacagacttcactctcaccctcaccagcctagacgcctagaagtatttagtaatttattactgtacaacagtcgtacgctaactcggccctccctacgtttccggacgggacgggaccgtaaggtcggagagtacgaagcgactggtcggcgtcgacacctatccgttcgttcttactactcccttcccgctacg

SEQ ID NO: 269828 - DNA, 608 bp, Homo sapiens
  misc_feature: GYAE6OF02HJQZE.12.18.B07.1.454.CMB.1.raw
  modified_base (196)..(196): a, c, t, g, unknown or other
  misc_feature (196)..(196): n is a, c, g, or t
  modified_base (378)..(378): a, c, t, g, unknown or other
  misc_feature (378)..(378): n is a, c, g, or t
  modified_base (425)..(425): a, c, t, g, unknown or other
  misc_feature (425)..(425): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctcctgcagggccagtcagagtgttaacagatactagcctggtaccagcagacgacctggccaggctcccaggctcctcatctatgatacattgaagagggccatggcatctcaggcagattcaatggacaggtgggtctgggacaggtacttcgactctaccaccctcaccngcctagacgcctagaagtattttaggaatttattactcgtacaacgngtacgtagcaacgttcggacccttacccgtactttaccggggacgggtaacggggtaccctaaggggtcggaacggtactacgaaacgggtccgtaaaccggtggtaccgggtactgggaccctaaccgtagttacccgttgttacccgttacctacgtttccccgtttaccccggcttaacg

SEQ ID NO: 269829 - DNA, 602 bp, Homo sapiens
  misc_feature: GYAE6OF02IR36U.12.18.B07.1.454.CMB.1.raw
  modified_base (285)..(285): a, c, t, g, unknown or other
  misc_feature (285)..(285): n is a, c, g, or t
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
tcagatacgacgtacacgaccggtgctcgatttagtcgctgcgtaaggggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctnatctatgatacattgaagagggccacgtggcatctcaggcagattacaatggctaggtgggtcngggacagacttcactcncacctcaccngcctagcgtacctagaagtacttttaggaattttagtactagtacaactagacgtagactaacgtcggccctacccgtacgtttcgggacggtagggaacctaagggtcggaaagacgttaacgaacgggtaccgttaacggtcggttcgggacttacggacctaacccgttagttccgttaacggttcctttaccacgtttcccgtttaccccccggcttaaccg

SEQ ID NO: 269830 - DNA, 811 bp, Homo sapiens
  misc_feature: GYAE6OF02H9HK6.12.18.B07.1.454.CMB.1.raw
  modified_base (214)..(214): a, c, t, g, unknown or other
  misc_feature (214)..(214): n is a, c, g, or t
tcagatacgacgtacacgaccggtgctcgatttagtcgctgcgtaagggggagggaacgtgctcacgttaggacccaggagggaacccatggtaagccccagctcagcttctcttcctcctgctactctggctcccagataccaccggagaaattgtgtttgactcagtctccagaccaccctgtctttgtctccaggggaaagagcaaccctntcctggcagggccagtcaggacgtgttaacagatacttagcctaggtaccagcagacgacctggccaggcttcccaggcctcctctagtcctatgactacagttaggaacgtagggccacgttggaccaacgtctaccgaagggtccaaggtatttacgaaagttgggaacctagggttgggtacgtagggtaacaggtacttaccgacgtacctacccgtacccctcgtaacccgtaccggtaccttaacggaacggtacccgtaacggtaaacgttaacgtttttaaacggttaaaacttttaacgttaaccgttacgttaaccgtaaaacccgtaacggttaccgttaaacgtacccgtaaaccggttaccggtaaccccgttacccggttaaccggttttaccgggggaccggtaaaccgggggtaaccggtaaacggggttacgggtaaacggtaacgtaccggtaaacgggtaccggtaaccggttagggtttaccggtcggttaccggtaaccgtaacccggttaccttaccggtttccgttacccgttaccgtaacccgttttcccgttaccccccgtacttaacccgg

SEQ ID NO: 269831 - DNA, 576 bp, Homo sapiens
  misc_feature: GYAE6OF02F1Z68.12.18.B07.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctcctgcagggccagtcagagtcttagcacctacttagcctggtaccaacagaaacctggccaggctcccaggctcctcatctatgatgcatccaaaggccagtggcatcccagccaggttcagtggcagtggtctagggcagacttcactctcaccatcagcagcctagacgcctgaagtatttgctagttattactgtcagtcagcgttagcaactggcctcggttctacgttttcggccgtacggggacctaaagccgttaggaggtaactccgtaaacgtaaacgtacggtcgggaccgttcggaccctaaccgtaacttacgttccggttaccgtttcctaacgtttcccgttccccggtaacccc

SEQ ID NO: 269832 - DNA, 620 bp, Homo sapiens
  misc_feature: GYAE6OF02G5VAE.12.18.B07.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctcctgcagggccagtcagagtgttaacagatacttagcctggtaccagcagagacctggccaggctcccaggctcctcatctatgatacattgaagagggccatggcatctcaggcagattacaagtggcaggtgggtctgggacagacttcactctacaccctcaccagcctagacgtcctagaagtattttaggaaattttattactgtacaacgtagtcgttaagactaaacgtcggtacccttacccgtacgttttaccgggaccgggtaacgggaacccgtaaaggggttcgggaacggtaacgttaccgaaaggccggtaaaccgttggtacgggcgttacggacctaacccgtaagttccgttacggttaccttaccgtaactttcccgtttacccccgacttaacg

SEQ ID NO: 269833 - DNA, 512 bp, Homo sapiens
  misc_feature: GYAE6OF02FX44K.12.18.B07.1.454.CMB.1.raw
  modified_base (380)..(380): a, c, t, g, unknown or other
  misc_feature (380)..(380): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcatctcacatcacagactggancctgaagtattttgctagtgttattattgtcagcagtatggtagcgcacgtacgacttttggccgacggggtcaagcgtggagactagaacgtactgtggctgccacatctgtcttcactcttcccgactac

SEQ ID NO: 269834 - DNA, 650 bp, Homo sapiens
  misc_feature: GYAE6OF02IV2EJ.12.18.B07.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctcctgcagggccagtcagagtgttaacagatacttagcctggtaccagcagagacctggccaggctcccaggctcctcatctatgatacattgaagagggccatggcatctcaggcagattcaatggcagtgggtctgggacagacttcactctcaccctcaccagcctagacgcctagaagtattttaggaaattttacgttacttgtactaaacgtagtacgtacgactaaacgtcggacccttcccgtaacgttttccggggaccgggtaacggggaacccgtaaaggggttcgggaaacgtaacgttaccggaaacgggtacccggtaaacggttcggggtacgggtacccgttacggacccgtaaacccgtaacgtttcccgttacggtttcccttttaccgtaacgttttccccgtttaccccccggacccttaaccg

SEQ ID NO: 269835 - DNA, 622 bp, Homo sapiens
  misc_feature: GYAE6OF02IO7XU.12.18.B07.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaangcaaccctctcctgcagggccagtcagagtgttaacagatacttagcctggtaccagcagagacctggccaggctcccaggctcctcatctatgatacattgaagngggccagtggcatctcaggcagattcaatggcagtgggtctgggacagacttcactcncaccctnaccagcctagacgcctagaacgtagttttaggaaattttagttaactgttaccaaacgtaggtacgttaagacctaaacgttcgggcccttacccgacgttttccgggaccgggtaacggggtaacccgaaggggttcggaaggtacttaaccgaaaggtccgaaacgttggtacgggtcttacggaccctaacccgagtttccgttacggttacccttttccggaactttccccgtttaccccggaccttaacg

SEQ ID NO: 269836 - DNA, 889 bp, Homo sapiens
  misc_feature: GYAE6OF02G7V31.12.18.B07.1.454.CMB.1.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
  modified_base (310)..(310): a, c, t, g, unknown or other
  misc_feature (310)..(310): n is a, c, g, or t
  modified_base (400)..(400): a, c, t, g, unknown or other
  misc_feature (400)..(400): n is a, c, g, or t
tcagatacgacgtacacgaccggtgctcgatttagtcgctgcgtaaggggggaggaactgctcagttaggacccagagggaaccatggaagccccagctcagcttctcttcctcctgctactctggctcccagataccaccggagaaattgtgttgactcagtctccagccaccctgtctgtgtctccgaaggggaaanagccaccctctcctgcgagggccagtcaggagtgttaangcgacttagcctggtaccagcagactaccgtggccaggtcctcccgaggtcctcctcattctagttgggtcncctaatcctaaccggacggggccctaacggttcggtaacctccccgaagtcccgtaagggtttccagggttcggctagggttcgggtcgnggggtaacaggttacgttaccaacgttcctaccgaacctattccgaagtacccgacggtccctaggtaccgtaacggtttacgtagggttaaagtttacgttttttacgggacctttaaacggttttttaaccgtttaaccgttacggtttaaccgtaacggttaaccgttaaaggtttaaaacgttttaaaaaccgtttaaaccggttttcggggttttaaccccttacgggtttacccgtttaacccgggtttacccgggttttacccgggggggggttaaacccggggggggtaaaccccgttaaagggggttaaccgggggtaaacgtaaaccgggtttaaacccggaaaaaccggggtaacccggttttcggggtaaacccgggttccgttaaaccggtacccgtaaaacccggttccggtttaacccggtttaccggttttaccctttaccggttaccccgttacccccggttaaccccccgg

SEQ ID NO: 269837 - DNA, 589 bp, Homo sapiens
  misc_feature: GYAE6OF02ITV7S.12.18.B07.1.454.CMB.1.raw
  modified_base (195)..(195): a, c, t, g, unknown or other
  misc_feature (195)..(195): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaanagcaaccctctcctgcagggccagtcagagtgttaacagatacttagcctggtaccagcagagacctggccaggctcccaggctcctcatctatgatacattgaagagggccatggcatctcaggcagattcaatggcaggtgggtctgggacagacttcactctcaccctcaccagcctagacgctagaagtagttttaggaattttagttaccttgtaccaactaggcgttaacgactaactcggacccttcccgtaacgttttccgggacgggacgggtaacccgaaggggttacgggagtaacgtaccgaaagtccggtaacgtggtacgggtcttacggaccaaccgtacttcgttcgtactttcctacttccgttaccccgcctaacg

SEQ ID NO: 269838 - DNA, 564 bp, Homo sapiens
  misc_feature: GYAE6OF02FMUZJ.12.18.B07.1.454.CMB.1.raw
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcaggtgggtctgggacagacttcactctccaccctcaccagcctagacgcctagaagtattttaggaattttattactgtacaactagacgtagctaacgtcggtaccctccgtacgttcgggacggtacgggaaccgtaagggtggaagactacgaagcgtaacgtggtcggtctcgacctacctagttccgttacgttccttacctacgtttcccgttcccgtctacg

SEQ ID NO: 269839 - DNA, 575 bp, Homo sapiens
  misc_feature: GYAE6OF02HEYPO.12.18.B07.1.454.CMB.1.raw
  modified_base (196)..(196): a, c, t, g, unknown or other
  misc_feature (196)..(196): n is a, c, g, or t
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctcctgcagggccagtcagagtgttaacngatacttagcctggtaccagcagagacctggccaggctcccaggctcctcatctatgatacattgaagngggccagtggcatctcgaggcagattcaatggcaggtgggtctgggacagacttcactctccaccctcaccagcctagacgtcctaggaagtagttttaggtaattttagttacttgtacaacgtagtcgtagcaacgtcggacccttcccgtacgtttcgggacgggtaacgggaccgtaagggtcggaacgtagtacgaagtaccgtaacgtggtacggcttacgctaaccgtattcgtcgttacttcctacgtttccttacccgctacg

SEQ ID NO: 269840 - DNA, 736 bp, Homo sapiens
  misc_feature: GYAE6OF02JL8GJ.12.18.B07.1.454.CMB.1.raw
tcagatacgacgtacacgaccggtgctcgatttagtcgctgcgtaagggggaggaacgtgctcagttaggacccagagggaaccatggaagcccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagacgacctggccgacggctcccaggcctcctcatctatgatacattgaagacggccagtcgcagtcgacaggcagtacttcaagtcggctaggttcgggtactacggggaactaggtacctttacacgttcccttaccaccccgttacgaccctacggtaccctaaggaccgtacccgtagtaaacggtttacgttttacgggttaaattttacgtttaaccgttacggttaaccctaacgtaacggttacgttaacgtccgttaaacgttccggtacccctttacccgttaccggtttccggggaccgggttaaaccggggtaaccgtaaggggttacgggtaacgtaacggtaccgtaaaccgggtaccgtaacggttcgggtcgggtaacccggttcggtaaccgaacccgttagttaccgtacggtttcccgttaaccgttacccggtttacccggtttaccccggtcccttaagg

SEQ ID NO: 269841 - DNA, 694 bp, Homo sapiens
  misc_feature: GYAE6OF02HH2HO.12.18.B07.1.454.CMB.1.raw
  modified_base (192)..(192): a, c, t, g, unknown or other
  misc_feature (192)..(192): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctccagataccacggagaattgtgttgactcagtctccagccacctgtctttgtctccgagggaagngccaaccctctcctgcgaggccagtcagagtagttaacagatactagcctaggtaccagcagacgacctggccaggcctccgaggtcctcctacatactagtagtaactactagttaggaaggacgggaccaacgtggacacgtctacgacgctagtaacttacgaagtggacgtacgggtcgggttacgtaggggaactacggtactttccgaccgtccttacccaaccccttcgaaccgacggtacccgtaacggtccgtaccgttaaggtaacgtttaacggttttaggtaaacttttacgttaaccgttagtaacctaacgtacggtacgtacgtaccgtaagtcccgtacccttaccgttacggtttaccgggacgggtaaccgggtaaccgtaagggtacgaacgtacgacgtaagaccggtagtcgggttaccgcgttacgacccgtactacgttcgttccgtcttaccgtaccgtcccgttaccgaccttaacg

SEQ ID NO: 269842 - DNA, 660 bp, Homo sapiens
  misc_feature: GYAE6OF02GJZ32.12.18.B07.1.454.CMB.1.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (450)..(450): a, c, t, g, unknown or other
  misc_feature (450)..(450): n is a, c, g, or t
  modified_base (471)..(471): a, c, t, g, unknown or other
  misc_feature (471)..(471): n is a, c, g, or t
tcagatacgacgtacacgaccggtgctcgatttagtcgctgcgtaagggggagggaactgctcagttaggacccagagggaaccatggaagccccagctcagcttctctcctcctgctactctggctcccagataccaccggagaattgtgttgactcagtctccagccaccctgtcttgtctaccgaggggaaangccaaccctctccctggcacgggccagtccagacgtagttaacagactactagcctggtaccagcagacgtacctggaccacggctccccgaggccttccnctatccgtatcgaacttaccagttagaacgcggggacccaagtcggctaacgtcctcgaggggccagtacttacacgtggctagggtggtctaggggacagccttnacctctaccncccacgtaccacgtctaacgcgcccgttagaaggttnttttacggaaatttcgttaancggtactaaagcggtaacggttctacgtaacgtccggtaccctaccgttaccggtttacgggaccggtaacgggaacgtaacggggtagaccgtaacgcgtaacggacccagttaggtccgggaccttaggaccacccgttaattccgttacggtcctttaacgccgtttaccccgttcccacgttcgg

SEQ ID NO: 269843 - DNA, 556 bp, Homo sapiens
  misc_feature: GYAE6OF02GCYYZ.12.18.B07.1.454.CMB.1.raw
  modified_base (196)..(196): a, c, t, g, unknown or other
  misc_feature (196)..(196): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctcctgcagggccagtcagagtgttaacagatacttagcctggtaccagcagagacctggccaggctcccaggcctcctcatctatgatacattgaagagggccactggcagtctcaggcagattcaagtggctaggtgggtctgggacagtacttcactcncaccctnaccagcccgtggacgccgtaggtaagtacttttgcgtagtagttattattgttacagtcgtagttagtggtaggcgcgaccgtactacgttttggccgtacgggtccaacggcgtaggacgagtagaaacggtaacgtcgtaggtcgtgaccaccgattccgttagttacttctattccccg

SEQ ID NO: 269844 - DNA, 696 bp, Homo sapiens
  misc_feature: GYAE6OF02GS6QJ.12.18.B07.1.454.CMB.1.raw
tcagatacgacgtacacgaccggtgctcgatttagtcgctgcgtaaggggggaggaactgctcagttaggacccagagggaaccatggaagccccagctcagcttctcttcctcctgctactctggctcccagataccaccggagaaattgtgttgactcagtctccagccaccctgtctttgtctccgaggggaaagagccaaccctctcctgcagggccagtcagagtgttaacagatacttagcctggtaccagcagagacctggcccaggcctcccgaggcctcctcatctatgatactagttgaagcgggcctagtggctactctacgagggcaaggtacttacgaaagtcggacgtaggggttcggggtcgttaggggaacctaaggtaacctttaccgaacctttccccgtaccgtacccccctcgaaccccgtaacgtaccccgtaacggaaccgttcccgtaaggtaaacgtttaacgttttacggtaaatttttaacgttaccgttagtacctaaacgtacgtacgtaacgtactaaccgtcggtaccccttaccgttacggtttccgggaaccgggacgggtaaccgtaagggtcgggaagtaccggtaagacgggacgtacgttggacggttcgaccgacctacgacttacgtcgttaccttcggtaccttcccgtccactacg

SEQ ID NO: 269845 - DNA, 628 bp, Homo sapiens
  misc_feature: GYAE6OF02FUPYQ.12.18.B07.1.454.CMB.1.raw
  modified_base (199)..(199): a, c, t, g, unknown or other
  misc_feature (199)..(199): n is a, c, g, or t
  modified_base (402)..(402): a, c, t, g, unknown or other
  misc_feature (402)..(402): n is a, c, g, or t
tcagatacgacgtacacgaccggtgctcgatttagtcgctgcgtaaggggggaggaactgctcagttaggacccagagggaaccatggaagccccagctcagcttctcttcctcctgctactctggctcccagataccaccggagaaattgtgttgactcagtctccagcccaccctgtctttgtctccgaggggaaanagccaaccctctcctgcagggccagtcagagttgttaacagtatacttagcctggtaccagcagacgacctggccaggcctcccgaggcctcctacatctagtggtgctatccgtaccgagggccctagtcggtactacccgagtcccaggttcaggtggcgagggtgggtcgtgggaacaggtacgtctacttcacactacncagccacgcctgctagtctaggtaattgttttgacttagtttattacgtgttactagctaagttataaacgttacgttcggttacttcgtacttccgtacgggtttcgggggaccggggtaacgtaagggttggaaatacgtaacgaaccggttacgtacggttcggactacggacctaacgtcgttacttcggttccgttaccgtacctttcccgtacccgtacc

SEQ ID NO: 269846 - DNA, 625 bp, Homo sapiens
  misc_feature: GYAE6OF02G5EQM.12.18.B07.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctcctgcagggccagtcagagtgttaacagatacttagcctggtaccagcagagacctggccaggctcccaggcctcctcatctatgatacattgaagagggccacgtggcatctcaggcagattcaatggcaggtggtctgggacagacttcactctcaccctcaccagcctagacgtcctagaagtattagtaggtaatttagttactgttaccaacgtagtacgtagactaacgtcggacccttacccgtacgtttccggggacgggtaacgggtaacccgtaagggtcgggtaaacgacgttacgaacggtccggtaaaccgtgggttacgggaccgttacggacccgtaacccgtaagttcccgtttacggtttaccctttaccgtaccgttttccccgttacccccggtacccg

SEQ ID NO: 269847 - DNA, 712 bp, Homo sapiens
  misc_feature: GYAE6OF02HW4AH.12.18.B07.1.454.CMB.1.raw
  modified_base (195)..(195): a, c, t, g, unknown or other
  misc_feature (195)..(195): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaanagcaaccctctcctgcgagggccagtcagagtgttaacagtatactagcctggtaccagcagacgacctggccaggcctcccgaggcctcctcatcctatgactacattagaaggacgggccagtggacatcctcaggctagtacttcgaaagtcggacagggttacggggtctagggggaactaaggttacctttacgaacctttcccgtccctaaaccccttcccgaacccgtacgtacccgtaaggtacccgtacccgtaagggtaaacgtttagttttttaacgggtaaattttttaacgtaccgttacggttaacctaaacgtacgtacggttaacgtacctaaacggtccggtaccccttacccgtaccggtttccgggaccgggtaacgggaacgtaacggggtagaacgtacgtaacgacggacgtaacgttgggtaccggctaccgaccgtaacctacgttccgttaggttccttacgttaccctttcccgttaccccgtccttaacg

SEQ ID NO: 269848 - DNA, 724 bp, Homo sapiens
  misc_feature: GYAE6OF02GMJDC.12.18.B07.1.454.CMB.1.raw
  modified_base (712)..(712): a, c, t, g, unknown or other
  misc_feature (712)..(712): n is a, c, g, or t
tcagatacgacgtacacgaccggtgctcgatttagtcgctgcgtaagggggaggaactggctccagttacggacccagagggaacccatggaagccccagctcagcttctcttcctcctgctactctggctcccagataccaccggagaaattgtagttgtactcagtctcctaagccaccctgtctttgtctccgaggggaaatgcaaccctcgtcctgcgaggggcccgacgtcagacgtgttacagtatactagctggtaccagcagtagactggccaggctccgaggcctcctcagtctactggatactagttagaaggtacgggcctagtggctattctcggaggtaccaagttacttacaaaggtcggtactagggttcgggtacgtcggaactggttaccctccgaccctacgtaccctccgaacgtccgaccctaaggaccgtaaccgtacgtaacgttttaacgttttaacggtttaacgttttactttaccgtcgtaaacctaaacgacggttaacgtacttacgtaacgttcccgggtacccttacccgggttaccgttaccgggaccgggttaaacgggtaccgttaaggggttagggaaccgtataaccggaaacgtccgttaacggtgttaacggcggttaccgaccgtacctacgtttcgtacgtttaccgttaacgttcgttaccccgttcccggngtttactaccgg

SEQ ID NO: 269849 - DNA, 745 bp, Homo sapiens
  misc_feature: GYAE6OF02GD1SK.12.18.B07.1.454.CMB.1.raw
tcagatacgacgtacacgaccggtgctcgatttagtcgctgcgtaagggggaggaactgcctcagttaggacccagagggaaccatggaagccccagctcagcttctcttcctcctgctacctctggctcccagataccaccggagaaattgtgttgactcagtctccagccaccctgtctttgtctccaggggaagagcaaccctctcctgcagggccagtcagagtgttaacagatacttagcctggtaccagcagagacctggccaggctcccgaggctcctcatctatgatacattgaagaggccacgtggcactctcgaggcagattcgaaagtcggacgtagggtcggggtcgtaggggactacgggtacctttaccgaccgtttccctcccgtaacccccttacccgaaccccgtaacgtacccgtaacggaacggtacccccgttaaggtaaacggtttaagttttttaacgggtaaaacttttttaacggtttaacccttagttaaccgtaaaaccgtacggtaaccggttaacgaccgttaaaccgttcggtacccccttacccgttaaccggttttccggggaccggggtaccgggtaaccggaacggggtttcggaaacgtcgtaacgaacggtaccggtaacgttaggtcgggacctaccggtaccgtaacccgtagtttcccgttaggttccgttacccgtacgtttaccccgttccccgtaccttaaccg

SEQ ID NO: 269850 - DNA, 620 bp, Homo sapiens
  misc_feature: GYAE6OF02F4FKC.12.18.B07.1.454.CMB.1.raw
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
  modified_base (565)..(565): a, c, t, g, unknown or other
  misc_feature (565)..(565): n is a, c, g, or t
tcagatacgacgtacacgaccggtgctcgatttagtcgctgcgtaaggggggaggaactgctcagttaggacccagagggaaccatggaagccccagctcagcttctcttcctcctgctactctggctcccagataccaccggagaaattgtgttgactcagtctccagccaccctgtctttgtctccaggggaaanagcaaccctctccngcagggccagtcagagtgttaacagattactagcctggtaccagcagacgacctggccaggcctcccgaggcctacctcatctatcgatacagttgaaggacgggccaacgtggctatctacaggctagtattcgaatggactaggtcgggtntggggactaggtaccttcaaccttcgacctaccccttcaacccngtaccagtaccgtcctaggaaagttattttaggtaaattttacttaacgtgtaaccaacgtagtccgtaggacctaacggtcggtccccttacccgttagtttacgggaacggtacgggaccgtagggtacgacgtacttacgaagcgtaagttggnggtacgtcaccggaccttagtcttacggtccttacacgttcccttccgaccttcg

SEQ ID NO: 269851 - DNA, 639 bp, Homo sapiens
  misc_feature: GYAE6OF02HN3AW.12.18.B07.1.454.CMB.1.raw
  modified_base (195)..(195): a, c, t, g, unknown or other
  misc_feature (195)..(195): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaanagcaaccttctcctgcagggccagtcagagtcttagcactactagcctggtaccaacagaaacctggaccaggcctcccaggcctcctcatctatgatgcataccgaaaagggcccacgtcgggacactccccgacgccgtaggttcaggtggcgaggtgggtcgtggggctagtacttcacctcgtccactatcagcagtcctagcgacctagtaagtattttcgcttagttttaattacgttgtacctagacctaggtacgtacgtacctaacgtcggtacccgtttcggttaccgttaccgttttcgggacccgtaggggtaccctaaggtcgtagggaagtacgtaacaaaccggtacgttagggtacggtccgttacgacctacccgtacgttccgttacggttctttaccgtaacccgtttcccgttccccgtaaccg

SEQ ID NO: 269852 - DNA, 686 bp, Homo sapiens
  misc_feature: GYAE6OF02FIPJW.12.18.B07.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccgaggggaangcaaccctctcctgcagggccagtcagagttgttaacagtatactagcctggtaccagcagacgacctcggccaggcctcccgaggcctcctcatctatgatacgtattaggaacggacgggacctacgtggacctatccgtacgaggacaaggttacttacgaagtgggactaggggttcggggtcgtaggggaactaggtacctttaccgacgttcccgttacccaacccccttacgaaccccgtacgtacccgtaacggtaccgtaccgttaaggtaaacggtttagtttttaaggttaaactttttacgttaacttacgtactaaacgtacggtacgttacgacctaacgtccgtacccttcccgtaacgtttccggggacgggtaacgggaccgtaagggcgtaacgtactacgaacgtacgtacgtggtacggtctgtaccacgacgttcgttcgtcttacctacgttcccttaccgcttaacg

SEQ ID NO: 269853 - DNA, 587 bp, Homo sapiens
  misc_feature: GYAE6OF02HKU83.12.18.B07.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
  modified_base (508)..(508): a, c, t, g, unknown or other
  misc_feature (508)..(508): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccgaggggaaanagcaaccctctcctgcagggccagtcagagtgttaacagatacttagcctggtaccngcagagacctggccaggctcccaggcctcctcatctatcgatacattgaagagggccacgtggcatcctacgaggcagattacaagtcggcaggtgggtcgtgggactagacttcactctccaccctcaccagcctagcgcctagaacgttagttttaggtaattttacgttacgtcgtactaacgtagtcgtagctaacgtcgaccctccgtaccgtttcgggccggtaacgggacctaagggtgaacggtanacgaaggaccggtattgggtacggtctacgacaccgttactcgttcgtaccttactcgttacccgttccccgctaaccg

SEQ ID NO: 269854 - DNA, 829 bp, Homo sapiens
  misc_feature: GYAE6OF02G0FC4.12.18.B07.1.454.CMB.1.raw
tcagatacgacgtacacgaccggtgctcgatttagtcgctgcgtaaggggggaggaactgctcagttaggacccagagggaaccatggaagccccagctcagcttctcttcctcctgctactctggctcccagactaccaccggagaaattgtgttgactcagtctccagcccaccctgtctttgtctccgaaggggaagagccaaccctctcctagcgacgggccagtcagtagttagttaacagtattacttagccttaggtaccagcaggacgaccgtcggaccgacggcccgtacccgacggtccttacccgtctaattaccttaagtagtaaccttacctaagtttaggaaacgggtaccggggtaccctaaccggttaggacctacgttccgtacgaacgggtcgaaggtaaccttaccggaaggttacggggtacgtaacggggttcggggtacggttacggggaacgtaacgttaacccgtttccgtaacttcccgtacccctacccgttacccgaccgtaccgtaccgtaacggtacggtacctaagggtaaaccgtttagtttttaacggtaaacgtttttacgttaacgttagtaacctaaaccgtacggtacgtaacgtaccgtaaccggttccgtacccttacccggttacggtttaccggggaccgggtaacgggtaccggtaacgggtacgaacggtaacgtacggaacgtaccggtaaggtcggtacggtacgtaccgtacccgaaccgttacgttaccgtttaccgttacctttaccgtaacccgtttcccgttaccccgtaccgttaaccg

SEQ ID NO: 269855 - DNA, 774 bp, Homo sapiens
  misc_feature: GYAE6OF02IJB09.12.18.B07.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
tcagatacgacgtacacgaccggtgctcgatttagtcgctgcgtaaggggggaggaactgctcagttaggacccagagggaaccatggaagccccagctcagcttctcttcctcctgctactctggctcccagataccaccggagaaattgtgttgactcagtctccagccaccctgtctttgtctccagggaangcaaccctntcctgcagggccagtcagagtgttaacagatacttagcctggtaccagcagacgacctggccaggcctacccgaggccttcccgtcattcttaatcgaattaaccgtaatttacgggaaacggacggggcccctaacgtgggaccaattccgtaccgaagggacctaaggtaactttaccgaagttcgggacgtagggttcggggttcgtacgggggaacctaacggttacctttaccgaacccgtttccctaccctaaccccttaccgaaccccgtaacgtacccgtaacggaccgtacccgttaaggtaaacgtttaacgtttttagggttaaaacttttagttaccgtacgttaacgtaaacgacggttacgtaacgtacctaaccgttccggtcccttacccgttacgtttaccggggaccgggtaaacgggtacccaaggtccgtaagggaacgaacttaacggaaaaccgtacgttacgggtacggtcctacggacccttaaaccgaacgtttcccgttacgttaccctttacgtaccctttccccgttaccccgaccttaacg

SEQ ID NO: 269856 - DNA, 923 bp, Homo sapiens
  misc_feature: GYAE6OF02IO3HA.12.18.B07.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgctgcgtaagggggaggaactgctcagttaggacccagagggaaccatggaagccccagctcagcttctcttcctcctgctactctggctcccagactaccaccggagaaattgtgttgactcagtctccagccaccctgtctttgtctccgagggaagngcaacccgtctcctgcgaggccagtcgagagttcgttaacagtatacttagcctaggtaccagcagacgactggaccgaggcctacccgaggtcctccgtacacgttctaatgtactaccgtagttacggaacggacggggcctacggtcggtacctacgttaccgtacgtacggactaaggtactttacgaacgttggacgttacggggtacgggttaccggtacggggtaaccgtacggttacccgtttacgtaccgtttccgtacccctaacccgttacccgtacccgtaaccggtacccgtaacggtaccgtacccgttaaggtaaaccggtttaggtttttaaccgggtttaaaacgtttttaacgttttaccggtacgtttaacccggaaaccgtttacggggtaccgtttaaaccgggaacgtttaaccgggttacccggtaccccgtttacccggttaacccggttttaccgggggacccgggttaaccgggggttaaaccccggttaacggggttaaccggggtaaacgtaaaccggttaaacccgggtaaacgggttaacccgttaacgggggtttaccgggtttacccggggtaacccgttaacccggtaacccggtaacccgtttacggttaacccggtttttacccgtttaccgggttacccttttaccccgggtttaaccccggtttcccccggtaacccgttttacccggg

SEQ ID NO: 269857 - DNA, 710 bp, Homo sapiens
  misc_feature: GYAE6OF02G0U8A.12.18.B07.1.454.CMB.1.raw
  modified_base (143)..(143): a, c, t, g, unknown or other
  misc_feature (143)..(143): n is a, c, g, or t
  modified_base (193)..(193): a, c, t, g, unknown or other
  misc_feature (193)..(193): n is a, c, g, or t
  modified_base (282)..(282): a, c, t, g, unknown or other
  misc_feature (282)..(282): n is a, c, g, or t
  modified_base (377)..(377): a, c, t, g, unknown or other
  misc_feature (377)..(377): n is a, c, g, or t
tcagatacgacgtacacgaccggtgctcgatttagtcgctgcgtaagggggaggaactgctcagttaggaccagagggaaccatggaagccccagctcagcttctcttcctcctgctactctggctccagactaccaccgganaaattgtgttgactcagtctccagccacctgttctttgctccgagggaangcacctctcctgcaggccagtcagagtgttaacagtatactagcctaggtaccagcagacgcctggccaggcctccgaggtcctccgtnatcgttatgtatactaagttacggaaggcgggtaccacggtggactacttcgtagacggtcaagtacttacgaagcggtcgtagggtacggggtntacggggaacttggtaaccttccgtccgttactaccctacccgtaccaccgtacgtaccgtacgactaccgtaggtaacgttagttttaacggtaatttttaacggtacttacgtaacctaacggtacgtcgtaacgtcgtaaaccggtcctacccgtacccgttacgggttacccgggacggggtaccggtaaccggtaacgggtacgtaaccggacgttaaccgaacgtaaccggttacggtcggtaccggtactaccggtaacccgtaccgttaacgtacccttcgttacccgttaccgttacgttccccgtttacccgaccgtttaccg

SEQ ID NO: 269858 - DNA, 1011 bp, Homo sapiens
  misc_feature: GYAE6OF02IPFQS.12.18.B07.1.454.CMB.1.raw
tcagatacgacgtacacgaccggtgctcgatttagtcgctgcgtaagggggaggaactgctcagttaggacccagagggaaccatggaagccccagctcagcttctccttcctcctgctactctggcctcccagactaccgaccggagtaattgtgttgactcacgtcctaccacgcccaccctcgttctttcgtcctaccggaagggaaacgacgtaccaaccctcctccgtcgaccgacggaccgacgtacgagtacgttacgttaacgaagtaacgttacgttacgtaccgtacggtaaccgacgacgtttttacgacgtaccgtcggccgacggcctccgacggcctcctctactactacgtagtactacctagttagaaggacggtaccgtaacgcggactacgtcctacgtacggacgtagtacttacgaagtcggacggtaggtacgggtacggtacgggaacgtacggtaccgttacctaccgttaccgtacccgtaaccccttacccgacccgtaccggtacccgttaacggaccgttaccggttaaacggtaaaccgttttaggttttttaaaccggttaaacttttttaaaccgtaaacccgttttacgaaacccgttaaaggtacccgggtttaaaccgaaaccggttacccggtaaacccggttccggttaaaccccccgttttacccggtttaaaccgggggtttttaccccggggaaacccgggggtaaaccccggggttaaaccgggttaaaccgggggggtggttaaacccccggttaaaacggttacccggtaaaaaccggggttacccggtttaaacccgggtcgggggttttaccccgggttaaaccgggttcccccgggtaaaccccggtttaaaaccccttccgggttttaccccggggtttaacctttttcccccggggtacccttttaaacccccggtttttcccccccgggttttaacccccggtaaaaccccgtttttaccccgg

SEQ ID NO: 269859 - DNA, 891 bp, Homo sapiens
  misc_feature: GYAE6OF02IB1CM.12.18.B07.1.454.CMB.1.raw
  modified_base (885)..(885): a, c, t, g, unknown or other
  misc_feature (885)..(885): n is a, c, g, or t
tcagatacgacgtacacgaccggtgctcgatttagtcgctgcgtaagggggaggaactgctcagttaggacccagagggaaccatggaaacccagcgcagcttctcttcctcctgctactctgctcccagatacccacggagaaattgtgtgacgcagtctccaggacctaccctgttcttttgtaccggtccgggggtaaagagtccaccccttctcctggaccgtacgggcctagtacgaggtacgttggttacggtcgggacctaaacgtttactttacggtcccgttaacggaaccccgtaaaactaaccggtaaaaccgttccggggacccggttaaccggcccgtccccgtaacggtcccgttcgttaaccgtaacttcgttaagttcgggttacgaccgttacgtaccccgtacggacccggaacggggtaccccgttacggttccggacggtacccctaccccgaacgacggtttaacgggttacgtacgggttcggacggttaacggggttccgggttacggtaacgggaccgttacggtttaaccctttcccgaacctacccgtttacccgtaaccaaccggtttaaccgaaacgttccggtaacccggtttacgggaaacctttccggtaacggttaacggtttacgttttaggtaaccgtttttaacggttttaactttaacgttcgtaccttaggtacggttaggttacgggtacgggtacgtaaccgtaccgttcgtaaccgttccgtttacggtacccggttccgtacggtaactacgtagacgttaacacgttaaactcgtgtacgtcggtacgacgttactacgttcgttaccgttacttccgttaccgttcccgtacccttaccctnttacgg

SEQ ID NO: 269860 - DNA, 232 bp, Homo sapiens
  misc_feature: GYAE6OF02IH4YJ.26.68.G02.1.454.CMB.1.raw
  modified_base (229)..(232): a, c, t, g, unknown or other
  misc_feature (229)..(232): n is a, c, g, or t
tcagagactatactcacgaccggtgctcgatttagtcgatagtgaagggaaaggggagtcctggggccaggggaccctggtcagcgtctcctcagcctccaccaagggcccatcggtcttcccctggcgccctgctccaggagcacctccgagagcacagcggccctgggctgcctggtcaaggactacttccagtatagtctctgagcgggctggcaaggcgcatagnnnn

SEQ ID NO: 269861 - DNA, 299 bp, Homo sapiens
  misc_feature: GYAE6OF02IPW2S.26.68.G02.1.454.CMB.1.raw
  modified_base (207)..(207): a, c, t, g, unknown or other
  misc_feature (207)..(207): n is a, c, g, or t
  modified_base (235)..(299): a, c, t, g, unknown or other
  misc_feature (235)..(299): n is a, c, g, or t
tcagagactatactcacgaccggtgctcgattttagtcgatagtgaagggaaagggggagtcctggggcccaggggaccctggtcagcgtctcctcagcctccaccaagggcccatcggtcttccccctggccgccctgctccaggagcacctccgagagcacagcggcctgggctgcctggtcaaggctacttccagtatagtctntgagcggggctggcaaggcgcaatacgnnnnnnnnnnnnnnnnnnnnnnnnnnnnnnnnnnnnnnnnnnnnnnnnnnnnnnnnnnnnnnnnn

SEQ ID NO: 269862 - DNA, 485 bp, Homo sapiens
  misc_feature: GYAE6OF01EG8RS.22.46.E02.1.454.CMB.1.raw
  modified_base (451)..(451): a, c, t, g, unknown or other
  misc_feature (451)..(451): n is a, c, g, or t
  modified_base (456)..(485): a, c, t, g, unknown or other
  misc_feature (456)..(485): n is a, c, g, or t
tcagacatacgcgtcacgaccggtgctcgatttagactcatctacagggaaaggggctggagtggatttcatatattaacgatggagggaggacgaaaggtaccgcaaattctgtgaagggccgagtcaccatttcccagagaccaacgcccaggtaactcagtcgtatcgtgtcaaatgaacagccctgacagccgaggacacggcctgtcgtacttactgtacgagagattgggcaagccctgggcctttgatgtctaggggccctgggacaatggtcaccgtcgtccttacgcctccaccaaggggcccgatccggtctttcccccgtggccgcccttcgtcctcctaggacgcgacctccggagacgcacgagcggccctgggcctgccgtggtacaacggacctacttccacgcgtactcgtactcgagcgggctggcaaggtcgnatagnnnnnnnnnnnnnnnnnnnnnnnnnnnnnn

SEQ ID NO: 269863 - DNA, 420 bp, Homo sapiens
  misc_feature: GYAE6OF01DETZN.22.46.E02.1.454.CMB.1.raw
  modified_base (208)..(208): a, c, t, g, unknown or other
  misc_feature (208)..(208): n is a, c, g, or t
  modified_base (329)..(329): a, c, t, g, unknown or other
  misc_feature (329)..(329): n is a, c, g, or t
  modified_base (332)..(332): a, c, t, g, unknown or other
  misc_feature (332)..(332): n is a, c, g, or t
  modified_base (414)..(420): a, c, t, g, unknown or other
  misc_feature (414)..(420): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccattccagagacaacgccaggaactcagtgtatctgcaaatgaacagcctgacagccgaggacacggctgtctattacngtacgagagatggcagcctggccttggatgtctggggccctggacatggtcaccgtctctttagcctaccaccaaggcccatccggtctcccctcgcgcctcgctccagcgcacctcgagngcncgacgcggcctggctgcctggtcaaggtacctacttccacgtcgtatgtctgggacgcgggcctagggccaagggcacatgnnnnnnn

SEQ ID NO: 269864 - DNA, 417 bp, Homo sapiens
  misc_feature: GYAE6OF01BLEAV.22.46.E02.1.454.CMB.1.raw
  modified_base (335)..(335): a, c, t, g, unknown or other
  misc_feature (335)..(335): n is a, c, g, or t
  modified_base (410)..(417): a, c, t, g, unknown or other
  misc_feature (410)..(417): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttcccctggcgcctgctccaggcgcacctcgagngcacagcggccctgggctgcctggtcaaggactacttccacgcgtatgtctgagcgggctggcaaggcgcatagnnnnnnnn

SEQ ID NO: 269865 - DNA, 419 bp, Homo sapiens
  misc_feature: GYAE6OF01AMP6A.22.46.E02.1.454.CMB.1.raw
  modified_base (413)..(419): a, c, t, g, unknown or other
  misc_feature (413)..(419): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctctgggggcacagcggccctgggctgcctggtcaaggactacttccacgcgtatgtctgagcgggctggcaaggcgcatagnnnnnnn

SEQ ID NO: 269866 - DNA, 420 bp, Homo sapiens
  misc_feature: GYAE6OF01CHE21.22.46.E02.1.454.CMB.1.raw
  modified_base (414)..(420): a, c, t, g, unknown or other
  misc_feature (414)..(420): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaaggcccatcggtcttccccctggcgccctgctccaggacgcacctccgagacgcacagcggccctgggctgcctggtcaaggctacttccacgcgtatgtctgagcgggctggcaaggcgcatagnnnnnnn

SEQ ID NO: 269867 - DNA, 422 bp, Homo sapiens
  misc_feature: GYAE6OF01AS7JZ.22.46.E02.1.454.CMB.1.raw
  modified_base (408)..(408): a, c, t, g, unknown or other
  misc_feature (408)..(408): n is a, c, g, or t
  modified_base (414)..(422): a, c, t, g, unknown or other
  misc_feature (414)..(422): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcgtcttccccctggcgccctgctccaggacgcacctccgagacgcacagcggccctgggctgcctggtcaaggactactccacgcgtatgtctgagcgggctggcagggcncatagnnnnnnnnn

SEQ ID NO: 269868 - DNA, 419 bp, Homo sapiens
  misc_feature: GYAE6OF01BPLT3.22.46.E02.1.454.CMB.1.raw
  modified_base (325)..(325): a, c, t, g, unknown or other
  misc_feature (325)..(325): n is a, c, g, or t
  modified_base (414)..(419): a, c, t, g, unknown or other
  misc_feature (414)..(419): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaaggcccatcggtcttccccctggcgccctgctcaggngcacctccgagagcacagccggcctgggctgcctggtcaaggactacttccacgcgtatgtctgagcgggctgggcaagggcgcatagnnnnnn

SEQ ID NO: 269869 - DNA, 412 bp, Homo sapiens
  misc_feature: GYAE6OF01DTM9I.22.46.E02.1.454.CMB.1.raw
  modified_base (405)..(412): a, c, t, g, unknown or other
  misc_feature (405)..(412): n is a, c, g, or t
tcagacatacgcgtcacgaccggtgctcgatttagactcatctacagggaaaggggctggagtggatttcatatattaacgatggagggaggacgaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaaggccatcggtcttccccctggcgccctgctccaggagcacctcgagagcacagcggcctgggctgcctggtcaaggctactcacgctatgtctgagcggctggcaaggcgcagtagnnnnnnnn

SEQ ID NO: 269870 - DNA, 419 bp, Homo sapiens
  misc_feature: GYAE6OF01AB5FD.22.46.E02.1.454.CMB.1.raw
  modified_base (410)..(419): a, c, t, g, unknown or other
  misc_feature (410)..(419): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttagcctccaccaggcccatcggtctccccctggcgccctgctccaggacgcacctccgagacgcacagccggccctgggctgcctggtcaaggctactccacgcgtatgtctgagcgggctggcaaggcgcatagnnnnnnnnnn

SEQ ID NO: 269871 - DNA, 410 bp, Homo sapiens
  misc_feature: GYAE6OF01C3J2K.22.46.E02.1.454.CMB.1.raw
  modified_base (405)..(410): a, c, t, g, unknown or other
  misc_feature (405)..(410): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaaggccatcggtcttcccctgcgccctgctccaggagcacctccgagacgcacagcgcctgggctgcctggtcaggctactcacgcgtatgtctgagcgggctggcaaggcgcatagnnnnnn

SEQ ID NO: 269872 - DNA, 506 bp, Homo sapiens
  misc_feature: GYAE6OF01DQX79.22.46.E02.1.454.CMB.1.raw
  modified_base (489)..(506): a, c, t, g, unknown or other
  misc_feature (489)..(506): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacaagtggtcaccgtctctttagccctccaccgaaggcccatcggtccttcccccgtggccgccctgcctcccgaggacgccaccctccgagacgcacgacggccggccccgtgggcctcggtcccgtgggtaccgaaacgggtaccttaaccgtttacccgaacggtccgttaattcggtcgtagggacggccggggtctacggggaccaaaggggccgacgtaataggnnnnnnnnnnnnnnnnnn

SEQ ID NO: 269873 - DNA, 419 bp, Homo sapiens
  misc_feature: GYAE6OF01E52AY.22.46.E02.1.454.CMB.1.raw
  modified_base (313)..(313): a, c, t, g, unknown or other
  misc_feature (313)..(313): n is a, c, g, or t
  modified_base (414)..(419): a, c, t, g, unknown or other
  misc_feature (414)..(419): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcgtcttcccctggccnccctgctccaggagcacctccgagagcacagccggccctgggctgcctggtcaaggactacttccacgcgtatgtctgagcgggctggcaaggcgcatagnnnnnn

SEQ ID NO: 269874 - DNA, 422 bp, Homo sapiens
  misc_feature: GYAE6OF01D272Y.22.46.E02.1.454.CMB.1.raw
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (415)..(422): a, c, t, g, unknown or other
  misc_feature (415)..(422): n is a, c, g, or t
tcagacatacgcgtcacgaccggtgctcgatttagactcatctacaggggaaggggctggagtggatttcatatattaacgatggagggagggacggaaaaggtacgcaaattctgtgaagggccgagtcaccatttccagagacaacgtccaggaactcagtgtatctgcaaatgaacagcctgacagcccgaaggacacggctgtctattactgtacgagagattggcaagcctgggcctttgatgtctggggcccctgggacaatggtcaccgtctctttagcctccaccaaggcccatcggtctcccctggcgccctgctccaggngcacctcganagcacagcggccctgggctgcctggtcaaggcctactcccagcgtatgtctgagcgggctggcaaggcgcatagnnnnnnnn

SEQ ID NO: 269875 - DNA, 523 bp, Homo sapiens
  misc_feature: GYAE6OF01CUQWG.22.46.E02.1.454.CMB.1.raw
  modified_base (502)..(523): a, c, t, g, unknown or other
  misc_feature (502)..(523): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctatactgtacgagagattggcaagccgtgggtccttgatgtcgtggggcctgggacaagtggtcaccgtctctttagccctccaccgaacggccctagtccggttcccttcccccgtggcccgtccctgccctacccgagggaccacccgacccgtccgaggacgccaaccgtaggcccggcccgtgggccgtcggtcccgttgggtaccgaaacgggtacccttaccgtttaccgaaccggtcgttagtcggtctcgggacggtcgggtcctgggaccgaagggcccgcgtaagtagnnnnnnnnnnnnnnnnnnnnnn

SEQ ID NO: 269876 - DNA, 419 bp, Homo sapiens
  misc_feature: GYAE6OF01B899N.22.46.E02.1.454.CMB.1.raw
  modified_base (410)..(419): a, c, t, g, unknown or other
  misc_feature (410)..(419): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtctccccctggccgccctgctccaggagcacctcgagagcacagcggccctgggctgcctggtcaaggctacttccacgcgtatgtctgagcggctggcaaggcgcatagnnnnnnnnnn

SEQ ID NO: 269877 - DNA, 420 bp, Homo sapiens
  misc_feature: GYAE6OF01BOTAV.22.46.E02.1.454.CMB.1.raw
  modified_base (326)..(326): a, c, t, g, unknown or other
  misc_feature (326)..(326): n is a, c, g, or t
  modified_base (414)..(420): a, c, t, g, unknown or other
  misc_feature (414)..(420): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggngcacctccgagagcacagcggccctgggctgcctggtcaaggactacttccacgcgtatgtctgagcgggctgggcaaggcgcatagnnnnnnn

SEQ ID NO: 269878 - DNA, 433 bp, Homo sapiens
  misc_feature: GYAE6OF01DZGFE.22.46.E02.1.454.CMB.1.raw
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
  modified_base (424)..(433): a, c, t, g, unknown or other
  misc_feature (424)..(433): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacaatggtcaccgtctctttagcctcaccaaggcccatcggtcttccccngcgcctgctccaggacgcacctccgagngaccacagccggtccctggggcctgccgtgggtcaaggactacttcccgagcgtatgtctggagcgggctagggcaaggcgcaatagnnnnnnnnnn

SEQ ID NO: 269879 - DNA, 498 bp, Homo sapiens
  misc_feature: GYAE6OF01BM183.22.46.E02.1.454.CMB.1.raw
  modified_base (456)..(456): a, c, t, g, unknown or other
  misc_feature (456)..(456): n is a, c, g, or t
  modified_base (458)..(461): a, c, t, g, unknown or other
  misc_feature (458)..(461): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (474)..(498): a, c, t, g, unknown or other
  misc_feature (474)..(498): n is a, c, g, or t
tcagacatacgcgtcacgaccggtgctcgattttagactcatctacaggggaaggggctggagtggatttcatatattaacgatggagggaggtacgaaaaggtacgcaaattctgtgaagggccgagtcaccagtttccagagacaacgccaggaactcagtgtatctgcaaatgaacagcctgacagccgaggacacggctgtctattactgtacgagtagtattggcaagcctagggcctttagatgtcgtggggcccctggggacaatggtacaccgtctctttacgcctccaccaagggcccatccggtcttcccccgtgggccgccccgtgcctccgaggagccacctccgagacgcacgacgcgccctgggctcgcctggccaaggactactccacgcgtatgtctggacgcgggctcgggtacaagggtccacgaattaagcagctcncnnnngngngngangngnnnnnnnnnnnnnnnnnnnnnnnnn

SEQ ID NO: 269880 - DNA, 427 bp, Homo sapiens
  misc_feature: GYAE6OF01CZCOP.22.46.E02.1.454.CMB.1.raw
  modified_base (418)..(427): a, c, t, g, unknown or other
  misc_feature (418)..(427): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatccggtcttccccctggccgccctgcctccgaggagccacctccgagacgcacagcggccctgggctgcctggtcaaggctacttccagagtatgtctgagcgggctggcaaggcgcatagnnnnnnnnnn

SEQ ID NO: 269881 - DNA, 449 bp, Homo sapiens
  misc_feature: GYAE6OF01BKTD4.22.46.E02.1.454.CMB.1.raw
  modified_base (398)..(398): a, c, t, g, unknown or other
  misc_feature (398)..(398): n is a, c, g, or t
  modified_base (430)..(449): a, c, t, g, unknown or other
  misc_feature (430)..(449): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggcctgggacaatggtcaccggtctctttagcctccaccaagggcccatcggtcttcccccgtggccgccctgcctccgaggacgccacctcccgagacgccacagccggccctggggcctggcctggtcaaggctacttccacgcgtangtctggacgcgggctgggcaaggcgcatacgnnnnnnnnnnnnnnnnnnnn

SEQ ID NO: 269882 - DNA, 474 bp, Homo sapiens
  misc_feature: GYAE6OF01C1APA.22.46.E02.1.454.CMB.1.raw
  modified_base (452)..(453): a, c, t, g, unknown or other
  misc_feature (452)..(453): n is a, c, g, or t
  modified_base (455)..(474): a, c, t, g, unknown or other
  misc_feature (455)..(474): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaacggcccagtccggtccttccccccgtggccgccctgcctcccgaggcgccacctccgagacgccaccaggccggcccgtggggcctcgcccgtggtccaaaggacctacctccgacgcgtatcgtctggacggcgggctagggacgaagggccgacaagtagnngnnnnnnnnnnnnnnnnnnnn

SEQ ID NO: 269883 - DNA, 497 bp, Homo sapiens
  misc_feature: GYAE6OF01ASRXF.22.46.E02.1.454.CMB.1.raw
  modified_base (480)..(497): a, c, t, g, unknown or other
  misc_feature (480)..(497): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttagcctccaccaagggcccatcggtccttccccctggccgccctgcctccgaggacgccaccgtccgagacgcacacggccggcccgtggggcctcggcccgttggtaccgaaacgggtaccttaacccgtttcccgaaccggtcgttaattcggttccgtggacggccggggtctcggggactaaaggggccacgtaagtaggnnnnnnnnnnnnnnnnnn

SEQ ID NO: 269884 - DNA, 402 bp, Homo sapiens
  misc_feature: GYAE6OF01DB0A7.22.46.E02.1.454.CMB.1.raw
  modified_base (304)..(304): a, c, t, g, unknown or other
  misc_feature (304)..(304): n is a, c, g, or t
  modified_base (307)..(308): a, c, t, g, unknown or other
  misc_feature (307)..(308): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (389)..(402): a, c, t, g, unknown or other
  misc_feature (389)..(402): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctatactgtacgagagattggcaagcctgggcctttgatgtctggggccctgggacaatggtcaccgtctcttagcctccacaaggccatcgtctcccctgcnccnncncagncnctcgangcacngcgcctggctgcctgcaagctctcacgcgtatgctgagcggctggacgaaggcgcagtacgnnnnnnnnnnnnnn

SEQ ID NO: 269885 - DNA, 601 bp, Homo sapiens
  misc_feature: GYAE6OF01BZT8Q.22.46.E02.1.454.CMB.1.raw
  modified_base (487)..(487): a, c, t, g, unknown or other
  misc_feature (487)..(487): n is a, c, g, or t
  modified_base (540)..(540): a, c, t, g, unknown or other
  misc_feature (540)..(540): n is a, c, g, or t
  modified_base (554)..(554): a, c, t, g, unknown or other
  misc_feature (554)..(554): n is a, c, g, or t
  modified_base (575)..(601): a, c, t, g, unknown or other
  misc_feature (575)..(601): n is a, c, g, or t
tcagacatacgcgtcacgaccggtgctcgatttagactcatctacagggaaggggctggagtggatttcatatattaacgatggaggggaggaacgaaaaggtacgactaaattctggtaggaacgggccgagtccacctacttccagagaacaacgccgaaggaactcagtgtatcgtgaacaaatacgaacacgtccgtagaacacggaccggaacggaaccgcggtcgttcgttacttaattacgtacggaacgagagtagttcggaacaacggtccggtcggttccttagtagttcggtcgggtccggggtccgtagggaaactaggttcggtacccgtaccggttcctttacgttacggcccctaccgaaaccggaaccgggtccctacggttccggttcccccttccccggcggccccgtccctcgccctaccggaaggccacccacccgtgggaacgccacgaccgcggcccggtccggngctcgtccggtagtaacgaacgtccttaccgtccgaacgtcgtagtcgtacgngggtacggcgggtncggaacgaacgtgactagcgnnnnnnnnnnnnnnnnnnnnnnnnnnn

SEQ ID NO: 269886 - DNA, 430 bp, Homo sapiens
  misc_feature: GYAE6OF01AISB1.22.46.E02.1.454.CMB.1.raw
  modified_base (327)..(327): a, c, t, g, unknown or other
  misc_feature (327)..(327): n is a, c, g, or t
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
  modified_base (420)..(430): a, c, t, g, unknown or other
  misc_feature (420)..(430): n is a, c, g, or t
tcagacatacgcgtcacgaccggtgctcgatttagactcatctacagggaaggggctggagtggatttcatatattaacgatggagggaggacgaaaaggtacacaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccacaagggcccatcggtcttccccctggccgccctgctccaggcncaccctccgagcgcaccagccggcccgtgggctgcccttggtccaaggcctacttccacgcgtatgtcngacgcggctggcacggcncatagnnnnnnnnnnn

SEQ ID NO: 269887 - DNA, 433 bp, Homo sapiens
  misc_feature: GYAE6OF01DVN26.22.46.E02.1.454.CMB.1.raw
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (410)..(433): a, c, t, g, unknown or other
  misc_feature (410)..(433): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttagcctccacaggccatcgtctcccngcncctgctcaggncacctcgagcgcacacgccggcccgtgggcctcgcctgggtacaaggcttacctccacgcgtatgtctgaggcgggctgggcaagggcgcagtagnnnnnnnnnnnnnnnnnnnnnnnn

SEQ ID NO: 269888 - DNA, 420 bp, Homo sapiens
  misc_feature: GYAE6OF01DB8Q4.22.46.E02.1.454.CMB.1.raw
  modified_base (406)..(420): a, c, t, g, unknown or other
  misc_feature (406)..(420): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctatactgtacgagagattggcaagcctgggcctttgatgtctggggcctgggacaatggtcaccgtctctttagcctcaccaggccatcggtctcccctggcgccctgctcaggagcacctccgagagcacagccggccctgggctgcctggtacaaggactacttccgagtatgtctgagcgggtctggacaaggcgcatagnnnnnnnnnnnnnnn

SEQ ID NO: 269889 - DNA, 457 bp, Homo sapiens
  misc_feature: GYAE6OF01AZPMD.22.46.E02.1.454.CMB.1.raw
  modified_base (443)..(457): a, c, t, g, unknown or other
  misc_feature (443)..(457): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacatggtcaccgtctctttagcctccaccaagggccccatccggtccttcccccgtggccgccctgcctcccaggacgccacctccgagacgcacgagccggccctgggcctggccttggtcgaacggaccttacttcccacgcgtatcggtctggacgcgggtctgggacgaaggtccacgatagnnnnnnnnnnnnnnn

SEQ ID NO: 269890 - DNA, 502 bp, Homo sapiens
  misc_feature: GYAE6OF01BJYZR.22.46.E02.1.454.CMB.1.raw
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (424)..(424): a, c, t, g, unknown or other
  misc_feature (424)..(424): n is a, c, g, or t
  modified_base (462)..(463): a, c, t, g, unknown or other
  misc_feature (462)..(463): n is a, c, g, or t
  modified_base (465)..(466): a, c, t, g, unknown or other
  misc_feature (465)..(466): n is a, c, g, or t
  modified_base (468)..(502): a, c, t, g, unknown or other
  misc_feature (468)..(502): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggacaagccgtggtcctttgagtgtcgtcggggccgtggacaatggtcacctctcttacgcctccaaccgacggcccatccggtcctcccccgnggcccgtcccgtcgcctccgnggacgccncccgtcgagcgacacgcgccggcccgtggctcgcctggactaacggacttaccgtccgaccgtcgtacgtgtcgtacggnggccccgggtgtgggtaaccgacggggctacgagtagnngnngnnnnnnnnnnnnnnnnnnnnnnnnnnnnnnnnnnn

SEQ ID NO: 269891 - DNA, 483 bp, Homo sapiens
  misc_feature: GYAE6OF01DZLYI.22.46.E02.1.454.CMB.1.raw
  modified_base (316)..(316): a, c, t, g, unknown or other
  misc_feature (316)..(316): n is a, c, g, or t
  modified_base (458)..(458): a, c, t, g, unknown or other
  misc_feature (458)..(458): n is a, c, g, or t
  modified_base (465)..(483): a, c, t, g, unknown or other
  misc_feature (465)..(483): n is a, c, g, or t
tcagacatacgcgtcacgaccggtgctcgatttagactcatctacagggaaggggctggagtggatttcatatattaacgatggagggaggacgaaaggtacgcaaattctgtgaagggccgagtcaccatttccagagacaacgccaggaactcagtgtatctgcaaatgaacagcctgacagccgaggacacggctgtctattactgtacgagagattggcaagccgtgggtcctttgatgtcgtggggccctgggacaatggtcaccgtctcttacgcctaccacgaacgggcccagtccggtccttcccccnggccgccctcgcctcccgaggacgccacccgtccgagacgaccgacacggtccggccccgtggggtcctcggcctagggtaccaaacggccttacctccgacgtacgtatgtcgtggacgccgggcgtcggacgaggccgtnaagtagnnnnnnnnnnnnnnnnnnn

SEQ ID NO: 269892 - DNA, 441 bp, Homo sapiens
  misc_feature: GYAE6OF01BV61G.22.46.E02.1.454.CMB.1.raw
  modified_base (427)..(427): a, c, t, g, unknown or other
  misc_feature (427)..(427): n is a, c, g, or t
  modified_base (434)..(441): a, c, t, g, unknown or other
  misc_feature (434)..(441): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacaatggtcaccgtctctttagcctccaccaggcccatcggtcttccccctggccgccctgcctccaggacgccacctccgagacgccacgacgccggcccgtggggctggcccgtggtcaacggtactacttccacgtccgtagtgtctggacgcgggctggcaggcncatacgnnnnnnnn

SEQ ID NO: 269893 - DNA, 488 bp, Homo sapiens
  misc_feature: GYAE6OF01EQV44.22.46.E02.1.454.CMB.1.raw
  modified_base (322)..(322): a, c, t, g, unknown or other
  misc_feature (322)..(322): n is a, c, g, or t
  modified_base (469)..(488): a, c, t, g, unknown or other
  misc_feature (469)..(488): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagccgtgggtcctttgatgtcgtggggcccctgggacaagtggtcaccgttctcttacgcctccaccgaagggcccatccggttcccttccccccgnggcccgtccctcgccgtccgaggcgccaccgtcccggagacgccgacgacggccggcccgtgggctcgccgtggtacgaaacggtacctaccgtccgacgtcgtatcgtacgtggacggcgggtctcgggacaagggcacagtagcnnnnnnnnnnnnnnnnnnnn

SEQ ID NO: 269894 - DNA, 500 bp, Homo sapiens
  misc_feature: GYAE6OF01BX3E0.22.46.E02.1.454.CMB.1.raw
  modified_base (480)..(500): a, c, t, g, unknown or other
  misc_feature (480)..(500): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagccgtgggtcctttgatgtcgtggggccctgggactaagtggtccaccgtcttcttacgcctaccaccgacggccctagtccggtcccttcccccgtggccgtccctcgcctccgaggcgccaccgtccgagcgacacgacgccggccgtgggcctcggtccgtggtacgaacggtaccttaccgttacccgacgtccgttacttcggtcgttggacggtccggggtcgtagggaccgaaggcgacagtacggnnnnnnnnnnnnnnnnnnnnn

SEQ ID NO: 269895 - DNA, 526 bp, Homo sapiens
  misc_feature: GYAE6OF01CDHUO.22.46.E02.1.454.CMB.1.raw
  modified_base (493)..(493): a, c, t, g, unknown or other
  misc_feature (493)..(493): n is a, c, g, or t
  modified_base (496)..(526): a, c, t, g, unknown or other
  misc_feature (496)..(526): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggtcctttgatgtcgtggggccctgggacaagtggtcaccgtcttctttagccctccaccaagggccccattccggtccttcccccgtggcccgcccctgccctccgacggacgccacctcccgagacgccacgacgccggccctggggcctcggcccgttgggtacaacgggaccttaccgttcccaccggtcgtattcggtcgtgggacggtcggggtccctggggaccgaaaggggtcccgacgtaataacgggcagncgnnnnnnnnnnnnnnnnnnnnnnnnnnnnnnn

SEQ ID NO: 269896 - DNA, 472 bp, Homo sapiens
  misc_feature: GYAE6OF01C4SL5.22.46.E02.1.454.CMB.1.raw
  modified_base (210)..(210): a, c, t, g, unknown or other
  misc_feature (210)..(210): n is a, c, g, or t
  modified_base (329)..(329): a, c, t, g, unknown or other
  misc_feature (329)..(329): n is a, c, g, or t
  modified_base (438)..(472): a, c, t, g, unknown or other
  misc_feature (438)..(472): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattacngtacgagagattggcaagcctgggtcctttgatgtctggggcctgggactaagtggtcaccgtctctttagcctcacaaggccatcggtcttcccccgtgccgccctgcctccgaggcnccaccgtccgagacgcacaggccggccgtgggctcgcctggtacaacggcctacgttccgacgcgtatcgtctggagcgggtactgggacgaacgggcacgagtagcgnnnnnnnnnnnnnnnnnnnnnnnnnnnnnnnnnnn

SEQ ID NO: 269897 - DNA, 530 bp, Homo sapiens
  misc_feature: GYAE6OF01A0FCM.22.46.E02.1.454.CMB.1.raw
  modified_base (272)..(272): a, c, t, g, unknown or other
  misc_feature (272)..(272): n is a, c, g, or t
  modified_base (491)..(491): a, c, t, g, unknown or other
  misc_feature (491)..(491): n is a, c, g, or t
  modified_base (495)..(530): a, c, t, g, unknown or other
  misc_feature (495)..(530): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctggggcctttgatgtcgtggggccctgggacatggtcaccgtntctttacgcctccaccgaacgggcccctagtcggtcccttccccctggccgcccctgcctccgaggacgccacctccgacgacgcacgagccgggcccctggggtcctacggcccgtggtaccaaaacggtaccgttaccgtttccccgaacggcggtttacttcggtcctgggaacggtccggggtccttggggaccgaagggcccgagacgtaagcngacnnnnnnnnnnnnnnnnnnnnnnnnnnnnnnnnnnnn

SEQ ID NO: 269898 - DNA, 398 bp, Homo sapiens
  misc_feature: GYAE6OF01EHX6O.22.46.E02.1.454.CMB.1.raw
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (336)..(337): a, c, t, g, unknown or other
  misc_feature (336)..(337): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
  modified_base (389)..(398): a, c, t, g, unknown or other
  misc_feature (389)..(398): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggacatgtcaccgtntcttagcctcacaggccatcgtctccccngcgcctgctcngcncnccncgagncacngcgccnggcnncgtgcagtctctccacgtctntgtntgagccggtncggacgacggcgnatgnnnnnnnnnn

SEQ ID NO: 269899 - DNA, 602 bp, Homo sapiens
  misc_feature: GYAE6OF01BXAQS.22.46.E02.1.454.CMB.1.raw
  modified_base (564)..(571): a, c, t, g, unknown or other
  misc_feature (564)..(571): n is a, c, g, or t
  modified_base (573)..(573): a, c, t, g, unknown or other
  misc_feature (573)..(573): n is a, c, g, or t
  modified_base (575)..(602): a, c, t, g, unknown or other
  misc_feature (575)..(602): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgacaaatgaacagcctgacagccgaggacacggctgtctattactggtaacgagagagttcggacaagtccgtgggtcctttggacgttggttcgtcggggccgtagggacaagttcggtactaccgttctctttacgcctaccgaaccgaacggccctaccgttccggttcccttcccccggtcggacccgtcccgtcgtcctaccgacggacacccgtacccgtccgaacgtacgacaccgacggtcccggccccgtggggccgtccggtaccgttcggtaacgaaaccggtaccttacccgtttacccgaccgggttaacgttacgttcgtcggtacggtaacgggccgggtacggtcgggtaacggacgggcgtaacgtacgttacggatcgacnnnnnnnngngnnnnnnnnnnnnnnnnnnnnnnnnnnnn

SEQ ID NO: 269900 - DNA, 563 bp, Homo sapiens
  misc_feature: GYAE6OF01DXFCV.22.46.E02.1.454.CMB.1.raw
  modified_base (523)..(523): a, c, t, g, unknown or other
  misc_feature (523)..(523): n is a, c, g, or t
  modified_base (526)..(530): a, c, t, g, unknown or other
  misc_feature (526)..(530): n is a, c, g, or t
  modified_base (532)..(563): a, c, t, g, unknown or other
  misc_feature (532)..(563): n is a, c, g, or t
tcagacatacgcgtcacgaccggtgctcgatttagactcatctacagggaaggggctggagtggatttcatatattaaacgatggagggaggaacgaaaaggtacgcaaattctgtgaagggccagtcaccatttccagagacaacgccaggaactcagtgtatctgacaaatgaacagcctgacagccgaggcacggctgtctattactgtaacgagagattcggacaacgccgtggtcctttgattcgtcgtcggggccctgggactaagtcggtaccaccgttcttcctttacgccctacctaaccggacggccacgttccggttcccttccccgtttcggccgtcccctgtccgtccgaggacgccacccgttaccggaagacgacctacgaccggtacccggccgtgggtcctcggtcccgtagggtaccgaacgggtaccttactcccgacggtcgttaacgttgtccggtaggacgggtccggggtcgtacgggacaaaggggtccgaatactagngannnnncnnnnnnnnnnnnnnnnnnnnnnnnnnnnnnnn

SEQ ID NO: 269901 - DNA, 579 bp, Homo sapiens
  misc_feature: GYAE6OF01CK746.22.46.E02.1.454.CMB.1.raw
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (543)..(547): a, c, t, g, unknown or other
  misc_feature (543)..(547): n is a, c, g, or t
  modified_base (550)..(559): a, c, t, g, unknown or other
  misc_feature (550)..(559): n is a, c, g, or t
  modified_base (561)..(571): a, c, t, g, unknown or other
  misc_feature (561)..(571): n is a, c, g, or t
  modified_base (573)..(579): a, c, t, g, unknown or other
  misc_feature (573)..(579): n is a, c, g, or t
tcagacatacgcgtcacgaccggtgctcgatttagactcatctacagggaaggggcctggagtggatttcatatattaacgatggagggaggacgaaaaggtacgcaaattctgtgaagggccgagtcaccatttccagagacaaccgccaggaactcaagtgtatctgacaaatgaacgacgcctgacagccgaaggacacggctgtctattactgtacgaagagtattaggcaacgccgtgggtcctttagacgttggtccgtcggggccgtaggggactagtcggtactaccgttcttcttacgcctaccgaccgacggcctacgttccgtcctccccgtcggcccgtcccgtaccgcccgtaccgacggaccgtcccacccgtaccgacgacgacgaccggaccggtccggtcccggcggtcctcggtccgtacgtaaccggtaacgtaccttaccgtaccgaaccgtacggttacgtcggtacgtacggtacggtccgggtcggacgggacgacgggcgacgacgtagcacgnacngnnnnnacnnnnnnnnnngnnnnnnnnnnncnnnnnnn

SEQ ID NO: 269902 - DNA, 488 bp, Homo sapiens
  misc_feature: GYAE6OF01BFIT3.22.46.E02.1.454.CMB.1.raw
  modified_base (284)..(284): a, c, t, g, unknown or other
  misc_feature (284)..(284): n is a, c, g, or t
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (451)..(451): a, c, t, g, unknown or other
  misc_feature (451)..(451): n is a, c, g, or t
  modified_base (454)..(488): a, c, t, g, unknown or other
  misc_feature (454)..(488): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagtagttgacaagccgtgggccttttgatgtcgtggggccctgggacaagtgtcacgtctcgttacncctccacgagggccctagtcgttcctccccgcgccgtcctcnccncgaggacnccacccgtcgacgcgacacacggccgcccgtggctcgccgtggacaacgtactaccttaccgacgtcgttagtcgtacgtggccggtacgggctggacgaaacggcacgatagntcnnnnnnnnnnnnnnnnnnnnnnnnnnnnnnnnnnn

SEQ ID NO: 269903 - DNA, 518 bp, Homo sapiens
  misc_feature: GYAE6OF01E5DLH.22.46.E02.1.454.CMB.1.raw
  modified_base (339)..(339): a, c, t, g, unknown or other
  misc_feature (339)..(339): n is a, c, g, or t
  modified_base (477)..(477): a, c, t, g, unknown or other
  misc_feature (477)..(477): n is a, c, g, or t
  modified_base (486)..(518): a, c, t, g, unknown or other
  misc_feature (486)..(518): n is a, c, g, or t
tcagacatacgcgtcacgaccggtgctcgatttagactcatctacagggaagggggctggagtggatttcatatattaacgatggagggaggacgaaaaaggtacgcaaattctgtgaagggccgagtcaccatttccagagacaacgccaggaactcagtgtatctgacaaatgaacagcctgacagccgaggacacgctgtctattactgtacgagagagttggacaagccgtgggtcctttgactgtcgtcggggcctgggacaagtcggtcctaccgttcttctttacgccctaccgaaccgaacgggccctacgtcccggttcccttcccccgngggccctcccgtcgcctaccggacggacgcctaccgtcccggaagacgccacgacggccggcctgggctcgtaccgtgtaccgagtacctactaccgacgtcgtatcgtctgggacggcggtactcgggaccgaggcncgtagtcgnnnnnnnnnnnnnnnnnnnnnnnnnnnnnnnnn

SEQ ID NO: 269904 - DNA, 724 bp, Homo sapiens
  misc_feature: GYAE6OF01CTSDD.22.46.E02.1.454.CMB.1.raw
  modified_base (203)..(203): a, c, t, g, unknown or other
  misc_feature (203)..(203): n is a, c, g, or t
  modified_base (569)..(569): a, c, t, g, unknown or other
  misc_feature (569)..(569): n is a, c, g, or t
  modified_base (608)..(608): a, c, t, g, unknown or other
  misc_feature (608)..(608): n is a, c, g, or t
  modified_base (646)..(646): a, c, t, g, unknown or other
  misc_feature (646)..(646): n is a, c, g, or t
  modified_base (656)..(656): a, c, t, g, unknown or other
  misc_feature (656)..(656): n is a, c, g, or t
  modified_base (661)..(661): a, c, t, g, unknown or other
  misc_feature (661)..(661): n is a, c, g, or t
  modified_base (668)..(668): a, c, t, g, unknown or other
  misc_feature (668)..(668): n is a, c, g, or t
  modified_base (672)..(672): a, c, t, g, unknown or other
  misc_feature (672)..(672): n is a, c, g, or t
  modified_base (675)..(675): a, c, t, g, unknown or other
  misc_feature (675)..(675): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
  modified_base (683)..(685): a, c, t, g, unknown or other
  misc_feature (683)..(685): n is a, c, g, or t
  modified_base (688)..(688): a, c, t, g, unknown or other
  misc_feature (688)..(688): n is a, c, g, or t
  modified_base (692)..(692): a, c, t, g, unknown or other
  misc_feature (692)..(692): n is a, c, g, or t
  modified_base (697)..(698): a, c, t, g, unknown or other
  misc_feature (697)..(698): n is a, c, g, or t
  modified_base (706)..(709): a, c, t, g, unknown or other
  misc_feature (706)..(709): n is a, c, g, or t
  modified_base (722)..(724): a, c, t, g, unknown or other
  misc_feature (722)..(724): n is a, c, g, or t
tcagacatacgcgtcacgaccggtgctcgatttagactcatctacaggggaaaggggctggagtggatttcatatattaacgatggagggaggaacgaaaaggtacgctaaattctgtaggaagggtcgagtccacctactttccagagaccaacgccaaggaacctctagtagtactctagactaaatcggaacacgtaccngaccgacggacccggaaggccacggtctggtaccttagttacgtacggtaacgagtaagtagtttacggaaccgtaacggtcccgtttacgggttcgtttacggaacgtttcgggttccgggtccggggaccggttacgggtaactaaacgggttccggtacccgtttacccgtacgtttaccgttacccgtaccccgtaccgaaaccccgggtaaccggtcccgtaaccgtttccccggtttacccccgttcccccggacgtcccggtcccgtacgtccccgtacggtaccggactacccgtacccgacgtacgacgaccgtaccgacgggcccgtcccgtagggtcacggtacctaccgggtanaacccggttacccttcgacccgtagtaaccttggtaccncggtgggaaccggtggtccggaagtacggacgtcgtanacgtagcctnaccgnatgactnacgntcncagntntnnnacngacnacgannacgtcgannnnagctcgacatcgnnn

SEQ ID NO: 269905 - DNA, 416 bp, Homo sapiens
  misc_feature: GYAE6OF02IMYJZ.22.46.E02.1.454.CMB.1.raw
  modified_base (410)..(416): a, c, t, g, unknown or other
  misc_feature (410)..(416): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgcctgctccaggagcacctccgagagcacagcggcctgggctgcctggtcaaggactacttccacgcgtatgtctgagcgggctggcaggcgcatagnnnnnnn

SEQ ID NO: 269906 - DNA, 418 bp, Homo sapiens
  misc_feature: GYAE6OF02FSLAX.22.46.E02.1.454.CMB.1.raw
  modified_base (412)..(418): a, c, t, g, unknown or other
  misc_feature (412)..(418): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttcccctggcgccctgctccaggagcacctccgagagcacagcggccctgggctgcctggtcaaggctacttccacgcgtatgtctgagcgggctgggcaaggcgcatagnnnnnnn

SEQ ID NO: 269907 - DNA, 418 bp, Homo sapiens
  misc_feature: GYAE6OF02FRBIG.22.46.E02.1.454.CMB.1.raw
  modified_base (413)..(418): a, c, t, g, unknown or other
  misc_feature (413)..(418): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggactacttccacgcgtatgtctgagcgggctggcaaggcgcatagnnnnnn

SEQ ID NO: 269908 - DNA, 417 bp, Homo sapiens
  misc_feature: GYAE6OF02GFYDJ.22.46.E02.1.454.CMB.1.raw
  modified_base (412)..(417): a, c, t, g, unknown or other
  misc_feature (412)..(417): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggctacttccacgcgtatgtctgagcgggctggcaaggcgcatagnnnnnn

SEQ ID NO: 269909 - DNA, 419 bp, Homo sapiens
  misc_feature: GYAE6OF02HLRKV.22.46.E02.1.454.CMB.1.raw
  modified_base (411)..(419): a, c, t, g, unknown or other
  misc_feature (411)..(419): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccacaaggcccatcggtcttcccctggcgccctgctccaggagcacctccgagagcacagcggccctgggctgcctggtcaaggactacttccacgcgtatgtctgagcgggctggcaaggcgcatagnnnnnnnnn

SEQ ID NO: 269910 - DNA, 484 bp, Homo sapiens
  misc_feature: GYAE6OF02JF4RM.22.46.E02.1.454.CMB.1.raw
  modified_base (270)..(270): a, c, t, g, unknown or other
  misc_feature (270)..(270): n is a, c, g, or t
  modified_base (455)..(456): a, c, t, g, unknown or other
  misc_feature (455)..(456): n is a, c, g, or t
  modified_base (458)..(484): a, c, t, g, unknown or other
  misc_feature (458)..(484): n is a, c, g, or t
tcagacatacgcgtcacgaccggtgctcgatttagactcatctacagggaaggggcgtggagtggatttcatatattaacgatggagggaggacgaaaaggtacgcaaattctgtgaaggccgagtcaccatttccagagacaacgccaggaactcagtgtatctgcaaatgaacagcctgacagccgaggacacggctgtctattactgtacgagagattggcaagcctgggcctttgatgtctggggccctggacaatggtcacgtcntttagcctccacaagggcccatccggtcttccccctggccgcccctcgactcccaggacgcaacctcccgagacgccacagtccggccctggggctggccctggtccaaagggacttaccgttccaccggcgttaactcgtccttggacgcgggtcctgggacccaaagggccgacgattacggnngnnnnnnnnnnnnnnnnnnnnnnnnnnn

SEQ ID NO: 269911 - DNA, 419 bp, Homo sapiens
  misc_feature: GYAE6OF02FI0MV.22.46.E02.1.454.CMB.1.raw
  modified_base (414)..(419): a, c, t, g, unknown or other
  misc_feature (414)..(419): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagccccgggcctttgatgtctggggccctgggacaatggtcaccgtctctttagcctccaccaagggcccatcggtcttccccctggcgccctgctccaggagcacctccgagagcacagcggccctgggctgcctggtcaaggctacttccacgcgtatgtctgagcgggctggcaaggcgcatagnnnnnn

SEQ ID NO: 269912 - DNA, 423 bp, Homo sapiens
  misc_feature: GYAE6OF02G7G01.22.46.E02.1.454.CMB.1.raw
  modified_base (414)..(423): a, c, t, g, unknown or other
  misc_feature (414)..(423): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccagggcccatcggtcttccccctggccgccctgctccaggacgcacctccgagagcacagcggccctgggctgcctggtcaaggctacttccacgcgtatgtctgagcgggctgggcaggcgcatagnnnnnnnnnn

SEQ ID NO: 269913 - DNA, 422 bp, Homo sapiens
  misc_feature: GYAE6OF02GGX9P.22.46.E02.1.454.CMB.1.raw
  modified_base (414)..(422): a, c, t, g, unknown or other
  misc_feature (414)..(422): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcacgtctctttagcctccaccaagggcccatcggtcttcccctggcgccctgctccaggacgcacctccgagagcacagcggccctgggcctgcctggtcaaggactacttccacgcgtatgtctgagcgggctggcaaggcgcatagnnnnnnnnn

SEQ ID NO: 269914 - DNA, 419 bp, Homo sapiens
  misc_feature: GYAE6OF02HNFE8.22.46.E02.1.454.CMB.1.raw
  modified_base (411)..(419): a, c, t, g, unknown or other
  misc_feature (411)..(419): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggcgcacctcgagagcacagcggccctgggctgcctggcaaggactactccacgcgtatgtctgagcgggctggcaaggcgcatagnnnnnnnnn

SEQ ID NO: 269915 - DNA, 425 bp, Homo sapiens
  misc_feature: GYAE6OF02JX4ED.22.46.E02.1.454.CMB.1.raw
  modified_base (414)..(425): a, c, t, g, unknown or other
  misc_feature (414)..(425): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacatggtcaccgtctctttagcctccaccagggccatcggtctcccctggccgccctgcctccaggacgccacctccgagacgcacacgccggcccgtgggcctgcctggtcaaggctactccacgcgtatgtctgagcggctggcaggcgcatagnnnnnnnnnnnn

SEQ ID NO: 269916 - DNA, 421 bp, Homo sapiens
  misc_feature: GYAE6OF02GIDPZ.22.46.E02.1.454.CMB.1.raw
  modified_base (413)..(421): a, c, t, g, unknown or other
  misc_feature (413)..(421): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttcccctggcgccctgctccaggagcacctccgagagcacagcggccctgggctgcctggtcaaggctacttccacgcgtatgtctgagcgggctgggcaaggcgcatagnnnnnnnnn

SEQ ID NO: 269917 - DNA, 419 bp, Homo sapiens
  misc_feature: GYAE6OF02I0P0R.22.46.E02.1.454.CMB.1.raw
  modified_base (414)..(419): a, c, t, g, unknown or other
  misc_feature (414)..(419): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagactgacagccgaggacacggctgtctattactgtacgagagattggcaagcctgggcctttgatgtctggggccctgggacaatggtcaccgtctctttagcctccaccgaaggcccatcggtcttccccctggcgccctgcctccaggagcacctccgagacgcacagcggccctgggctgcctggtcaaggctacttccacgcgtatgtctgagcgggctggcaaggcgcatagnnnnnn

SEQ ID NO: 269918 - DNA, 422 bp, Homo sapiens
  misc_feature: GYAE6OF02G23ZS.22.46.E02.1.454.CMB.1.raw
  modified_base (413)..(422): a, c, t, g, unknown or other
  misc_feature (413)..(422): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgcccctgctccaggacgcacctccgagagcacagcggccctgggctgcctggtcaaggctacttccacgcttgtctgagcgggctggcaaggcgcatagnnnnnnnnnn

SEQ ID NO: 269919 - DNA, 449 bp, Homo sapiens
  misc_feature: GYAE6OF02ITATL.22.46.E02.1.454.CMB.1.raw
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (406)..(406): a, c, t, g, unknown or other
  misc_feature (406)..(406): n is a, c, g, or t
  modified_base (436)..(449): a, c, t, g, unknown or other
  misc_feature (436)..(449): n is a, c, g, or t
tcagacatacgcgtcacgaccggtgctcgatttagactcatctacagggaaagggcgtggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctagggacaatggtcaccgtctctttacgccttccacgaacggcccagtcggtccttcccccgtggccgtccctgcctccaggacnccgacctcganacgcacacgcggccctgggctcgcctggtcaacggctacctccacgcgtatcgtcnggagccgggctggccgaaggcgcagtacgnnnnnnnnnnnnnn

SEQ ID NO: 269920 - DNA, 424 bp, Homo sapiens
  misc_feature: GYAE6OF02IU042.22.46.E02.1.454.CMB.1.raw
  modified_base (327)..(327): a, c, t, g, unknown or other
  misc_feature (327)..(327): n is a, c, g, or t
  modified_base (408)..(408): a, c, t, g, unknown or other
  misc_feature (408)..(408): n is a, c, g, or t
  modified_base (414)..(424): a, c, t, g, unknown or other
  misc_feature (414)..(424): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaaggcccatcggtcttcccctggcgccctgcctccaggacncacctccgagagcacagcggccctgggctgcctggtcaaggactacttccacgcgtatcgtctgagcgggctggcaaggcncatagnnnnnnnnnnn

SEQ ID NO: 269921 - DNA, 425 bp, Homo sapiens
  misc_feature: GYAE6OF02G7HFK.22.46.E02.1.454.CMB.1.raw
  modified_base (411)..(411): a, c, t, g, unknown or other
  misc_feature (411)..(411): n is a, c, g, or t
  modified_base (417)..(425): a, c, t, g, unknown or other
  misc_feature (417)..(425): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaggcccatcggtcttcccctggcgccctgctccaggcgccacctccgagacgcacagccggccctggggcctgcctggtcaaggacctacttccacgcgtatgtctgagcgggctggcaaggcgnagtagnnnnnnnnn

SEQ ID NO: 269922 - DNA, 415 bp, Homo sapiens
  misc_feature: GYAE6OF02F0CJ8.22.46.E02.1.454.CMB.1.raw
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
  modified_base (389)..(389): a, c, t, g, unknown or other
  misc_feature (389)..(389): n is a, c, g, or t
  modified_base (405)..(405): a, c, t, g, unknown or other
  misc_feature (405)..(405): n is a, c, g, or t
  modified_base (410)..(415): a, c, t, g, unknown or other
  misc_feature (410)..(415): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcnccctgctccaggngccacctccgagagcacagcggccctgggctgcctggtcaaggctactccacgcgtatgtcngagcggctggcaggcnatagnnnnnn

SEQ ID NO: 269923 - DNA, 434 bp, Homo sapiens
  misc_feature: GYAE6OF02IP26A.22.46.E02.1.454.CMB.1.raw
  modified_base (311)..(311): a, c, t, g, unknown or other
  misc_feature (311)..(311): n is a, c, g, or t
  modified_base (417)..(417): a, c, t, g, unknown or other
  misc_feature (417)..(417): n is a, c, g, or t
  modified_base (424)..(434): a, c, t, g, unknown or other
  misc_feature (424)..(434): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggcccctgggacaatggtcaccgtctctttagcctccaccaagggcccatcggtcttcccccnggcgccctgcctccaggcgccacctccgagacgcacagccggccctggggctgcctggtcaaggactacttccacgcgtagtgtctgacgcgggctggcgaaggcncagtagnnnnnnnnnnn

SEQ ID NO: 269924 - DNA, 495 bp, Homo sapiens
  misc_feature: GYAE6OF02ICX36.22.46.E02.1.454.CMB.1.raw
  modified_base (222)..(222): a, c, t, g, unknown or other
  misc_feature (222)..(222): n is a, c, g, or t
  modified_base (468)..(468): a, c, t, g, unknown or other
  misc_feature (468)..(468): n is a, c, g, or t
  modified_base (470)..(495): a, c, t, g, unknown or other
  misc_feature (470)..(495): n is a, c, g, or t
tcagacatacgcgtcacgaccggtgctcgatttagactcatctacagggaaaggggcctgggacgtggatttcactatattaaccgatggagggaggacgaaaaggtacgcgaaattctgtgaagggccgagtcaccatttccagagacaacgccaggaactcagtgtatctgcaaatgaacagcctgacagccgaggacacggctgtctattactgtacgngagattggcaagcctgggcctttgatgtctggggccctgggacaatggtcaccgtctcttttagcctccacaacggcctatcggtcttcccctgccgcccttgccttccgaggacgtcacctccgagacgaccacagccggccctcgggggccttcggaccttggccctaaagggacccttaccgttacccaccggtcgtattcgtcctggtacgcggggctgggacgtaacgggcgactataagngnnnnnnnnnnnnnnnnnnnnnnnnnn

SEQ ID NO: 269925 - DNA, 499 bp, Homo sapiens
  misc_feature: GYAE6OF02HZWBE.22.46.E02.1.454.CMB.1.raw
  modified_base (273)..(273): a, c, t, g, unknown or other
  misc_feature (273)..(273): n is a, c, g, or t
  modified_base (312)..(312): a, c, t, g, unknown or other
  misc_feature (312)..(312): n is a, c, g, or t
  modified_base (327)..(327): a, c, t, g, unknown or other
  misc_feature (327)..(327): n is a, c, g, or t
  modified_base (476)..(499): a, c, t, g, unknown or other
  misc_feature (476)..(499): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaagtggtcaccgtntctttagcctccaccaagggccatcgtcttccccctgcnccctgctccaggacnccacctcccgagacgccacgacggccggaccccgtggggcctcgcccttcgggtccgaaacggtaccttaccgttcccgaaccgccggttactcggttactcggtaacggccggggtccttgggccgaaagggccgacgaacgtacggnnnnnnnnnnnnnnnnnnnnnnnn

SEQ ID NO: 269926 - DNA, 440 bp, Homo sapiens
  misc_feature: GYAE6OF02G1XEL.22.46.E02.1.454.CMB.1.raw
  modified_base (271)..(271): a, c, t, g, unknown or other
  misc_feature (271)..(271): n is a, c, g, or t
  modified_base (426)..(440): a, c, t, g, unknown or other
  misc_feature (426)..(440): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtntctttagcctccaccaagggcccatccggtcttccccctggccgccctgcctccaggcgcacctccgagacgcacagccggccctgggctgccgtggtacaaggactactcccgacgtcgtatgtctgacggcggtctggacaaggcgcagtagnnnnnnnnnnnnnnn

SEQ ID NO: 269927 - DNA, 450 bp, Homo sapiens
  misc_feature: GYAE6OF02IHLED.22.46.E02.1.454.CMB.1.raw
  modified_base (314)..(314): a, c, t, g, unknown or other
  misc_feature (314)..(314): n is a, c, g, or t
  modified_base (436)..(450): a, c, t, g, unknown or other
  misc_feature (436)..(450): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattgggcaagccgtgggcctttgatggtctggggccctgggacaatggtcaccgtctctttagcctccaccaagggcccactcggtcttcccccnggccgccctgcctccaggcgcacctccgagacgcacacgcggccctggggctgccgtggtcaacggactacttccgacgtcgtatgtctggacggcgggtctcgggcgaaggcgacagtagnnnnnnnnnnnnnnn

SEQ ID NO: 269928 - DNA, 417 bp, Homo sapiens
  misc_feature: GYAE6OF02GBZ7H.22.46.E02.1.454.CMB.1.raw
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (411)..(417): a, c, t, g, unknown or other
  misc_feature (411)..(417): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccagggcccatcgtcttccccnggcgccctgctccaggancacctccgagagcacagcggccctgggctgcctggtcaaggactacttccacgcgtatgtctgagcgggctggcaaggcgcatagnnnnnnn

SEQ ID NO: 269929 - DNA, 510 bp, Homo sapiens
  misc_feature: GYAE6OF02FM9ZK.22.46.E02.1.454.CMB.1.raw
  modified_base (468)..(468): a, c, t, g, unknown or other
  misc_feature (468)..(468): n is a, c, g, or t
  modified_base (471)..(472): a, c, t, g, unknown or other
  misc_feature (471)..(472): n is a, c, g, or t
  modified_base (474)..(477): a, c, t, g, unknown or other
  misc_feature (474)..(477): n is a, c, g, or t
  modified_base (479)..(510): a, c, t, g, unknown or other
  misc_feature (479)..(510): n is a, c, g, or t
tcagacatacgcgtcacgaccggtgctcgatttagactcatctacaggggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggccttgatgtctggggccctgggacaatggtcaccggtctcttagccctccaccaagggcccatcggtccttccccctggccgccctgcctccgaggacgccgaccctccggacgacgccacgacggccggcccgtggggcctcggcccgttgggtaccgaacggtaccttacccttcccgacgtccgtattcgtctggacggtccggggctgggcgaagggccgacagttagngcnncnnnncnnnnnnnnnnnnnnnnnnnnnnnnnnnnnnnn

SEQ ID NO: 269930 - DNA, 534 bp, Homo sapiens
  misc_feature: GYAE6OF02IMS82.22.46.E02.1.454.CMB.1.raw
  modified_base (332)..(332): a, c, t, g, unknown or other
  misc_feature (332)..(332): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (500)..(503): a, c, t, g, unknown or other
  misc_feature (500)..(503): n is a, c, g, or t
  modified_base (505)..(505): a, c, t, g, unknown or other
  misc_feature (505)..(505): n is a, c, g, or t
  modified_base (507)..(534): a, c, t, g, unknown or other
  misc_feature (507)..(534): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacaatggtcaccgtctctttagcctccaccaaggcccatccggtcttccccctggccgcccctgcctccacggnccacctccgagacgccacacggccggcccgtgggcctcggtcccgtgggtaccaaacgggaccttaccgttacccgaccggtaccgttaacgttcggttccgtgggacgggtcccggggtcgttcggggaccgaaacggggccggtaccaagttaacggncgngcngnnnngngnnnnnnnnnnnnnnnnnnnnnnnnnnnn

SEQ ID NO: 269931 - DNA, 410 bp, Homo sapiens
  misc_feature: GYAE6OF02I0ABC.22.46.E02.1.454.CMB.1.raw
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (331)..(331): a, c, t, g, unknown or other
  misc_feature (331)..(331): n is a, c, g, or t
  modified_base (398)..(398): a, c, t, g, unknown or other
  misc_feature (398)..(398): n is a, c, g, or t
  modified_base (404)..(410): a, c, t, g, unknown or other
  misc_feature (404)..(410): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaggccatcgtctccccnggcncctgctcaggngcacctccgagngcacagccggcctggctgcctggtcaaggctactccacgcgtatcgtctgacgcgggctggcaggcncatagnnnnnnn

SEQ ID NO: 269932 - DNA, 493 bp, Homo sapiens
  misc_feature: GYAE6OF02G9ZW1.22.46.E02.1.454.CMB.1.raw
  modified_base (322)..(322): a, c, t, g, unknown or other
  misc_feature (322)..(322): n is a, c, g, or t
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
  modified_base (466)..(493): a, c, t, g, unknown or other
  misc_feature (466)..(493): n is a, c, g, or t
tcagacatacgcgtcacgaccggtgctcgatttagactcatctacagggaaagggggctggagtggatttcatatattaacgatggagggaggacgaaaaggtacgcaaattctgtgaagggccgagtcaccatttccagagacaacgccaggaactcagtgtatctgacaaatgaacagcctgacagccgaggacacggctgtctattactgtacgagagtattggcaagccgtgggtcctttgattggtcgtcggggcctgggacaagtggtcaccgtctctttagcctccaccgaaggcccagtccggtccttccccgnggccgcccctgcctccgaggacnccacctcgagcgcacgacggccgcccgngggctcgccgtaggacgaacggtcctactcccgacgcgttactcgtcgtggacggcggggtctacgggacgaacgggcgtagaacgtagctgnnnnnnnnnnnnnnnnnnnnnnnnnnnn

SEQ ID NO: 269933 - DNA, 479 bp, Homo sapiens
  misc_feature: GYAE6OF02IKJ9A.22.46.E02.1.454.CMB.1.raw
  modified_base (326)..(326): a, c, t, g, unknown or other
  misc_feature (326)..(326): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
  modified_base (447)..(479): a, c, t, g, unknown or other
  misc_feature (447)..(479): n is a, c, g, or t
tcagacatacgcgtcacgaccggtgctcgatttagactcatctacagggaaaggggctggagtggatttcatatattaacgatggagggaggacgaaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacaatggtcaccgtctcttagcctcaccagggccatcggtcttccccctggccgccctgctccaggnccacctccgagacgcacagccggcccgtgggctcgccgtggtcaacggtaccttacttacccacgtcgtatcgtctggacggcgggctgggacgtaacgggcgtcaagtacgntgangacnnnnnnnnnnnnnnnnnnnnnnnnnnnnnnnnn

SEQ ID NO: 269934 - DNA, 488 bp, Homo sapiens
  misc_feature: GYAE6OF02I0YT8.22.46.E02.1.454.CMB.1.raw
  modified_base (444)..(444): a, c, t, g, unknown or other
  misc_feature (444)..(444): n is a, c, g, or t
  modified_base (467)..(488): a, c, t, g, unknown or other
  misc_feature (467)..(488): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggacaagtgtcaccgtctctttagcctccaccaagggcccatccggttccttcccccgtcggccgtccctcgcctccgaggcgccaccctcccggacgacgcacgacgccggcccgtggggcctcggcccttgggtaccaaacggaccttaccttcccgaccgtccgttatcgttctggacggtccgggntcgggacgaaggccgacagtagnnnnnnnnnnnnnnnnnnnnnn

SEQ ID NO: 269935 - DNA, 529 bp, Homo sapiens
  misc_feature: GYAE6OF02ICNCV.22.46.E02.1.454.CMB.1.raw
  modified_base (273)..(273): a, c, t, g, unknown or other
  misc_feature (273)..(273): n is a, c, g, or t
  modified_base (330)..(330): a, c, t, g, unknown or other
  misc_feature (330)..(330): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (494)..(529): a, c, t, g, unknown or other
  misc_feature (494)..(529): n is a, c, g, or t
tcagacatacgcgtcacgaccggtgctcgatttagactcatctacagggaaggggctggagtggatttcatatattaacgatggagggaggacgaaaaggtacacaaattctgtgaagggccgagtcaccatttccagagacaacgccaggaactcagtgtatctgcaaatgaacagcctgacagccgaggacacggctgtctattactgtacgagagattggacaagcctgggcctttgatgtctgggccctgggacaagtggtcaccgttntctttagcctccacaagggcccatccggtcttccccctggccgccctgctccagganccacctccgagacgcacgacgccggcccgtgggcttacggccgtcggtacaaacggtaccttaccgtttcccaaccggtccgttaagttacggtttccttaggaacgggtccggggcgtttacggggacgaaacggggccgtaccgtaagttaggcngacgngnnnnnnnnnnnnnnnnnnnnnnnnnnnnnnnnnnnn

SEQ ID NO: 269936 - DNA, 422 bp, Homo sapiens
  misc_feature: GYAE6OF02HG7C8.22.46.E02.1.454.CMB.1.raw
  modified_base (416)..(422): a, c, t, g, unknown or other
  misc_feature (416)..(422): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggccgccctgcctccaggacgcacctccgagacgcacagcggccctgggctgcctggtcaaggctactccacgcgtatgtctgagcgggctggcaagggcgcatagnnnnnnn

SEQ ID NO: 269937 - DNA, 483 bp, Homo sapiens
  misc_feature: GYAE6OF02G4302.22.46.E02.1.454.CMB.1.raw
  modified_base (313)..(313): a, c, t, g, unknown or other
  misc_feature (313)..(313): n is a, c, g, or t
  modified_base (335)..(335): a, c, t, g, unknown or other
  misc_feature (335)..(335): n is a, c, g, or t
  modified_base (438)..(438): a, c, t, g, unknown or other
  misc_feature (438)..(438): n is a, c, g, or t
  modified_base (449)..(450): a, c, t, g, unknown or other
  misc_feature (449)..(450): n is a, c, g, or t
  modified_base (452)..(483): a, c, t, g, unknown or other
  misc_feature (452)..(483): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggactaatggtccacgtctctttagcctccaccaaggcccatccggtccttccccgnggccgccctcgcctccgaggcncaccgtccgagacgcacagccggccctgggctcgccgtggtcaacggtaccttacctccacgtcgttatcgtctaggaggccgggctcgggacaacggggccngtaacgtaggnngnnnnnnnnnnnnnnnnnnnnnnnnnnnnnnnn

SEQ ID NO: 269938 - DNA, 577 bp, Homo sapiens
  misc_feature: GYAE6OF02H6LQ4.22.46.E02.1.454.CMB.1.raw
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (531)..(533): a, c, t, g, unknown or other
  misc_feature (531)..(533): n is a, c, g, or t
  modified_base (535)..(535): a, c, t, g, unknown or other
  misc_feature (535)..(535): n is a, c, g, or t
  modified_base (537)..(538): a, c, t, g, unknown or other
  misc_feature (537)..(538): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (544)..(545): a, c, t, g, unknown or other
  misc_feature (544)..(545): n is a, c, g, or t
  modified_base (547)..(547): a, c, t, g, unknown or other
  misc_feature (547)..(547): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
tcagacatacgcgtcacgaccggtgctcgatttagactcatctacagggaagggactggacgtggagtttcatactattaacgatggagggaggacgaaaaggtacgcaaattctggtgaagggccgagtcacctatttccagagacaacgccaggaactcgagtcgtaactcctggacaaaagttgaacagcctgacgagccgaggacacggctgtctagttactgtacgagagattggcaacgcgtcggtacctttgagtgtcgtcgggtccctgggacaagtcggtcctaccggttcttctttacgccgtcccaaccgaacggccccacgtccgtccgttcccccgtggccgtcccgtcgcgtccgaggacgtcctaccgtaccggagacgacacgacgccggacccgtgggactcgccgtgggtacaaaggtacctaccgtccgaccgtacgtagtccgtaccgtaggacggtcggtctcggaccgaacggccgacgtaagcgagcncgtgncgngagcgngctnannngngnntntntnncnctcgtctntngngngngngntgtgtgngng

SEQ ID NO: 269939 - DNA, 503 bp, Homo sapiens
  misc_feature: GYAE6OF02JHSW7.22.46.E02.1.454.CMB.1.raw
  modified_base (476)..(503): a, c, t, g, unknown or other
  misc_feature (476)..(503): n is a, c, g, or t
tcagacatacgcgtcacgaccggtgctcgatttagactcatctacagggaaaggggctggagtggatttcatatattaacgatggagggaggacgaaaaggtacgcaaattctgtgaaggccgagtcaccatttccagagacaacgccaggaactcagtgtatctgacaaatgaacagcctgacagccgaggacacggctgtctattactgtacgagagattggacaagcctgggccttttgatgtcgtggggccctgggacaagtggtcaccgtctcttagcctccacaaggccatccggttcctcccccgtggccgccctgcctccgaggacgccaccgtccgagcgcacgacgccggcccgtgggacctgcccgtcggtacaacgggccttacgtcgccgtggtaccgaagcttaccgtacccagccgttagtgtctggacggtcgggctcggacgaaggcgtaccagtagcnnnnnnnnnnnnnnnnnnnnnnnnnnnn

SEQ ID NO: 269940 - DNA, 623 bp, Homo sapiens
  misc_feature: GYAE6OF02GTIZS.22.46.E02.1.454.CMB.1.raw
  modified_base (521)..(521): a, c, t, g, unknown or other
  misc_feature (521)..(521): n is a, c, g, or t
  modified_base (546)..(546): a, c, t, g, unknown or other
  misc_feature (546)..(546): n is a, c, g, or t
  modified_base (557)..(557): a, c, t, g, unknown or other
  misc_feature (557)..(557): n is a, c, g, or t
  modified_base (565)..(565): a, c, t, g, unknown or other
  misc_feature (565)..(565): n is a, c, g, or t
tcagacatacgcgtcacgaccggtgctcgatttagactcatctacaggaaaggggctggagtggatttcatactagttaacgatggagggaggacgaaaaggtacgcaaattctgtgaagggcccgagtcacctatttccagagacaacggccaggaactcagtgtatctgcaaatgaacagccgtgacagccgaaggacacggctgtctattactgtacgagagattggcaagcctgggcctttgatgtcgtggggcccctagggacaagtcgggtaccaccggttcttacttttaggcccttccgacccaagggcccagttcggtccttccccctcggccgacccgtcgcctccgaggacgcctaccgtccggagacggccacgacggccggaccgtcgggctacgccgtaggtacgaaggtccttaccgtttaccgtacgtacggttacgttacggtacgtcgggacggtccgggtcgttacggggaccgttaacgggccgtacgtaacgttaggcgngccgtcacggcacgtctcggtaccncgcgctcgacncacgcgcnctacgcgcgcgcgcgcgtcgtcgtcgtcgtcgacgacgacgtcgtacgtcgtacgtcg

SEQ ID NO: 269941 - DNA, 520 bp, Homo sapiens
  misc_feature: GYAE6OF02HX43Z.22.46.E02.1.454.CMB.1.raw
  modified_base (219)..(219): a, c, t, g, unknown or other
  misc_feature (219)..(219): n is a, c, g, or t
  modified_base (284)..(284): a, c, t, g, unknown or other
  misc_feature (284)..(284): n is a, c, g, or t
  modified_base (495)..(520): a, c, t, g, unknown or other
  misc_feature (495)..(520): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgaganattggcaagtcctgggcctttgatgtcgtggggccctgggacaatggtcaccgtctctttagccnccacacggccccagtccggtccttcccccgtcggcccgtccccgtgccttccgacggacgcccacccgtccgagacgcaccgaggcccggcccgtgggcctcggccgttgggtacgaaacggtaccttaccgtttacccgacggtccgttacgttcggttccgtgggtacgggtccgggtcgtcgggaccgtaacgggtcgacgagtacgnnnnnnnnnnnnnnnnnnnnnnnnnn

SEQ ID NO: 269942 - DNA, 463 bp, Homo sapiens
  misc_feature: GYAE6OF02FSKM5.22.46.E02.1.454.CMB.1.raw
  modified_base (330)..(330): a, c, t, g, unknown or other
  misc_feature (330)..(330): n is a, c, g, or t
  modified_base (445)..(463): a, c, t, g, unknown or other
  misc_feature (445)..(463): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggactaagtggtcaccgtctctttagcctccaccaagggcccatcggtcttccccgtggccgccctgctccgaggngccacctccgagagccacgacgccggccctggggctcggcctgggtacaaggtacctaccttccacggtccgttatcggtctggacggtcgggctcgggcaagggccgcagtagnnnnnnnnnnnnnnnnnnn

SEQ ID NO: 269943 - DNA, 508 bp, Homo sapiens
  misc_feature: GYAE6OF02HT2QX.22.46.E02.1.454.CMB.1.raw
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (466)..(466): a, c, t, g, unknown or other
  misc_feature (466)..(466): n is a, c, g, or t
  modified_base (470)..(473): a, c, t, g, unknown or other
  misc_feature (470)..(473): n is a, c, g, or t
  modified_base (476)..(479): a, c, t, g, unknown or other
  misc_feature (476)..(479): n is a, c, g, or t
  modified_base (481)..(485): a, c, t, g, unknown or other
  misc_feature (481)..(485): n is a, c, g, or t
  modified_base (487)..(492): a, c, t, g, unknown or other
  misc_feature (487)..(492): n is a, c, g, or t
  modified_base (494)..(495): a, c, t, g, unknown or other
  misc_feature (494)..(495): n is a, c, g, or t
  modified_base (497)..(508): a, c, t, g, unknown or other
  misc_feature (497)..(508): n is a, c, g, or t
tcagacatacgcgtcacgaccggtgctcgatttagactcatctacagggaaagggggctggagtggattttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggacaagccgtgggcctttggatgtcgtggggccctgggaacaagtcggtccaaccgtcctattttacgccttaccaccgaaacgggccccagttccggtcccttcccccgtggcccncccgtcgcctccaacggngcctaccgtccgagacgcaacgcgccgcccgngggctcgcttgtacaagtacctactccacgcgtatgtctgaggcggctagggcaaggtcgacgtaatagcagcngagnnnnacnnnnannnnnannnnnnannannnnnnnnnnnn

SEQ ID NO: 269944 - DNA, 471 bp, Homo sapiens
  misc_feature: GYAE6OF02IC0BJ.22.46.E02.1.454.CMB.1.raw
  modified_base (310)..(310): a, c, t, g, unknown or other
  misc_feature (310)..(310): n is a, c, g, or t
  modified_base (396)..(396): a, c, t, g, unknown or other
  misc_feature (396)..(396): n is a, c, g, or t
  modified_base (437)..(471): a, c, t, g, unknown or other
  misc_feature (437)..(471): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagggattggcaagcctgggcctttgatgtcgtggggccctgggacaagtggtcaccgtctcttagcctccaccaaggcccatccggtccttccccnggccgccctcgcctcccaggacgccacctccgagacgcacaggccgcccgtgggcctgcctggtacaaagcctacttccacgcgtntcgtctgagcgggctgggacaacgggccgacagtagctgcnnnnnnnnnnnnnnnnnnnnnnnnnnnnnnnnnnn

SEQ ID NO: 269945 - DNA, 535 bp, Homo sapiens
  misc_feature: GYAE6OF02I8J5G.22.46.E02.1.454.CMB.1.raw
  modified_base (357)..(357): a, c, t, g, unknown or other
  misc_feature (357)..(357): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
  modified_base (499)..(502): a, c, t, g, unknown or other
  misc_feature (499)..(502): n is a, c, g, or t
  modified_base (504)..(505): a, c, t, g, unknown or other
  misc_feature (504)..(505): n is a, c, g, or t
  modified_base (507)..(507): a, c, t, g, unknown or other
  misc_feature (507)..(507): n is a, c, g, or t
  modified_base (510)..(527): a, c, t, g, unknown or other
  misc_feature (510)..(527): n is a, c, g, or t
  modified_base (529)..(532): a, c, t, g, unknown or other
  misc_feature (529)..(532): n is a, c, g, or t
  modified_base (535)..(535): a, c, t, g, unknown or other
  misc_feature (535)..(535): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaatgaacagcctgacagccgaggacaggctgtctattctgtacagagattggcaagcctgggcctttggatgtctcgggcctgggacaagtggtcaccgtctacttttacgcctcctaccgaacggcccagtccggtcccttcccccgtcggccgccctcgctcccaggacgtccaccgtccggagacnccacgaggtccggaccctggggcctacgcccgtgggtcaacggggtaccttacctcccgtacgccggttaattccggttctagggacggcgggtcgttcgggaaccgtagggccgtgaacctagggtacngngcnctncncnnnncnngnacnnnnnnnnnnnnnnnnnncnnnngtn

SEQ ID NO: 269946 - DNA, 431 bp, Homo sapiens
  misc_feature: GYAE6OF02GXHV0.22.46.E02.1.454.CMB.1.raw
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (419)..(431): a, c, t, g, unknown or other
  misc_feature (419)..(431): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctgggccctgggacaatggtcaccgtctctttagcctccaccaagggcccatcggtcttccccnggccgccctgcctccaggacncacctccgagacgcacgagcggccctgggctgccctggtcaaggtctacttccacgtcgtatgtctgagcgggcnggacaggcacntagnnnnnnnnnnnnn

SEQ ID NO: 269947 - DNA, 509 bp, Homo sapiens
  misc_feature: GYAE6OF02IPVF3.22.46.E02.1.454.CMB.1.raw
  modified_base (182)..(182): a, c, t, g, unknown or other
  misc_feature (182)..(182): n is a, c, g, or t
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (279)..(279): a, c, t, g, unknown or other
  misc_feature (279)..(279): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (477)..(501): a, c, t, g, unknown or other
  misc_feature (477)..(501): n is a, c, g, or t
  modified_base (503)..(509): a, c, t, g, unknown or other
  misc_feature (503)..(509): n is a, c, g, or t
tcagacatacgcgtcacgaccggtgctcgatttagactcatctacagggaagggctggagtggatttcatatattaacgatggagggaggacgaaaaggtacgacaaattctgtgaaagggccgagtcaccatttccagagacaacgccaggaactcagtgtatctgcaaatgaacagcctnaccagccgagacacgctgtctaattacngtacagagnttgganaagcctggggtcctttaggactgtcgtggggccctggacgaatggtacaccgtntctttagcctccacacggccatccgtaccttccccctgccgtcctgtacctccaaggacnctaccctacgngtacgctaacgacgcgaccccgtggcctggcctcggtacgtaacggaccttaaccgtccgaacctcgtactgtcccgtaggacgccgggtactagggccaaaggtccgcgtagaagcnagctncagnnnnnnnnnnnnnnnnnnnnnnnnncnnnnnnn

SEQ ID NO: 269948 - DNA, 493 bp, Homo sapiens
  misc_feature: GYAE6OF02IRA1O.22.46.E02.1.454.CMB.1.raw
  modified_base (186)..(186): a, c, t, g, unknown or other
  misc_feature (186)..(186): n is a, c, g, or t
  modified_base (428)..(428): a, c, t, g, unknown or other
  misc_feature (428)..(428): n is a, c, g, or t
  modified_base (467)..(493): a, c, t, g, unknown or other
  misc_feature (467)..(493): n is a, c, g, or t
tcagacatacgcgtcacgaccggtgctcgatttagactcatctacagggaaaggggctggagtggattttcatatattaacgatggagggaggacgaaaaggtacgcaaattctgtgaagggccgagtcaccatttccagagacaacgccaggaactcagtgtatctgcaaatgaacagcctgacngccgagacacggctgtctattactgtacgagagattggcaagcctgggtcctttgatgtctggggccctgggacaatcggtcaccgtctctttacgcctccaccgacggcccagtccggtccttcccccgtggccgtccctgcctccgaggcgccacccgtcgacgacgctaccgagccggcccgtggggcctcgccgtgggtacaacggtacctacgttacccgacgtcgttatcgttcgngtacggcgggactcgggacaagggtccagtactagcagnnnnnnnnnnnnnnnnnnnnnnnnnnn

SEQ ID NO: 269949 - DNA, 591 bp, Homo sapiens
  misc_feature: GYAE6OF02FN0Z2.22.46.E02.1.454.CMB.1.raw
  modified_base (323)..(323): a, c, t, g, unknown or other
  misc_feature (323)..(323): n is a, c, g, or t
  modified_base (523)..(523): a, c, t, g, unknown or other
  misc_feature (523)..(523): n is a, c, g, or t
  modified_base (537)..(538): a, c, t, g, unknown or other
  misc_feature (537)..(538): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(570): a, c, t, g, unknown or other
  misc_feature (569)..(570): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (582)..(582): a, c, t, g, unknown or other
  misc_feature (582)..(582): n is a, c, g, or t
  modified_base (591)..(591): a, c, t, g, unknown or other
  misc_feature (591)..(591): n is a, c, g, or t
tcagacatacgcgtcacgaccggtgctcgatttagactcatctacagggaaaggggctggagtggatttcatatattaacgatggagggaggacgaaaaaggtacgcaaattctgtgaagggccgagtcaccatttccagagacaacgccaggaactcagtgtatctgcaaatgaacagcctgacagccgaggacacggctgtctattactgtacgagagattggcaagcctgggtcctttgatgtcgtggggccctgggacaatggtccaccgtcttctttacgcccttccaccgaagggccccatccggtccttcccccgnggtccgtccccgtgccttccgaaggacgtccaccgtccgaagacgcgaacgacggccggcccgtggggacctcggcccgttgggtaccaaacgggtaccttaccgttacccgaccggtaccgttagttcgttacgtgggtacggtccggggcttagggaccgtaacgggccgtacgtaacgttaacgctgtagcgtagcncgttgctgaccgtnncngtancgttcgagccatgaccgntcngncnnacgcncngacgngcgtgtgtn

SEQ ID NO: 269950 - DNA, 680 bp, Homo sapiens
  misc_feature: GYAE6OF02I7OHA.22.46.E02.1.454.CMB.1.raw
  modified_base (629)..(629): a, c, t, g, unknown or other
  misc_feature (629)..(629): n is a, c, g, or t
  modified_base (631)..(632): a, c, t, g, unknown or other
  misc_feature (631)..(632): n is a, c, g, or t
  modified_base (634)..(636): a, c, t, g, unknown or other
  misc_feature (634)..(636): n is a, c, g, or t
  modified_base (640)..(640): a, c, t, g, unknown or other
  misc_feature (640)..(640): n is a, c, g, or t
  modified_base (644)..(645): a, c, t, g, unknown or other
  misc_feature (644)..(645): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (653)..(653): a, c, t, g, unknown or other
  misc_feature (653)..(653): n is a, c, g, or t
  modified_base (657)..(658): a, c, t, g, unknown or other
  misc_feature (657)..(658): n is a, c, g, or t
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
  modified_base (665)..(671): a, c, t, g, unknown or other
  misc_feature (665)..(671): n is a, c, g, or t
  modified_base (677)..(680): a, c, t, g, unknown or other
  misc_feature (677)..(680): n is a, c, g, or t
tcagacatacgcgtcacgaccggtgctcgatttagactcatctacagggaaggggctggagtggatttcatatattaacgatggagggaggacgaaaaaggtacgcaaattctgtgaagggccgagtcaccatttccagagacaacgccaggaactcagtgtatctgcaaatgaacagcctgacagccgaggacacggctgtctattactgtacgagagattgacaacgcctcgggtcctttggatcgtcgtcgggggccctaggggacctaagtcggtccgacgtccgttcttacgcctaccaccgaaacgggccctacgtccggttcccttcccccgtggtcccggtcccctcgtccgtacccgagggtacggccctacccgttcccggaaggacctccgaaccgtacgggcccggggtccccgtcgggggtccgttcggtccccggttacggggtaacccgaaaaacgggggttacccttttaaaccccgttacccgtaaacccgggttaccggtaacgttttcgggtttaccgttacgggtaaacccgggggtcccggggaccggtttaacggggaccgggtaaacggggtacccggaacctaaggttaaggcgtacgcttagcncnngnnncgtnctanncgcncncnctcnncncnctnnnnnnncgcagnnnn

SEQ ID NO: 269951 - DNA, 586 bp, Homo sapiens
  misc_feature: GYAE6OF02JJ1RP.22.46.E02.1.454.CMB.1.raw
  modified_base (558)..(559): a, c, t, g, unknown or other
  misc_feature (558)..(559): n is a, c, g, or t
  modified_base (561)..(562): a, c, t, g, unknown or other
  misc_feature (561)..(562): n is a, c, g, or t
  modified_base (564)..(586): a, c, t, g, unknown or other
  misc_feature (564)..(586): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgagagagattggcaagcctgggcctttgatgtcgtggggccctgggacaagtcggtacaccgttcgtcttttagccttccaccgaacgggtcccacttaccggtcccctttcccccgtggtcccgcccgtcggtccttcccgaagggtaccgaccaccccgttcggacgtacgacccgaacgtaccgggcccggccccggttacggggccttaccgggacccgtttacgggggtaccgaaaaccgggtacctttaacccgtttcccgaaaccggtccggttaattcggtccggttaggtacgggccggggtagttcgggaccgtaagggccgtacagtaaggctcganngnncnnnnnnnnnnnnnnnnnnnnnnn

SEQ ID NO: 269952 - DNA, 741 bp, Homo sapiens
  misc_feature: GYAE6OF02G9G7J.22.46.E02.1.454.CMB.1.raw
  modified_base (621)..(621): a, c, t, g, unknown or other
  misc_feature (621)..(621): n is a, c, g, or t
  modified_base (638)..(638): a, c, t, g, unknown or other
  misc_feature (638)..(638): n is a, c, g, or t
tcagacatacgcgtcacgaccggtgctcgatttagactcatctacagggaaaggggctggagtggatttcatatattaacgatggagggaggacgaaaaggtacgcaaattctgtggaagggccgagtcaccatttccagagacaacgccaggaactcagtgtatctgacaaatgaacagcctgacagccgaggacacggctgtcttagttactgtaacgagagattggcaacgtccgtggggtccttttagagtcggtccgtacgggggccctagggaccaagttcggtaccaccgttcttacgtttacggcccttaccgaaccgtaacgggaccctaacggttcccggtacccgtttccccccggtcggacccggtcccgtacgtccgttacccggaaggtaccgaccgacccgttacccggaggtaaccgcgaaccgacgggtaccggccccgtttaggggaccgtcggaccccgttagggtaacccgtaaacggtaccgtttaaccgtacccgtaaccgggtaccggtttaacgttcggttaccggtacgggtaacgggtcccggggtacgttacgggggaacctaaacgggggaccgtacgtaaacggttcggaancgaacgtcggtagtacngcgtcgtactacgacgagtacgacacgtacgacgtcgactcgagtacgtacgacgagacgtacgtacgaacgacgtcgacgacgtacgtacgtcacgagtacg

SEQ ID NO: 269953 - DNA, 754 bp, Homo sapiens
  misc_feature: GYAE6OF02I0LDO.22.46.E02.1.454.CMB.1.raw
  modified_base (139)..(139): a, c, t, g, unknown or other
  misc_feature (139)..(139): n is a, c, g, or t
  modified_base (176)..(176): a, c, t, g, unknown or other
  misc_feature (176)..(176): n is a, c, g, or t
  modified_base (211)..(211): a, c, t, g, unknown or other
  misc_feature (211)..(211): n is a, c, g, or t
  modified_base (647)..(647): a, c, t, g, unknown or other
  misc_feature (647)..(647): n is a, c, g, or t
  modified_base (676)..(676): a, c, t, g, unknown or other
  misc_feature (676)..(676): n is a, c, g, or t
  modified_base (703)..(703): a, c, t, g, unknown or other
  misc_feature (703)..(703): n is a, c, g, or t
tcagacatacgcgtcacgaccggtgctcgatttagactcatctacagggaagggctggagtggatttcatatattaacgatggagggaggacgaaaaggtacgacaaattctgtgaagggccgagtcaccatttccagngacaacgccaggaactcagtgtatctgcaaatgaacngcctgacagccgaggacacggctgtactattacgngtacggagagtattcggcaagtccgtcgggtcgtttcgagtagtcggttccggggcccgtgggacgtaacgtacggttccgaccgtccctttatttaccggtacctccccaaccgacgggtaccccgtacttaccgggttacccgttccccccggttacggccggtcccctaccggtcctacccggtaacgggaaccgtccgtaccgttacccccgggaacgtagacccccgtaagtaccggcccccggggtcccgtcggggtacggtacccggttcccggtaccggttacccgaaaacgggtacccttacccgtttaccgacccgggacggttacgttaggtccggttacggtaccggacgggtccggtacggacgggtacggtaacccggtcgaaacgttcgacgtcgaacggtactcggcttaaagggcctanaccggctgtacggtcgaccgagtaccggntacgcgtcagttccgcgtactaccggntaaccgtcggtcaccacgtacgtacgtaccgtacgtacgtacgtacgtacg

SEQ ID NO: 269954 - DNA, 679 bp, Homo sapiens
  misc_feature: GYAE6OF02FMJUI.22.46.E02.1.454.CMB.1.raw
  modified_base (570)..(570): a, c, t, g, unknown or other
  misc_feature (570)..(570): n is a, c, g, or t
  modified_base (596)..(596): a, c, t, g, unknown or other
  misc_feature (596)..(596): n is a, c, g, or t
  modified_base (605)..(605): a, c, t, g, unknown or other
  misc_feature (605)..(605): n is a, c, g, or t
  modified_base (611)..(611): a, c, t, g, unknown or other
  misc_feature (611)..(611): n is a, c, g, or t
  modified_base (626)..(626): a, c, t, g, unknown or other
  misc_feature (626)..(626): n is a, c, g, or t
  modified_base (631)..(631): a, c, t, g, unknown or other
  misc_feature (631)..(631): n is a, c, g, or t
  modified_base (645)..(645): a, c, t, g, unknown or other
  misc_feature (645)..(645): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (657)..(657): a, c, t, g, unknown or other
  misc_feature (657)..(657): n is a, c, g, or t
tcagacatacgcgtcacgaccggtgctcgatttagactcatctacagggaaggggctggagtggatttcatatattaacgatggagggaggacgaaaaggtacgcaaatctgtgaagggccgagtcaccatttccagagacaacgccaggaactcagtgtatctgcaaatgaacagctgacagccggaggacacggctgtcgattactgtacgagagattggcagcctgggtccttgactgtcgtcggggcccttcggggactaagtggtccacgtcctcgttttaacgccgttcccaccaaggggtccccacgttaccggtcctttcccccccgttcgggccggacccccgtgtcccttacccgtacgggaacgccgtaccccgttacccggacgtacgggccaaccgaacgggtcccggcccggttcgggggccgttacggtccccgttacgggttacggaaaaccgggtaccgtaaaccttttcccgaacccggtaccgggttacgttacgtttcgttaccggggagggtacccggggtcgttaccgggccggtaaaacggggtccnccgtaaacggttcgacggtaccggtntacgcgacncgcgcncgtacgcgcgcgtcncgagngcgacgcgcgtcgngcgngncacgcncagcgctacagtacgtctgtcg

SEQ ID NO: 269955 - DNA, 620 bp, Homo sapiens
  misc_feature: GYAE6OF02HSPX4.22.46.E02.1.454.CMB.1.raw
  modified_base (568)..(568): a, c, t, g, unknown or other
  misc_feature (568)..(568): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (578)..(579): a, c, t, g, unknown or other
  misc_feature (578)..(579): n is a, c, g, or t
  modified_base (582)..(583): a, c, t, g, unknown or other
  misc_feature (582)..(583): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (589)..(590): a, c, t, g, unknown or other
  misc_feature (589)..(590): n is a, c, g, or t
  modified_base (592)..(593): a, c, t, g, unknown or other
  misc_feature (592)..(593): n is a, c, g, or t
  modified_base (595)..(596): a, c, t, g, unknown or other
  misc_feature (595)..(596): n is a, c, g, or t
  modified_base (599)..(609): a, c, t, g, unknown or other
  misc_feature (599)..(609): n is a, c, g, or t
  modified_base (611)..(620): a, c, t, g, unknown or other
  misc_feature (611)..(620): n is a, c, g, or t
tcagacatacgcgtcacgaccggtgctcgatttagactcatctacagggaaggggctggagtggatttcatatattaacgatggagggaggacgaaaaaggtacgcaaaattctgtgaagggccgagtcaccatttccagagacaacgccaggaactcagtgtatctgcaaatgaacagcctgacagccgaggacacggactgtctattactgtacgagagattggcaagccgtgggcctttgatgtcgtggggccctgggacctaagtcggtctaccgtctctttacgcccttacccacccgaaacggggtccccacgttccggttccctttcccccccgtagggccccgtcccccttcgacccgttcccgaacgggaccggccaccccgttcccggaacggtaccggccaaccgaccggtccggcccccggttcggggaccgtccggtacccgtcgggtaaccgaaacgggtaccttaccccgttacccgtaccggtccgttagttcgtccgtaggacgggtaccggggtctacggggtacgaaaccgggtcggacctaggtaagngtacngnacnncgnnancngnngnngnngcnnnnnnnnnnncnnnnnnnnnn

SEQ ID NO: 269956 - DNA, 722 bp, Homo sapiens
  misc_feature: GYAE6OF02J085J.22.46.E02.1.454.CMB.1.raw
  modified_base (199)..(199): a, c, t, g, unknown or other
  misc_feature (199)..(199): n is a, c, g, or t
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
  modified_base (599)..(599): a, c, t, g, unknown or other
  misc_feature (599)..(599): n is a, c, g, or t
  modified_base (605)..(605): a, c, t, g, unknown or other
  misc_feature (605)..(605): n is a, c, g, or t
  modified_base (626)..(626): a, c, t, g, unknown or other
  misc_feature (626)..(626): n is a, c, g, or t
tcagacatacgcgtcacgaccggtgctcgatttagactcatctacaggggaaggggctggacgtggatttcatatattaacgatggagggaggacgaaaggtacgcaaattctgtgaagggccgagtcaccatttccagagacaacgcaggaactcagtgtatcgtggcaactgacagctagacacgcgaggacacggntgtctatactggtacagatagtggactaacgtcctcgggtcctttagntcgtcgtcggggccctagggaactagtcggtaccacggttccttcgttacnccgttaccgaacgtacggcctagtccgttcccgtcccccgtaggccgtccctacggaccgttaccgaaggttccgaccgtacccgtaccgtacggaacgtaccggaccgtacgggtcccggaccgtcggggtaaccgtccggtacccggttagggtaaccgaaacgggtttacccgttaaccgtttcccgaaaccggggttccggttaagttcggttaccgtaacgggggtccgggtacccgggcccggttaacggacggtaacggccggtacctaaacggtacgcgttagcccgtatacngttacngacctaggtccaccgtacggngtacgtacgtcgttacgtacgtagtagtacgcgtacgtacgtacgtcgtacgtacgtacgtacgtcgtacgtacgtcgtacgtcgtacgtacgtcg

SEQ ID NO: 269957 - DNA, 616 bp, Homo sapiens
  misc_feature: GYAE6OF02HNO3Y.22.46.E02.1.454.CMB.1.raw
  modified_base (559)..(559): a, c, t, g, unknown or other
  misc_feature (559)..(559): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (592)..(599): a, c, t, g, unknown or other
  misc_feature (592)..(599): n is a, c, g, or t
  modified_base (603)..(616): a, c, t, g, unknown or other
  misc_feature (603)..(616): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagtattggcaacgtccgtgggtcctttgatgtcggtcgggccgtagggactagtcggtctaccgtcttcgttacgccttccaaccgtaacggcccagttccggttccttcccccgtcggccgtcccgtcgcctcgacggtcgacccgtacccgtccggaagacgaccacgaccgggcccgggtcccgtcggggtcccgtcggtccgttacgggtaacccgtaaacgggtacccttacccgtacccgtaccggtcggttaacgttcgggtttaccgtcgggggaacgggttcccgggtacggtacgggaacccggaacgggcccggtacggtaacggtaacgnggactcggngngngcgcgncngcancgcncncnnnnnnnnacgnnnnnnnnnnnnnn

SEQ ID NO: 269958 - DNA, 512 bp, Homo sapiens
  misc_feature: GYAE6OF02HG6ZR.22.46.E02.1.454.CMB.1.raw
  modified_base (186)..(186): a, c, t, g, unknown or other
  misc_feature (186)..(186): n is a, c, g, or t
  modified_base (191)..(191): a, c, t, g, unknown or other
  misc_feature (191)..(191): n is a, c, g, or t
  modified_base (212)..(212): a, c, t, g, unknown or other
  misc_feature (212)..(212): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
  modified_base (500)..(512): a, c, t, g, unknown or other
  misc_feature (500)..(512): n is a, c, g, or t
tcagacatacgcgtcacgaccggtgctcgatttagactcatctacagggaaggggctggagtggatttcatatattaacgatgggagggaggacgaaaagggtacgcaaattctgtggaaggccgagtcacatttccagagacaacgccaggaactcagtgtatctgacaaatgaacagcctgacngccgnggacacggctgtctattacgngtacgagagattggcaagcctgggaccttttgagtgtcgcgggggccccgtaaggaagtcgtcggtaccgtccgttacttacgttccacccgtacaacgggacccgtacgtcgttcccgttccccgttcccggccggtcccgtcgtaccgccgcggtanccgtacccgccggacncggaccacgacggtccggccgcggttcgcgtaccgggtctacggtacgtaacgtacctcgtaaccgtgtacgtgtaccgtgacgtcggcgtacgnggaacngacgttagntgnnnnnnnnnnnnn

SEQ ID NO: 269959 - DNA, 505 bp, Homo sapiens
  misc_feature: GYAE6OF02FS45L.22.46.E02.1.454.CMB.1.raw
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (485)..(486): a, c, t, g, unknown or other
  misc_feature (485)..(486): n is a, c, g, or t
  modified_base (488)..(505): a, c, t, g, unknown or other
  misc_feature (488)..(505): n is a, c, g, or t
tcagacatacgcgtcacgaccggtgctcgatttagactcatctacagggaaaggggctggagtggatttcatatattaacgatggagggaggacgaaaaggtacgcaaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttacgcctccaccaagggcccatcggtccttccccgnggccnccctcgctccgaggacnccacctcgagagcacacgcggcctgggctgccgtggtacaaggtacctacgttccgacggtacgtagttcgtcgtggacggtcgggtcgtcgggacaaaggggccactagtagcgtcgtcncgtncgtcncgnctnactgctngngcgntnngnnnnnnnnnnnnnnnnnn

SEQ ID NO: 269960 - DNA, 546 bp, Homo sapiens
  misc_feature: GYAE6OF02GWBXM.22.46.E02.1.454.CMB.1.raw
  modified_base (386)..(386): a, c, t, g, unknown or other
  misc_feature (386)..(386): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (521)..(523): a, c, t, g, unknown or other
  misc_feature (521)..(523): n is a, c, g, or t
  modified_base (525)..(525): a, c, t, g, unknown or other
  misc_feature (525)..(525): n is a, c, g, or t
  modified_base (527)..(537): a, c, t, g, unknown or other
  misc_feature (527)..(537): n is a, c, g, or t
  modified_base (539)..(539): a, c, t, g, unknown or other
  misc_feature (539)..(539): n is a, c, g, or t
  modified_base (541)..(546): a, c, t, g, unknown or other
  misc_feature (541)..(546): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagtattggcaaggcctgggtccttgatgtcgtgggccctgggacaagtggcaccgtctctttagccctaccaccgacggcctagtcccggttccttcccccgtggaccgtccctcgccctccgaggacgcccaccgtccgagtcgccacgacggccggccctggggtccncgcccgtggaccgtaacggaccttaccgtcccgtaacggtccgtaattccggtactacgggaccggtacgggggtccgtacgggaccgaacggggcctacgagtagacncgtagntangcngntgcntagncntnnngnannnnnnnnnnncncnnnnnn

SEQ ID NO: 269961 - DNA, 481 bp, Homo sapiens
  misc_feature: GYAE6OF02H8SYQ.22.46.E02.1.454.CMB.1.raw
  modified_base (210)..(210): a, c, t, g, unknown or other
  misc_feature (210)..(210): n is a, c, g, or t
  modified_base (269)..(269): a, c, t, g, unknown or other
  misc_feature (269)..(269): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (446)..(448): a, c, t, g, unknown or other
  misc_feature (446)..(448): n is a, c, g, or t
  modified_base (450)..(481): a, c, t, g, unknown or other
  misc_feature (450)..(481): n is a, c, g, or t
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattacngtacgagagattggcaagcctgggcctttgatgtcgtggggccctgggacaatggtacnccgtctctttagcctccaccacggccagtccgtcctcccccgtgccgtccctgcctccnggacnccacctccgagngcagacgccggccctagggctgccgtggtaccaaggtcctacttccacgtcgtatcgtgtgtaggcgggtatcggacgtaggcccgatagtagngcntcgnnngnnnnnnnnnnnnnnnnnnnnnnnnnnnnnnnn

SEQ ID NO: 269962 - DNA, 604 bp, Homo sapiens
  misc_feature: GYAE6OF02FK02C.22.46.E02.1.454.CMB.1.raw
  modified_base (270)..(270): a, c, t, g, unknown or other
  misc_feature (270)..(270): n is a, c, g, or t
  modified_base (535)..(535): a, c, t, g, unknown or other
  misc_feature (535)..(535): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(573): a, c, t, g, unknown or other
  misc_feature (571)..(573): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (602)..(602): a, c, t, g, unknown or other
  misc_feature (602)..(602): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctagggcctttgatgtctggggccctgggacatggtcacgtntcttagcctccacagggcccagtcgtcttccccgtggcgccctgctccaggacgccacctaccggagtagacctacgacggccggtccccgtacggggtccttcggcccgttacgggtaccgaaaacggggtacctttacccgtttaccccgacggtaccggtttaacgtcggttttaccgtacgggtaacgggccgggggtaccctttggggaacccggttaacggggacccggccgttaagttaacggcgaatgttcgagtanaccgngctagngtacncntcacagngtcgngngngnnngtgcgtcacacactgactctacancngtntc

SEQ ID NO: 269963 - DNA, 528 bp, Homo sapiens
  misc_feature: GYAE6OF02I78CE.22.46.E02.1.454.CMB.1.raw
  modified_base (185)..(185): a, c, t, g, unknown or other
  misc_feature (185)..(185): n is a, c, g, or t
  modified_base (488)..(488): a, c, t, g, unknown or other
  misc_feature (488)..(488): n is a, c, g, or t
  modified_base (498)..(528): a, c, t, g, unknown or other
  misc_feature (498)..(528): n is a, c, g, or t
tcagacatacgcgtcacgaccggtgctcgatttagactcatctacagggaaaggggctggagtggattgggtatatctattacactgggagcaccgactacagcccctccctcatgagtcgagtcaccatttcactagacacgtccaagaacctagttctccctgaaactgaggtctgtgaccgntgcggacaccggccgtctattactgtgcgatatttgtcgtttttggagttggttaccgcgtcgtttgctacgtggggccagggtaccctggtcaccgtcctctcagtcctccaccgaacgggccctagtccggtcccttcccccgtggcctacccctccttaccgaaggacgcctaccgtcggtcgggggccagacggccggtcccgtgggtacctcgtccgttgggtaccaacgggtaccttactccgacggtcgttagtcgttccgtagcgggacgggccgttgggaccgagggtccccgngtaacgtcgnnnnnnnnnnnnnnnnnnnnnnnnnnnnnnn

SEQ ID NO: 269964 - DNA, 498 bp, Homo sapiens
  misc_feature: GYAE6OF02G7XG2.22.46.E02.1.454.CMB.1.raw
  modified_base (340)..(340): a, c, t, g, unknown or other
  misc_feature (340)..(340): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (462)..(467): a, c, t, g, unknown or other
  misc_feature (462)..(467): n is a, c, g, or t
  modified_base (470)..(470): a, c, t, g, unknown or other
  misc_feature (470)..(470): n is a, c, g, or t
  modified_base (474)..(498): a, c, t, g, unknown or other
  misc_feature (474)..(498): n is a, c, g, or t
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggacaagcctgggcctttgatgtcgtggggcctgggacagtggtcaccgtctcttacgcctccacgaacggcccacgtccggtccttcccccgtggcccgccctcgccgtaccaggacnccaccgtccgagacgaccacgacgccggtacccgtgggcctcgccgtggtacgaacggtaccttacctccgacgcgttactcgtctggacggcgggtactgggacgacggtcganatggntnnnnnngancgtnnnnnnnnnnnnnnnnnnnnnnnnn

SEQ ID NO: 269965 - DNA, 513 bp, Homo sapiens
  misc_feature: GYAE6OF02HCD7I.22.46.E02.1.454.CMB.1.raw
  modified_base (241)..(241): a, c, t, g, unknown or other
  misc_feature (241)..(241): n is a, c, g, or t
  modified_base (279)..(279): a, c, t, g, unknown or other
  misc_feature (279)..(279): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (442)..(442): a, c, t, g, unknown or other
  misc_feature (442)..(442): n is a, c, g, or t
  modified_base (473)..(474): a, c, t, g, unknown or other
  misc_feature (473)..(474): n is a, c, g, or t
  modified_base (478)..(479): a, c, t, g, unknown or other
  misc_feature (478)..(479): n is a, c, g, or t
  modified_base (481)..(513): a, c, t, g, unknown or other
  misc_feature (481)..(513): n is a, c, g, or t
tcagacatacgcgtcacgaccggtgctcgatttagactcatctacagggaaaggggctggagtggattttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctggtccttgntgtcgtgggcctggacagtggtcaccgtcttcgttacnccctccaccgacgggcccagtccggtccttcccccgtggccgccctgcctccgaggcnccaccnccgagcgcacgcgccggccgtgggcctcgccgttggtacgaacggtaccttacccgttaccgaccggtcgttaacgtggtcctcgggacgggtccgggngtccgggacgacggtccgacgtaagtcgganngacnncnnnnnnnnnnnnnnnnnnnnnnnnnnnnnnnnn

SEQ ID NO: 269966 - DNA, 203 bp, Homo sapiens
  misc_feature: GYAE6OF01CASWL.39.50.E06.1.454.CMB.1.raw
  modified_base (179)..(182): a, c, t, g, unknown or other
  misc_feature (179)..(182): n is a, c, g, or t
  modified_base (184)..(203): a, c, t, g, unknown or other
  misc_feature (184)..(203): n is a, c, g, or t
tcagtcgcactagtcacgaccggtgctcgatttagatctactgacaacacacaagggcccatcggtcttcccctggcgccctgctccaggagcacctccgagagcacagcggccctgggctgcctggtcaaggactacttccactagtgcgactgtagcgggctggcaaggcgcatagnnnngnnnnnnnnnnnnnnnnnnnn

SEQ ID NO: 269967 - DNA, 500 bp, Homo sapiens
  misc_feature: GYAE6OF01AFFQU.39.50.E06.1.454.CMB.1.raw
  modified_base (204)..(204): a, c, t, g, unknown or other
  misc_feature (204)..(204): n is a, c, g, or t
  modified_base (495)..(495): a, c, t, g, unknown or other
  misc_feature (495)..(495): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactattagcagcaacttagcctggtaccagcaaaaacctggccagactcccaggctcctcatgtatggtgcgtccaccagggccactggtatcccagccaggttcagtggcagtgggtctgggacagagttcagtctcaccatcagcagcctgcagtctgaagtattttgtactttattactgtcagcagtatgatacctggcctcactactttggcctaggggaccaggttggagtatacgaaacgactgtcggctgcaccntctcg

SEQ ID NO: 269968 - DNA, 514 bp, Homo sapiens
  misc_feature: GYAE6OF01DS3X5.39.50.E06.1.454.CMB.1.raw
  modified_base (508)..(508): a, c, t, g, unknown or other
  misc_feature (508)..(508): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactatagcagcaacttagcctggtaccagacaaaaacctggccagactcccaggctcctcatgtatggtgccgtccaccgagggccactggtactcccagccaggttcagtggcaggtgggtctgggacagagttcagtctcaccatcagcagcctgcagtctgaagtattttgtactttattactgtcagctagtatgattaccgtggcctcactcttttggccctaggggaccctagggttggagtatacgaaacgaactggtcggctgcaccntcttcg

SEQ ID NO: 269969 - DNA, 507 bp, Homo sapiens
  misc_feature: GYAE6OF01EQPRJ.39.50.E06.1.454.CMB.1.raw
  modified_base (204)..(204): a, c, t, g, unknown or other
  misc_feature (204)..(204): n is a, c, g, or t
  modified_base (501)..(501): a, c, t, g, unknown or other
  misc_feature (501)..(501): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagcaaaaacctggccagactcccaggctcctcatgtatggtgcgtccaccagggccactggtatcccagccaggttcagtggcagtgggtctgggacagagttcagtctcaccatcagcagcctgcagtctgaagtattttgtactttattactgtcagcagtatgatacctggccttcactacgtttggccgtaggggacctagggttggagtatacgaaacgaactggtagctgacaccntcgtcg

SEQ ID NO: 269970 - DNA, 582 bp, Homo sapiens
  misc_feature: GYAE6OF01BMKRF.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccaccctctcctgcagggccagtcagactatagcagcaacttagcctggtaccagacaaaacgtggccagactccaggctcctcatgtatggtcgccgtccgaccgacgggccacgtcggtactcccgagccgaggttcaggtcggacgaggtgggtcgtagggactaggagttcagttcctcaccatcagcacgtcctgctagtctagtaagttattttagttactttacgttactgtactagtactaggtattcgacttaccgtcggtaccttaccgtaacttacggttttacggaccggtaacggggaccgttagggttacggaagtacgtaacgaaacggtacgttggacgtctacgactactgtcgttacg

SEQ ID NO: 269971 - DNA, 516 bp, Homo sapiens
  misc_feature: GYAE6OF01A9Y7L.39.50.E06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagactattagcagcaacttagcctggtaccagcaaaaacctggccagactcccaggctcctcatgtatggtgcgtccaccagggccactggtatcccagccaggttcagtggcagtgggtctgggacagagttcagtctcaccatcagcagcctgcagtctgaagtattttgtacttttattactgtctagcagtatgatacctggcctcactactttggccaggggaccagggttcggagtatacgaaaacgtactaggtacggtctagactaccgatcgttacgg

SEQ ID NO: 269972 - DNA, 520 bp, Homo sapiens
  misc_feature: GYAE6OF01B2TBR.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagcccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagcaaaaacctggccagactcccaggctcctcatgtatggtgcgtccaccagggccactggtactccagccaggttcagtggcagtgggtctgggacagagtcagtctcaccatcagcagcctgcagtctagaagtattttgtactttattactgtctagctagtatgactaccgtggcctcacgtactttcggccgaggggacctagggttggacgtatacctaaacggactggtaggtctcggaccacctgtcttcgg

SEQ ID NO: 269973 - DNA, 558 bp, Homo sapiens
  misc_feature: GYAE6OF01BN403.39.50.E06.1.454.CMB.1.raw
  modified_base (206)..(206): a, c, t, g, unknown or other
  misc_feature (206)..(206): n is a, c, g, or t
  modified_base (401)..(401): a, c, t, g, unknown or other
  misc_feature (401)..(401): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcctgcagggccagtcagactattagcagcaacttagcctggtaccagcaaaacctggccagactcccaggctcctcatgtatggtgcgtccacgagggccactggtatcccagccaggttcaggtggcaggtgggtctgggacaggtagttcagtctcaccatcagcagcctgcagtctagaatnttttgtactttattactgtcagtcagttatgtataccgtggtccctcacgttacgttttcgggacccgtaggggtaccctaggggtttacggagtacgttaccgaccgtaaccggtaaacgtgggttacgggacttaggacccaccgtacgttaccg

SEQ ID NO: 269974 - DNA, 487 bp, Homo sapiens
  misc_feature: GYAE6OF01ESOT9.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactattagcagcaacttagcctggtaccagcaaaaacctggccagactcccaggctcctcatgtatggtgcgtccaccagggccactggtatccagccaggttcagtgcagtgggtctgggacagagttcagtctcaccatcagcagcctgcagtctgaagtattttgtactttatactgtcagcagtatgatactggcctcactactttggcctagggaccaggtgagatacaaacgactgtgctgcacatctg

SEQ ID NO: 269975 - DNA, 510 bp, Homo sapiens
  misc_feature: GYAE6OF01CAKVS.39.50.E06.1.454.CMB.1.raw
  modified_base (204)..(204): a, c, t, g, unknown or other
  misc_feature (204)..(204): n is a, c, g, or t
  modified_base (421)..(421): a, c, t, g, unknown or other
  misc_feature (421)..(421): n is a, c, g, or t
tcagtcgcactagtcacgaccggtgctcgatttagatctactgacaacacacaagggggaggaactgctcagttaggacccagacggaaccatggaagccccagcgcatcttctcttcctcctgctactctggctcccagataccactggagaagtagtgatgacgcagtctccagccaccctgtctgtgtctccaggggaaangccaccctctcctgcagggccagtcagactatagcagcaacttagcctggtaccagcaaaaacctggccagactcccaggctcctcatgtatggtgcgtccaccagggccactggtactcccagccaggttcagtggcagtgggtctgggacagagttcagtctcaccatcagcagcctgcagtctgaagtattttgtacttttattactgtacagnagtatgatacctgcctcactctttggccgtagggacctaggttggagtatacgaaacgacgtgtacggtctcgacctacctatcgtacg

SEQ ID NO: 269976 - DNA, 542 bp, Homo sapiens
  misc_feature: GYAE6OF01B8N17.39.50.E06.1.454.CMB.1.raw
  modified_base (427)..(427): a, c, t, g, unknown or other
  misc_feature (427)..(427): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactattagcagcaacttagcctggtaccagcaaaaacctggccagactcccaggcctcctcatgtatggtgcgtccaccagggccactggtatcccagccaggttcagtggcagtgggtctgggacagagttcagtctcacatcagcagcctgcagtctgaatattttgtactttattactgtcagtctagtatnattacctaggccttactactaccttttgggccgtacggggtaccctagggttaggtacggtataccgtaaaacggaacgttggtcggtacttaggacctaccctaagttcgttcg

SEQ ID NO: 269977 - DNA, 533 bp, Homo sapiens
  misc_feature: GYAE6OF01DOM5S.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactattagcagcaacttagcctggtaccagcaaaaacctggccagacctccaggctcctcatgtatggtgcgtccaccgagggcccactggtactccccagccaggttcagtggcaggtgggtctgggacaggagttcagtctcaccatcagcagcctgcagtctgaagtattttgtacttttatcttgtcagctagtatgattacctggccctcactacgtttcggcccgtaggggcctaggggttggaacgtataccgaaacggacgttggacggtctacggaccaacctgttcgttcg

SEQ ID NO: 269978 - DNA, 530 bp, Homo sapiens
  misc_feature: GYAE6OF01EJDRG.39.50.E06.1.454.CMB.1.raw
  modified_base (205)..(205): a, c, t, g, unknown or other
  misc_feature (205)..(205): n is a, c, g, or t
  modified_base (523)..(523): a, c, t, g, unknown or other
  misc_feature (523)..(523): n is a, c, g, or t
tcagtcgcactagtcacgaccggtgctcgatttagatctactgacaacacacaagggggaggaactgctcagttaggacccagacggaaccatggaagcccccagcgcagcttctcttcctcctgctactctggctcccagataccactggagaagtagtgatgacgcagtctccagccaccctgtctgtgtctccaggggaaangccaccctctcctgcagggccagtcagactatagcagcaacttagcctggtaccagcaaaaacctggaccagactcccaggcctcctcatgtatggtgcgtccaccagggccactggtactcccagccaggttcagtggcaggtgggtctgggacagagttcagtctcaccatcagcagcctgcagtctagtaagtattttgtactttattactgtcagctagtatgtactaccgtggtcctcacctacgttttcggaccgtaggggtacctagggttaggagtatacgaaacgtaactggtcggtctagaccaaccntcgttcg

SEQ ID NO: 269979 - DNA, 560 bp, Homo sapiens
  misc_feature: GYAE6OF01CQ85I.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagactatagcagcaattagcctaggtaccagacaaaaaccgtcggaccacgacctcccgaggcctcctcatgtagtggtcgccgtaccacgacgggccacgtgtactccacgcgtaggttcaggtggcgtaggtgggtcgtagggacaggtacgttcgagtctcacatacgagcacgcgtgctagtactaggtacgttattttagttactttatacgtgtacagtactagtatcgtactaccgtgccttacgtacttacgtttcggaccgtagggacctaggttggacgtatacggaaacgtactggtacgtctacgcactgtcgtcg

SEQ ID NO: 269980 - DNA, 508 bp, Homo sapiens
  misc_feature: GYAE6OF01AYH0B.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactattagcagcaacttagcctggtaccagcaaaaacctggccagactcccaggctcctcatgtatggtgcgtccaccagggccactggtatcccagccaggttcagtgcagtgggtctgggacagagttcagtctcaccatcagcagcctgcagtctagaagtattttgtactttattactgtcagcagtatgataccgtgcctcactacgtttcggccgtaggggaccagggttggagtatacgaaacgtacgtgtaggctagacacatcgtcg

SEQ ID NO: 269981 - DNA, 567 bp, Homo sapiens
  misc_feature: GYAE6OF01BI2AW.39.50.E06.1.454.CMB.1.raw
  modified_base (205)..(205): a, c, t, g, unknown or other
  misc_feature (205)..(205): n is a, c, g, or t
  modified_base (408)..(408): a, c, t, g, unknown or other
  misc_feature (408)..(408): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtctccaggggaaanagccaccctctcctgcagggccagtcagactattagcagcaacttagcctggtaccagacaaaaacctggaccagactcccaggctcctcatgtatggtgcgtccaccgagggccacgtggtactcccagcctaggttcagtggcaggtgggtctgggactaggagttcgagtctcacatcagcagcctgcagtctagaagtnttttgtactttattactgtcagctagtatagacttaccgtcggtaccttctacttacgtttcggaccgtacgggggtaccctaggggttacggaacgtactaaccggtaaaacgtaacgttgggtaccggtacgttacgacctacctagttcgttaccg

SEQ ID NO: 269982 - DNA, 633 bp, Homo sapiens
  misc_feature: GYAE6OF01B64NK.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcagggccagtcagacttattagcagcaacttagcctggtaccagacaaaaacctggaccagacctcccaggctcctcatgtagtggtcgccgtaccaccgacgggcctacgtggttacctcccgacggccgtacggttcgaggtcggacgtaggttcgggtcgtagggacaggtagttcgagtcctacaccgtatccgacgcgacgcccgtgacctacgttctaggttaagttagtttttacggttacttttattacgttgtaccgagtacttaagttactagtacttaccgtcggtacccttacgtaccttacggtttcggaccggtaacggggtaccgtagggttacggacgtaacgtaacggtaaacgtacgttcggtagtccgtacggacctacctcgttcgttacg

SEQ ID NO: 269983 - DNA, 665 bp, Homo sapiens
  misc_feature: GYAE6OF01DO593.39.50.E06.1.454.CMB.1.raw
  modified_base (151)..(151): a, c, t, g, unknown or other
  misc_feature (151)..(151): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
tcagtcgcactagtcacgaccggtgctcgatttagatctactgacaacacacaaggggagaactgctcagttaggacccagacggaaccatggaagcccagcgcagcttctcttcctcctgctactctaggcttcccagataccactgganaagtagtgatgacgcagtctcagccacctgtctgtctctcaggggaancgccacctntccgtgcaggccagtcagctattgcagcaactcgctacgtacacgacaaacgtcgacctacgtacctaccgacgtccttaccgtacgtacgttacgtacgtcggtcgtccgtaccgacgtacggtaccgtacgtacgtacgtaccgacgtaccgtacggttacgtacgtacggtacgtacggttcggtacgtacggtacgtacgtacgttcgtacgtccgtacgtacgtacgttacgtacgtacgtacgtccgtacgtacgttacgttacgtacggttacgtttacgtttacgttacgtttacgtacgttcgtacgtacgtacgttacgtacgttacgtacgttacgtacgtaccttacgttacgttacgttaccggaccgtacggtaccgtaggttacggtacgtacgttacgtaacgtaccgtaggtacgtacgtacgtacctacgttgtcgtcg

SEQ ID NO: 269984 - DNA, 495 bp, Homo sapiens
  misc_feature: GYAE6OF01AH9B3.39.50.E06.1.454.CMB.1.raw
  modified_base (204)..(204): a, c, t, g, unknown or other
  misc_feature (204)..(204): n is a, c, g, or t
  modified_base (490)..(490): a, c, t, g, unknown or other
  misc_feature (490)..(490): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactatagcagcaacttagcctggtaccagcaaaacctggccagactcccaggctcctcatgtatggtgcgtccaccagggccactggtatcccagccaggttcagtggcagtgggtctgggacagagttcagtctcaccatcagcagcctgcagtctgagattttgtactttatactgtcagcagtatgtataccgtggcctcactactttggccaggggaccagggttggagtatcaaacgacgtgtggctgacacntctcg

SEQ ID NO: 269985 - DNA, 563 bp, Homo sapiens
  misc_feature: GYAE6OF01AO6X6.39.50.E06.1.454.CMB.1.raw
  modified_base (204)..(204): a, c, t, g, unknown or other
  misc_feature (204)..(204): n is a, c, g, or t
  modified_base (410)..(410): a, c, t, g, unknown or other
  misc_feature (410)..(410): n is a, c, g, or t
  modified_base (456)..(456): a, c, t, g, unknown or other
  misc_feature (456)..(456): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangctaccctctcctgcagggccagtcagactattagcagcaacttagcctggtaccagacaaaacctggccagactcccaggctcctcatgtatggtgcgtccaccagggccacgtggtactcccgaagcctaggttcagtcgggcgtaggtgggtcgtgggacaggtagttcagtctcacctatcagcagcctgcagtctagaatnttttgtactttatactgtcagctagtatcgacttaccgtgtcctanaccttaccgtttcggacccgtaggggtaccctaggggttacggtacgtaacgtaccggtaaacgtaaccgtggttacgggcctagacccgaaccttagtccgttacg

SEQ ID NO: 269986 - DNA, 614 bp, Homo sapiens
  misc_feature: GYAE6OF01DXAMZ.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcgagggccagtcagtactatagcagcaacttagcctggtaccagacaaaaacctcggaccacgacctccgaggcctcctcatgtatggtcgccgtccaccgacggcctacgtcggtactcccgagtccgtaacggttcaggtcggcgaggttcgggtcgtagggactaggtagttcgacgtcctacgacctatcgacgcacgtccgtgactagtcgtagtaagttacttttagttacttttagttactgtactagtctaagttctagtacttaccgtcggtccttacgtacgttacgtttcggccgtaacgggtacctagggttacggaacgtaataccgtaaaacggtacgttaggtacggtcgtacggacctaccgtgttccgtttaccg

SEQ ID NO: 269987 - DNA, 515 bp, Homo sapiens
  misc_feature: GYAE6OF01BJGO1.39.50.E06.1.454.CMB.1.raw
  modified_base (204)..(204): a, c, t, g, unknown or other
  misc_feature (204)..(204): n is a, c, g, or t
  modified_base (508)..(508): a, c, t, g, unknown or other
  misc_feature (508)..(508): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagcaaaaacctggccagacctcccaggctcctcatgtatggtgcgtccaccagggccactggtactccccagccaggttcagtcggcaggtgggtctgggacaggagttcagtctcaccatcagcagcctgcagtctgaagtattttgtactttattactgtcagctagtatgtatacctggcctcactctttggcctaggggtcctaggttggagtagtacaaacggactgtcggtctacgacacctntcgttcg

SEQ ID NO: 269988 - DNA, 557 bp, Homo sapiens
  misc_feature: GYAE6OF01BPFOO.39.50.E06.1.454.CMB.1.raw
  modified_base (204)..(204): a, c, t, g, unknown or other
  misc_feature (204)..(204): n is a, c, g, or t
  modified_base (446)..(446): a, c, t, g, unknown or other
  misc_feature (446)..(446): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagacaaaaacctggaccagactcccaggctcctcatgtatggtgcgtccaccagggccactggtatcccagccaggttcagtggcagtgggtctgggacagagttcagtctcaccatcagcagcctgcagtctagaagtattttgtactttattactgtctagctagtatgtactaccgtggccttnaccgtacttttcggccgtaacggggtacccgtaggggttcggaacgtagtaccgtaaaaccggtaacgttaggtacgggtaccttcggacccaccctacgtccgttaccgg

SEQ ID NO: 269989 - DNA, 540 bp, Homo sapiens
  misc_feature: GYAE6OF01CO4ZA.39.50.E06.1.454.CMB.1.raw
  modified_base (204)..(204): a, c, t, g, unknown or other
  misc_feature (204)..(204): n is a, c, g, or t
  modified_base (411)..(411): a, c, t, g, unknown or other
  misc_feature (411)..(411): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctctgcagggccagtcagactatagcagcaacttagcctggtaccagacaaaaactggaccagactcccaggctcctcatgtatggtcgccgtccaccgagggcccaacgttggtactcccgacgcctaggttcagtggcaggtgggtctgggacaggtagttcgatctacacatcagcagcctgcagtcagtaagtnttttgtaactttatactgtacagtcagtatgtactacgtgacttcacgttctttcggacctacggggacctagggttgaacgtataaccaaaacgtacgttggcggtacgtacgaccactagtgttacg

SEQ ID NO: 269990 - DNA, 556 bp, Homo sapiens
  misc_feature: GYAE6OF01AYWOJ.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagactatagcagcaactagcctggtaccagacaaaaacgtggaccagactcccaggtcctcctcagtgttagtggtcgccgtccaccgacgggcctacgtggtactccccagcctaggttcaggtggcgtaggtcgggtcgtgggactaggtacgtcgagttctacacctagtcagccacgtcctgcagttctagtaagttcttttagtacttttagttactgtacagtctagttatgtactccgtgtccttcgacttcgttcggccgtagggtacctagggttgacgtatacgaaacgtagtgtggtactcgacactgtcgtcg

SEQ ID NO: 269991 - DNA, 561 bp, Homo sapiens
  misc_feature: GYAE6OF01E3PZ6.39.50.E06.1.454.CMB.1.raw
  modified_base (205)..(205): a, c, t, g, unknown or other
  misc_feature (205)..(205): n is a, c, g, or t
  modified_base (445)..(445): a, c, t, g, unknown or other
  misc_feature (445)..(445): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtctccaggggaaangcccacctctcctgcagggccagtcagactatagcagcaacttagcctggtaccagacaaaaacctggccagactcccaggctcctcatgtatggtgccgtccaccagggcccactggtactccccgagccctaggttcaggtggctaggtgggtctgggacagtacgttcagtctcaccatcagcacgcctgctagtcgtagaagtattttgttacttttattacttgtctagctagtntagactaccgtgccttctacgtacgtttcggccgtacggggaccctagggttacgggacgtaagtaacgaaaccggtaacgttcggtaggtccgttagaccaacctgttcttaccg

SEQ ID NO: 269992 - DNA, 597 bp, Homo sapiens
  misc_feature: GYAE6OF01BB5WZ.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagactattagcagcaacttagcctgtaccagacaaaacctgaccagacctcccaggcctcctcagtgtagtggtgccgtaccaccgacggcctacgtcggtactcccgagcctaggttcaggtggcgtaggtcgggtcgtagggacaggtacgttcgacgtctaccgacatacgacgcgacgtcctgacgtagtctagtaagttattttacgttactttattactgtacagtacgtagtatagtacgttaccgtcggtacctacgtacgttacgtttcggaccggtacgggtaccgtagggttacgaacggtagtaacgaaaacggtacgttggtacggtactacgacctaccgtagttcgttaccg

SEQ ID NO: 269993 - DNA, 584 bp, Homo sapiens
  misc_feature: GYAE6OF01BCF8R.39.50.E06.1.454.CMB.1.raw
  modified_base (204)..(204): a, c, t, g, unknown or other
  misc_feature (204)..(204): n is a, c, g, or t
  modified_base (413)..(413): a, c, t, g, unknown or other
  misc_feature (413)..(413): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagacaaaaacctggaccagacctcccaggcctcctcatgtatggtgccgtccaccgacgggccactggtactcccgagcctaggttcaggtggcgaggtgggtcgtgggacaggagttcagtctcaccatcagcagcctgcagtctagtaagtnttttagtacttttattacttgtacagtctagttatagtactaccgtcggtcccttacgtaccgttacgttttcgggaccgtacggggtaccgtaggggttacggaacgtagtaccggaaaccggtaacgttgggtacgggtactacggtaccctaccgtagttccgttacg

SEQ ID NO: 269994 - DNA, 657 bp, Homo sapiens
  misc_feature: GYAE6OF01CVYW9.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcacgggccagtcagactatagcagctaacttagcctggtaccagacaaaaacctggaccagacctcccgaggctcctcatgtatggtgccgtccaccgagggcctacgtggtactcccagtcccgtaggttcagtcgggcaggttcgggtcgtagggacgtaggtacgttcaggtcctacaccgtatccgaacgcgaaccgtccttgactaggttcctaaggtaaagttagtttttacggttaacttttaacgttaccgttgtaactacggtactaacggtttcgtacggtacttaacccgttcggtacccttacgtaacccgttacgttttacgggacccgtaacggggtacccgttagggtacggtagtaacctaacggaaaacggtaccgttggtacgggtcctacggtacccaaccgttgtccgtttaccgg

SEQ ID NO: 269995 - DNA, 632 bp, Homo sapiens
  misc_feature: GYAE6OF01CM6MX.39.50.E06.1.454.CMB.1.raw
  modified_base (209)..(209): a, c, t, g, unknown or other
  misc_feature (209)..(209): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtcctccgaagggggaaanacgcccaccctctccgtgcgagggccagtcagactatagcagactaacttagcctggaccagaacaaaaaccgtcggaccagacctcccgaggcctcctcatgtatcggtgccgtaccaccgacgggaccacgtcggtactcccgacgccgtaggttcaggtggcgtaggtcggggtcgtgggactaaggtagttcgaggtcctacaccatcgagcacgcctgacgtagtactaggtaagttattttacgtttaactttatttactgtacaagtacgtaagttaatgtaacttacccgtggtaccctactaccgttacggttttacgggacggtaacggggtaccgttagggttaggaaacgttagtaaccgtaaaacgtacggttaggtacgtacgtacgactaccgtacgttcgttaccgg

SEQ ID NO: 269996 - DNA, 721 bp, Homo sapiens
  misc_feature: GYAE6OF01BJ5DG.39.50.E06.1.454.CMB.1.raw
  modified_base (152)..(152): a, c, t, g, unknown or other
  misc_feature (152)..(152): n is a, c, g, or t
  modified_base (203)..(203): a, c, t, g, unknown or other
  misc_feature (203)..(203): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactgganaagtagtgatgacgcagtctccagccaccctgtctgtgtctccaggggaancgccaccctctcctgcaggccagtcagactatagcagcaacttagcctggtaccagacaaaaccgtcgaccacgactcccgaggcctcctacatgtagtcggtcgtccgtacccaccgtacgggcccacgtcggtactccccagcccgaggttcaggtggaccgtaggttggggtccgttaggggaccgtaaggtacggtttaccgaaggttccctaccgtaacccgtacttaccgacggtaccgtaacggtccccttaggacccttacggttaccgtaaggttaacgtttacgttttttacgggtttaaacctttttacgttttaccgttacggttaccgtaacggttacttaaacggtttaacgttaccgggtaacgtttaaccccggtcggttacccttaccgtaaccgtttaccggttttaccgggacccggtaacgggggtccgtaaggggtttggaaacgtacgtaaccgaaacggtacgtggttacggtctcggaccactacgttcgtacg

SEQ ID NO: 269997 - DNA, 716 bp, Homo sapiens
  misc_feature: GYAE6OF01BLSU3.39.50.E06.1.454.CMB.1.raw
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (369)..(369): a, c, t, g, unknown or other
  misc_feature (369)..(369): n is a, c, g, or t
tcagtcgcactagtcacgaccggtgctcgatttagatctactgacaacacacaagggggagaactgctcagttaggacccagacggaaccatggaacgccccagcgcagcttctcttcctcctgctactctggcctcccagactaccactggaagaagtagtgatgacgcagtcctccagccacctgtctgtcgtctcgaaggggaancgcccaccctctaccngccgagggccagtcagtacttatacgctagactaacttagccgtacggtaccacgaaccaaaaccgtcgaccacgacctacccgaggtcctccgtactagttacgtagtcggtcgccgtaccacggacggcctacgtacgtaccnccgagccgtaggttcaggtcgtacgtaggtcggtcgtggacgtagtacgtcgtagtcctaccaccgtagtacgtacgccgacgtaccgtgtaccgtagttaccgtaggttaacgtttagttttaacgtttacgttttactttacgtacgttacgtacgtacttaaggttacgttacggttaacccttaccggtacccgtacttacccggtaaccgtttaccgggtttaccggaccggggttaaaccggggtacgttacgggggtacggacgttaaacggttaaccggtaaacgttaccgggtggtaccgggtacgttacccggacctaaccttcgttcggtttaccg

SEQ ID NO: 269998 - DNA, 641 bp, Homo sapiens
  misc_feature: GYAE6OF01COCCJ.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctccagataccactggagaagtagtgatgacgcagtctccagccaccctgtctgtgtctccgaggggaaancgccacctctctgcgaggccagtcagactatagcagcaacttagcctggtaccagaacaaaaaccgtcggaccagacctcccaggcctcctcactgtagtcggtcgccgtccaccgacgggcctacgtcggtacctccgacgccgtaggttcaggtggcagggttcgggtcgtgggactaggtacgtttacgagttcctaccaccgataccgagccgacgcctcgacgtacggttactaaggtaagtttacgtttttacgttaacctttttagtacgttgtactaagtctaagttctaaggtacttaccggtcggtacccttacgtaacgtttacgtttcggaccggtaacggggtaccgtaggggttacggaacggtaataaccggtaaacgttacggtcggttacgccgttacgaccgtaacttgttcgtttccg

SEQ ID NO: 269999 - DNA, 561 bp, Homo sapiens
  misc_feature: GYAE6OF01BKB42.39.50.E06.1.454.CMB.1.raw
  modified_base (204)..(204): a, c, t, g, unknown or other
  misc_feature (204)..(204): n is a, c, g, or t
  modified_base (324)..(324): a, c, t, g, unknown or other
  misc_feature (324)..(324): n is a, c, g, or t
  modified_base (363)..(363): a, c, t, g, unknown or other
  misc_feature (363)..(363): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcgagggccagtcagactattagcagcaacttagcctggtaccagacaaaactgccagactcccagctctcatgtatggtcgcgtccaccgaggccacgtggtacncccagcctaggttcagtggctaggtgggtctgggacagngttcagtctcaccatcgacgcgagtcctgcagtcgtagtaagttattttagttaacttttagttacgtgttacagtactagttagtgtactaccgttcggtccctacgtacctacgtttcggaccggtacggggtaccgtagggttcggaagtactacgaaacgtacgtggtacgtcgtacgacctaccagtcgttcg

SEQ ID NO: 270000 - DNA, 636 bp, Homo sapiens
  misc_feature: GYAE6OF01AJG4H.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagaccaaaaccgtggaccagacctcccgaggcctcctacatgtactggtcgccgtcccaccgacgggtccacgttcggtactccccgagtcccgtaggttacaggtcggcaggtcgggtcgtgggacaggtacgttcagtctcaccatcgacgcagtccgtgcgtacgtctagtaacgttatttttcgttaacttttattacgttcgtacacgtcgtagttacgtgtaccttaccgtcgtacccttacgtaccgttaccggttttcggaccggtacggggtaccgttaggggttacggtacggtacgttaaccggaaaccggttaccggttacgggttacggtaccgttacgacccgtacctacgttccgtttaccg

SEQ ID NO: 270001 - DNA, 698 bp, Homo sapiens
  misc_feature: GYAE6OF01B1K9V.39.50.E06.1.454.CMB.1.raw
  modified_base (209)..(209): a, c, t, g, unknown or other
  misc_feature (209)..(209): n is a, c, g, or t
  modified_base (452)..(452): a, c, t, g, unknown or other
  misc_feature (452)..(452): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggcctcccagataccactggagaagtagtgatgacgcagtctccagcccaccctgtctgtcgtctaccgaggggaaancgccaccctctcctgcgaggccagtcagtactattagacagactaacgttacgcctacggtaccaacgaacaaaaaccgtcggaccacggacctacccgaggtcctacctactagttagttacgtcggtccgtccgtacccgaaccgcggtacctacgtcgtacctccgacgtccgtaggtcgaggtcggacgtaggtcggtcgtacgggataggtcgttacacgtactaccacgtatccganacgacgtccgtagtcgtaacgttacgtaacgttaagtttacttttagttaactttacgtttacgtacgtacgtagtaccgtaagttcgtaacggttcccttaacgggtccgtacccttacgttaccgtttacggtttacggaccggttaacgggtaccgttaggggtaccggtaacgtaacgtaaaccgtaaacgggtacgttagggtcccggtaacctacggtaccctaacgtcgttcgttaccg

SEQ ID NO: 270002 - DNA, 554 bp, Homo sapiens
  misc_feature: GYAE6OF01BF7YA.39.50.E06.1.454.CMB.1.raw
  modified_base (205)..(205): a, c, t, g, unknown or other
  misc_feature (205)..(205): n is a, c, g, or t
  modified_base (411)..(411): a, c, t, g, unknown or other
  misc_feature (411)..(411): n is a, c, g, or t
  modified_base (442)..(442): a, c, t, g, unknown or other
  misc_feature (442)..(442): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccagggggaaangccaccctctcctgcagggccagtcagactattagcagcaacttagcctggtaccagacaaaaacctggccagactcccgaggcctcctcatgtatggtcgccgtccaccgagggcccactggtactcccagccaggttcagtggcaggtgggtcgtgggacaggagttcagtcctacaccatcagcagcctgcagtctgtaagtnttttgtactttattacgtgtacagtctagtntagtactaccgtgtccctacgtacttaccgtttcggacccgtaggggtaccgtagggttggagtactacgtaaacgtacgttggtacggtccgttgaccncctntccgttcg

SEQ ID NO: 270003 - DNA, 667 bp, Homo sapiens
  misc_feature: GYAE6OF01DH6HX.39.50.E06.1.454.CMB.1.raw
  modified_base (152)..(152): a, c, t, g, unknown or other
  misc_feature (152)..(152): n is a, c, g, or t
  modified_base (208)..(208): a, c, t, g, unknown or other
  misc_feature (208)..(208): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactgganaagtagtgatgacgcagtctccagcccaccctgtctgtcgtcctccgaggggaaancgccaccctctcctgcgagggccagtcagactatgcagcaattgctggacagacaaaactggaccagacctccgagccttccgtcagtagtacgtggtcaccgtaccaccgacggcctacgtcggtacctacccgacgtaccgtacggttcgaacggttcggacgtagggttcggggtccgtacgggtaacgtaggtacgttaccgtacggtaccgtacctaccgtacgtaccgacgaccgtacggtccgtcggaccgtacggttaccgtaaggttaaagtttccttttaacggtttaacttttacgttactcggtaccgtagtaccgtagtttacgtacgtacttccgttacgtaccctcttaaccgttcggtttacggaccggtacgggtacgtaagggtcggaactagtaaaccgtaacggagttcggacgtcctacgaacctctacgtcgttacg

SEQ ID NO: 270004 - DNA, 711 bp, Homo sapiens
  misc_feature: GYAE6OF01BCVJP.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtctccaggggaaangcccaccctctcctgcagggccagtcagactattagcagcaacttgcctggtaccagaccaaaacctggaccagacctcccaggcctcctcagtcgtagtcggtacgcgtccacgacggccacgtcgtactcccgagtccgaggttcgaggtcggacgacggttgggtaccgtacggggaacgtagggtacgtttcgacggttcctaccgaaccctagtaccgacgtaccgacgtcccgttacgaccgtagttcgttaaggtaacgtttagtttttacgtttaacgttttaacgtttacgttacgtcgtaacgtacctaaggtttactacggttactaccggttcggtacccttaccgtaaccgttacggttttaccgggacccggttaacgggggtaccgttaaggggttacgggtaccggttaaacgtaacccgggtaaaaccggtacggttcgggtacgggtacccgttacgaaccccgtacgttaccgttccggtttaccgg

SEQ ID NO: 270005 - DNA, 620 bp, Homo sapiens
  misc_feature: GYAE6OF01EWMMU.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaanagcccaccctctcctgcagggccagtcagactattagcagcaacttagcctggtaccagaccaaaaacctggaccacgacctcccgaggcctcctcatgttagtggtcgtccgtaccaccgacggccacgtggtactcccagccgtaggttcagtcggcgtaggtcgggtctaggggacaggtacgttcgagttcctacaccatcgacgcacgccgtgacctagtactaggtaattagtttttacgttaacttttacgttacgttcgttacgacgtacgtaagttacgtacgtacgttacccgttcggtacccttactaccgttacggttttcggaccggtacggggtaccgtaagggttcgggaacgtaacgtacgaaacgtacgtggtacggtctacgactacgtgtcgttcg

SEQ ID NO: 270006 - DNA, 811 bp, Homo sapiens
  misc_feature: GYAE6OF01B0WT5.39.50.E06.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (314)..(314): a, c, t, g, unknown or other
  misc_feature (314)..(314): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtcgtctaccgaggggaaacncgcccacctctcctgcagggccagtcagactagtacgnagactaactacgcctcggtaccaacgaacctaaaaccgtcggaccagacctccgacggtcctcctanacgttagtacgtcgggtcgccgtaccgacggacgggtacctacggtcggtacctaccccgacggtaccgtagggttacgacgggttacgggaccgtaagggttccggggtaccgtacggggacctaacggttacggtttacgtaaccggttacctaacccgaaccttacgttaccgacggttaccgaaccggttcccgtacggaccgttaacggtttaccgtaaacggttaagttttacggttttttaacgttaaaccgtttttacgttaccgttacgtttaacgtaacgggttaaccttaggtttaccgtaacgttacccgttaccgttaaccggttccttaaccggttaacccgtttacgggtttaacccgggccgggttaaacggggtacccttaagggggtttacgaaacggttaccgtaaaacccggtaaacggttacgttacgggttacccggtaacttaccggtaccttaacgtccgttaccgtttaccg

SEQ ID NO: 270007 - DNA, 783 bp, Homo sapiens
  misc_feature: GYAE6OF01A1IXR.39.50.E06.1.454.CMB.1.raw
  modified_base (203)..(203): a, c, t, g, unknown or other
  misc_feature (203)..(203): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaancgcccacctctcctgcgagggccagtcagactatgcagcaactacgcctcggtaccagaccaaaaccgtggaccagacctccgacgcctcctcattggtagtcggtcgccgtccaccggacgggcctacgtcggtactaccgacgtcccgtaggtcgacggtcggcgtaggtcgggtcgtagggactaggtacgttactacggtcctactaacccgattaccgagtaccacgtcccgtaggtaccaacggttcgtaacggtaaagtttacgtttttaacggtttaaccttttaacgtttaccgttaggttaccgtaaacggttccttaacggttaacgttacgttaacccgtacccgtttaccgggttccctttaaccggttacccgttttaccgggttttacccgggaaccccggggtttaacgggggttaaccccggttaaaggggggtttaaccgggtaaccggttaaaccggttaaacccggtaaaaaaccgggttccgggtttaaacggggaccgggttaacccgttacccggtaaacccgttaacccggtaaccgttttccccggttaaccggg

SEQ ID NO: 270008 - DNA, 638 bp, Homo sapiens
  misc_feature: GYAE6OF01BNZDT.39.50.E06.1.454.CMB.1.raw
  modified_base (173)..(173): a, c, t, g, unknown or other
  misc_feature (173)..(173): n is a, c, g, or t
  modified_base (202)..(202): a, c, t, g, unknown or other
  misc_feature (202)..(202): n is a, c, g, or t
  modified_base (424)..(424): a, c, t, g, unknown or other
  misc_feature (424)..(424): n is a, c, g, or t
  modified_base (484)..(484): a, c, t, g, unknown or other
  misc_feature (484)..(484): n is a, c, g, or t
  modified_base (619)..(619): a, c, t, g, unknown or other
  misc_feature (619)..(619): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagactaccactggagaagtagtgatgacgcagtcncagccacctgtctgtgtctcgaggggaancgccaccctctcctgcgacgggcagtcagactatagcagctaacgttagccgtacggtacagaacaaaacgtcggacacgacctaccgacggctacctctagtcgttagtcggtcgtccgtaccgaccggacggacctacgtcggtaccgtcccacggaccgtacggtcgaggtcggcgtaggtggtcgtagggacgtacggtacgttcgagtcctcaaccntacgacgcacggtctgactagtatacgtagtttacttttagttactttacgttctgtacnggtatagttatacgtactaccgtggtaccttacgtaccgttacggttacgggtaaccggtacggggtacggttacgggtacggtaggtaacgtaaccggtaaacggtacggtcggtacgtaccgtacgtaacccnccgttacgtcgtttaaccg

SEQ ID NO: 270009 - DNA, 882 bp, Homo sapiens
  misc_feature: GYAE6OF01CY4WK.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggcctcccagactaccactggagaagtgtgatgacgctagtcctccacgcccaccctgtctgtcgtctaccggaaggggaacaccgtcccacccgtctccgtaggccgacggtccagtacacgtacttagtacgacgtagtacctaaacgttcgtaccgtacggtaacccaaacggaaaccctaaaaaccggttccggaaccgtaaccgtaacccgtacccccggtacggtacccttaccctaaccggtagtttacggttaacgttcggtaccccgtaccggtaccccaccgggtaccgggtaccctaccgggttaaggttacccacccgtaaccgtacggttaacggggtcctagggtaccggcgggtaacggttcggggttaaccaggggtaaccttaacggggttaacttccgtaacggtttacccctaaaccgaccgtaaacggttccgaaacggtcccggtaacccgttcggtaccgttaacgtaccggtttaagttaaacgttttaaacgttttaccggttttttaagtttaaacttttaccggtttacgtaacggtttcccaaggtttaacccgttaaggttacgtaaacccggttacctttacccccggtagggtaccccttacgttttacccggttagtttaacccgggggaccgtaagggtaccgttagggtacgtagttaacccggaaacgttactcggttagttacgggtactctaaaccgtacgttcgtcgttacccg

SEQ ID NO: 270010 - DNA, 654 bp, Homo sapiens
  misc_feature: GYAE6OF01E34KY.39.50.E06.1.454.CMB.1.raw
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (307)..(307): a, c, t, g, unknown or other
  misc_feature (307)..(307): n is a, c, g, or t
  modified_base (430)..(430): a, c, t, g, unknown or other
  misc_feature (430)..(430): n is a, c, g, or t
  modified_base (641)..(641): a, c, t, g, unknown or other
  misc_feature (641)..(641): n is a, c, g, or t
tcagtcgcactagtcacgaccggtgctcgatttagatctactgacaacacacaagggggaggaactgcttcagttaggacccaggacggaaccatggaagccccagcgcagcttctcttcctctgctactctggcctcccagataccactggagaagtgtgatgacgcagtctcagcccaccctgtctgtntctaccgaggggaaancgccaccctntcctgccgagggccctaggtcagtacctagtagcagctacttagcctggtaccagacaaaaccgtgaccacgacctcccaggtcctaccnctagtgttagtcggtgtcccgtaccgaccggacgggccctaacgtggttaccgtccccagtcccgtagtttccgaggtggcgtacggtgggtcgtagggacaggttcgtcacggtcctcgacncgtcgaacgccgacgtcgtagcgtaacgttcggagttaagttagtttttcgttaacgtttagttactcgttacagtactagttacgtagtaccgtccgttaccgactttacgactttacggtttcgggacccggtagggtacccgtagggttacggagtaaccgttaacggtaaaccgagttcgggttacgtacctcggtaaccctggttnttcccgttaccgg

SEQ ID NO: 270011 - DNA, 722 bp, Homo sapiens
  misc_feature: GYAE6OF01E4RZP.39.50.E06.1.454.CMB.1.raw
  modified_base (711)..(711): a, c, t, g, unknown or other
  misc_feature (711)..(711): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctaccgaggggaaagacgcccaccctctccgtgccgtagggccagtcagaactagttagacacgctaacttacgcctaggtaccaacgaccaaaaacccgtcggaccagtaccctcccgacggccttccctacagtcgtagtcggtggtccgtacccaccgtacgggaccctaccgtcgggtaacctcccgacgccgtacggttacgtacggtcggacggtaaggtcgggttacggcggggtaactaggtacgttacgtacgttcccgaccgtaacctacgttccgacgaaccgtcgtacccggtgtacccgtagtaccgttaaggttaacgttttacgtttttacgtttaacttttaactttacggttacgttacgtacgtacgttaagtacgtaacgtacttacccgtacgttacctacgttaacgttacggtttaccgggtaccgggacggtaccggtaaggtacggtaagtactaaacgaaccgtaggttcggaacggtcgtacgacctaccgttntccgtttaccg

SEQ ID NO: 270012 - DNA, 736 bp, Homo sapiens
  misc_feature: GYAE6OF01CJK91.39.50.E06.1.454.CMB.1.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctccagataccactggagaagtagtgatgacgcagtctccagcccaccctggtctgtgtcctccgaaggggaaancgccaccctntcctgcgaggccagtcagacttagtagcagacctaatacgtccgtacggtaccaggaacctaaaaaccgtcggaccacggacctacccgacggtcctaccctcaagttcgttaacgtcgggtacgtcccggtacccgaaccggtacggggaccctaacggttccggtaaccttaccccggacggtacccgttacgggttacgtaacgggtcgggtacgtagggtcggggtaccggtacggggtaacgtaacgggtacgttcgtaacggttccctaccgaacctacgtacccaagggcctaccggtaccgtaggtacccgtaagttaccgtaagtaagttacgtttttacgttaacgttttaatcgttagtactagacctaggtaacgtacgtacgtacccgtcgtcctacgttaacccgttacgttcgggaaccggtcgggtaaccgtagggtacggtaacttagaaccgtaacggtacgtcggtacggtctacgtaccgtaacctgttccgttaccg

SEQ ID NO: 270013 - DNA, 723 bp, Homo sapiens
  misc_feature: GYAE6OF01C60WF.39.50.E06.1.454.CMB.1.raw
  modified_base (175)..(175): a, c, t, g, unknown or other
  misc_feature (175)..(175): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctccagactaccacgtggagaagtagtgaatgacgcagttcnccagcccacctgtctgtcgtctccgaaggggaaagcgcccacccttcgtaccgtggcgacgggaccaggttacagacttagtacgcaggacctaacttacgacctaggtaccaacgaaccgaaaaaccgttcgggaccaacgtaccgtacccgacggccttaccctacgtacgttacgtagtcggtcgtccgtaccgaccggacgggtacccacgttacggtacctacccgacgtaccgtacggttacgaggtacggcgtaggttcgggtacggtagggtacgaacggtacgtttacgaccggttacgtacccgtacgactaccgacgacgtacgtccgtacgtaccgtagttaccgtaggtttaaacgttacgtttttagtttaacccgttttatttaccgttggtaacgtacgtacgtaagttacgtacgtactacccggtatccctacttacgttacgttccggacggtacgggacgttagggttacgacgtaacacggtaaaacgtacgtaggtcggtacctacgtacctactgttccgttacg

SEQ ID NO: 270014 - DNA, 632 bp, Homo sapiens
  misc_feature: GYAE6OF01EQ8ZK.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctccagataccactggagaagtagtgatgacgcagtctccagccaccctgtctgtcgtctccgaggggaaagacgccaccctctcctgcgacgggccagtcagactatagcagcaacttagccgtcggtaccacgaccaaaaaccgtggaccacgacctcccgacggtcctcctctagtgtagtcggtcgccgtccgaccgacgggcctacgtcggtactcccgagccgtacggttacgaggtcggcgaggtcgggtcgtacgggacgaggtacgtcgtacggtctaccactatcgacgcacgcctgcgtagtcgtagtaagttattttgttactttatttacgtgtcgagtacgtagtagttacgtacttaccgtacggtccttactacgttacgtttcggaccggtacggggtaccgtaggggttacggtacgtaacgtaaccgtaaacggtacgttagggtacggtacgtacgacccgaaccttacgttcgttacg

SEQ ID NO: 270015 - DNA, 671 bp, Homo sapiens
  misc_feature: GYAE6OF01B6PFH.39.50.E06.1.454.CMB.1.raw
  modified_base (630)..(630): a, c, t, g, unknown or other
  misc_feature (630)..(630): n is a, c, g, or t
tcagtcgcactagtcacgaccggtgctcgatttagatctactgacaacacacaagggggagaactgctcagttaggacccagacggaaccatggaagccccagcgcagcttctcttcctcctgctactctggcctcccagactaccactggagaagtagtgatgacgcagtctccagcccaccctgtctgtcgtctaccgaaggggaaatccgccctacccgtctccgtgcgacggccagtcacgacttagtgcagactaatcgcctaggtaaccacgaacctaaaaccgtcggacctacgacctaccgacgtcctcctactagttgtacgtcggtcgtacccgtaccgaccggtaccggtccgtacggttacggtcctaccccgtaacggccggttacggttacgacgggttcgacggtacgggtcgggttacgacgggtaatacgggtacgttaccgacggttcctaacccgtactagtacgacgtccgtacgtctacggagtacgtacgtacggttaacgtttagttttacgttaatttaccgtaccgttagtacgacgttacgtgttaacgtcgtaaccgtccgtacttcctacgtacttcggtacgacggtacggtgtaggtacncgtacgacgtacgagtcgactcgtaccactcgtctgttacc

SEQ ID NO: 270016 - DNA, 787 bp, Homo sapiens
  misc_feature: GYAE6OF01B2EI6.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccacctgtctgtcgtctcgaagggaacgacgcccacctctcctgacgacgggcctagtcaacgtacctaagttacggactacggacctaaacgttacgaccgttacggtaaccaacgaaccaaaaaaccgtcggaccaacgtaccctacccgacggtcccttaccgtactacgttacggttacgttcgggtcgccggtacccgacggaacgggtccctacgttacggtacctacccgtaacggtccgttacggttcgtacggtacggtacgtagggttcgggtacggtacgggtaacgtacgttacgttacgtacgttacccgtacctaaccgtacgttaccgacggtccgtaccggaccgttaggacccgttacggttacgttaacggttaacgtttttacgtttttacgttttaaacttttacgtttaacgttaccgttactaaggttacgtaagtttacgtaacggttaccttacccggttacgtacccttacgttaccggtttacggtttaccgggaccggtaacggggtaccgttagggtacggtacgtaacgtaaccggtaaacgtacgggtgtacgtcgtaccacgtacctcggttccgttac

SEQ ID NO: 270017 - DNA, 831 bp, Homo sapiens
  misc_feature: GYAE6OF01CT63I.39.50.E06.1.454.CMB.1.raw
  modified_base (140)..(140): a, c, t, g, unknown or other
  misc_feature (140)..(140): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctccagntaccactggagaagtagtgatgacgcagtctccagccaccctgtctgtgtcctccgagggaacgcgcccaccctctccgtgccgtacgggcccagtacagtactattagcagactaacttacgcccgtaggtaccgaacgaaccgaaaaacccgttcggaccctaacggaccctaccccggtacggtcccctttacccgtaacctacgttacggttacggttacgggttaccgtcccggtaccccgaacccggtacggggtaaccccgtaaccggttaccgggttaacccttacccccggaaccggtacccggtacggtttccggaacggttacggggtccgtaacggggtttcggggttaccggtacggggaaccgttacgggtacgtttaccgaacggttccccgttaaccgacccgtagttaccgacggacccgtaaccggtacccgtcgggtaccgtacgttaccgttaaggtaaacgtttttcgtttttaacgtttaacctttttaaccgttacggtttcgtacgtaacgttaccgtaagttacgttacgttaccgttaccgtccggttaacccttcgttaacccgtttccgggtttaccgaccgggtacgggtacccgttaggtacgggtacgtagtaaccggaaacgttcggtacgttcgactacgacctacctcgtcgttacg

SEQ ID NO: 270018 - DNA, 725 bp, Homo sapiens
  misc_feature: GYAE6OF01C6UYN.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggcctcccagataccacgtggaagaagtagtgatgacgcagtcctccagccctacctgtcctgtcgtcctaccgaggggaaatcgccctaccctctcctgcgacgggcaggtccagtactatgcagctactacgctacggtacacgacaaaacgtgacacgacctccgacgtcctacctactagtcgttagtcggtcgtcccggtaccaccgacgggtaccacgtcggtacctaccgacgtaccgtagttacgcgggttcgcggtacggtcggggtttaccggaggggtactacgggtacgtaccgtacggtcctaaccgtaaccgtagtaccggaacggtcctaaccggtccgttaggccgtaaggttacggttaacgtaaggtttactttaacggtttaaccttttacgtctttacggtacttacggtaccgtaagtttaacgtacgaaccgtttcccgtaccgttcccttacgttaaccgtttacgggttaccggtaaccgggtacgggtaccctagggtaccggtaacgttacgaaaccggtacggtacggtaccgtcggtacgtaccgactaccgtagtccgttacccg

SEQ ID NO: 270019 - DNA, 653 bp, Homo sapiens
  misc_feature: GYAE6OF01CHPSW.39.50.E06.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggcctcccagataccactgganaagtagtgatgacgcagtctccagccaccctgtctgtgtctccgagggaancgcccacctctcctgcgagggccagtcagtactagttagcagacaacttacgccgtggtaccacgaccgaaaaaccgtcggaccacgacctcccgaggtcctaccgtctatgtacgtcggtgtccgtaccgaccgacggtcctacgtcgtactcccgacgtccgtacggttcacggtggcgtaggtcgggtcgtagggaactaggtacgttacgtacgtccgtcgtacctatcgaacgcctacgtccgtcggctaaggttcctaagtaacggttagtttttaacgttacttttacgttacgttcgttactaacggtccgttaagtcgttacgtaccgtacccgtgtccttacgtaccgttacggttccggacggtacggggtacgtagggtacgacgtaagtaacgtaaccgtagtacggttcgtacgtacgacctaccgtgttctacg

SEQ ID NO: 270020 - DNA, 813 bp, Homo sapiens
  misc_feature: GYAE6OF01DYTPT.39.50.E06.1.454.CMB.1.raw
  modified_base (167)..(167): a, c, t, g, unknown or other
  misc_feature (167)..(167): n is a, c, g, or t
  modified_base (802)..(802): a, c, t, g, unknown or other
  misc_feature (802)..(802): n is a, c, g, or t
tcagtcgcactagtcacgaccggtgctcgatttagatctactgacaacacacaagggggagaactgctcagttaggacccagacggaaccatggaagcccagcgcagcttctcttccctcctgctactctggcctcccagataccactggagaagtagtgatgacgntagtctcagcccaccctgtctgtgtccgtaccgaaggggaaacacgccgtaacctcctaccgtcggaccgacggggacctaacgttccgaacggtaacctagttacggacacggcctaaaacgttaggtcccgttacgggtaaccctaacgtaacccgaaaaaaccccgtcgggacctaaacggaccccttacccgaacggtcctaccctagtaacttaggttagttggtacggtcccgtacccgaaccggtacgggacccttaaccgtaggtaccacccgtaacgtaccgttaagggtccagggtccggtacgtacgggttcgggtacggtaggggtaaccaggttaagtcctacggttcctaacctaaccgtgtacgacggtacgtaccgtacctaggtaccctaaggttaccggtagttaacggtttacgttttacgtttacttttaacgtttacttccgttaacgacgttacgtaaggttactacggttacttaacccggttcgttacccgttaacgttaccgtttacggttaccggaccgggtaacgggtacccgttaaggggtaccgtaaacgtacggtaacgtaaaacgggtcttaaggtccggtacgtaacggtcctaaacccgttntcccggttacg

SEQ ID NO: 270021 - DNA, 760 bp, Homo sapiens
  misc_feature: GYAE6OF01BUCD3.39.50.E06.1.454.CMB.1.raw
  modified_base (207)..(207): a, c, t, g, unknown or other
  misc_feature (207)..(207): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggcctcccagactaccactggagaagtagtgatgacgcagtctccagcccacctgtctgtgtctaccgaggggaancgcccacctctcctgcgacggccagtcaagtactatacgacagacctaacttacgccgtacggtaaccacgaacctaaaaacccgtcggaccaacgtacccgtaccccggacggtccctaccgtactaacgttagtaacggttccgggtccggtacccgtacccgaacccggaaccgggaccctaacgttacggtacctaccccgtacggtacccgtaggttaccgagggtcgggacgtagggttcggggtacgtacggggaactaggtacgttccgacggttacctacctacccgacttaccgaccgaccgtacgtaccgtacggaccgtacggttacgttaaggttaacgttttaacgttttaccgtttaacttttacgtttacgttacgtaccgtagtacgttaagttacgtacggttacctaccggttccgtacccttacctaccgttacgggtttaccggaccggtaacgggtaccgttagggtacgtaacgtaacgtaacggtaaccgtagtcggtacgtccgtacgtaccctacctgttccgtacg

SEQ ID NO: 270022 - DNA, 550 bp, Homo sapiens
  misc_feature: GYAE6OF01BAPRG.39.50.E06.1.454.CMB.1.raw
  modified_base (205)..(205): a, c, t, g, unknown or other
  misc_feature (205)..(205): n is a, c, g, or t
  modified_base (425)..(425): a, c, t, g, unknown or other
  misc_feature (425)..(425): n is a, c, g, or t
  modified_base (455)..(455): a, c, t, g, unknown or other
  misc_feature (455)..(455): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccagggggaaanagccaccctctcctgcagggccagtcagactattagcagcaacttagcctggtaccagaccaaaaaccgtcggaccagacctcccaggcctcctcactgtatggtgcgtcaaccgagggccacgtggtactcccgagcctaggttcagtggcaggtcgggtctgggacaggtacgttcgagtcctcaccatccgagcacgtcctgctacgtcgtgaagtnttttagtactttatactgtacagtctagtntagtactccgtgccttctactacgtttcggccgacgggtaccgtagggttaggtacgatacgaacgtacgtggtcgtctagaccactgtcgtacg

SEQ ID NO: 270023 - DNA, 672 bp, Homo sapiens
  misc_feature: GYAE6OF01EEYPI.39.50.E06.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (459)..(459): a, c, t, g, unknown or other
  misc_feature (459)..(459): n is a, c, g, or t
tcagtcgcactagtcacgaccggtgctcgatttagatctactgacaacacacaagggggaggaactgctcagttaggacccagacggaaccatggaagccccagcgcagcttctcttccctcctgctactctggcctcccagactaccacgtggaagaagtagtgatgacgcagtcctccagccctacctgtctgtcgtccncgaaggggaaacncgccctaccctctccgtgaccgacggcctagtacagtactagtacgacacgtactaacttacgtaccgtacggtaccaacgaaccaaaaccgtcggaccaacgacctacccgaggtcctcctacacgttggtagtcggtcgcccgtaccgaccggacggtccacgtacgtacgaccgacgtaccgtaggtcacggtggacgtacggtcggtcggacggacgtagtacgtcgtacgtctacacgntacgacgaccgtacgtcctacggtcgtaacgtactaaggttaacgttttcgttttaacgtttaacccttttagttaccgttgtaccgtaggttactagttaactacgttacctaccgtcgttaccctagtacgtttaccggtcgggtaaccgtacgggtacgtagggtacgtacgtagacgaaagtcgtagacgtcacgtacctcgtcgtctc

SEQ ID NO: 270024 - DNA, 759 bp, Homo sapiens
  misc_feature: GYAE6OF01CX9IN.39.50.E06.1.454.CMB.1.raw
  modified_base (531)..(531): a, c, t, g, unknown or other
  misc_feature (531)..(531): n is a, c, g, or t
tcagtcgcactagtcacgaccggtgctcgatttagatctactgacaacacacaagggggagaactgctcagttagacccagacggaaccatggaagcccagcgcagcttctcttcctcctgctactctggctccagactaccactggataagtagtgatgacgcacgtctaccacgccctacctgtcgtgtcgttccgaccgaaggggaaacgcaccctacccgtctccgtgacgacgggtaccaggtacagtaccttatagacctagactaagttacgccgtacggtaaccaagaaacctaaaaacccgtcggaaccaacgtacccgtaccccgtagaccccgttccgtacaacgttacgttaggtcggttccgacccggttacccgaaccggacggtaccctaggtcgtacctaccgacgtaccggtaagtccgtaagcggtacgaagggttcgggtaccgtaacgggtacacgggttactaccgtagttaccgacaccgttaacgcgacgaccgtacgtccgtaacgngttacgggtaacttacgttaaagttttacgttttaccgggtttaatttaacgttacgttcggtaaactgggtacctaagttaacgtcgtaacgttcccgtacgtacccgtactaacgtttcggaacggtaaccgtacggggtaccgtaggtaaaccgtagaaaccccgtagaaacgggttacccgtggacgttaccgaacggtaccaaaccggtttcttggttaaccc

SEQ ID NO: 270025 - DNA, 770 bp, Homo sapiens
  misc_feature: GYAE6OF01AFFBH.39.50.E06.1.454.CMB.1.raw
  modified_base (170)..(170): a, c, t, g, unknown or other
  misc_feature (170)..(170): n is a, c, g, or t
  modified_base (225)..(225): a, c, t, g, unknown or other
  misc_feature (225)..(225): n is a, c, g, or t
tcagtcgcactagtcacgaccggtgctcgatttagatctactgacaacacacaaggggggaggaactgctcaggttacggacccagacggaaccatgggaacgccccagcgcagcttctcttcctcctgcctactctggcctcccagactaccacgtggaagtaagtagngtatcggacgcagtctccacgccctaccctgtctaggctcgtacggaagggaaancgcccaccctctccgtgacgaccgggctagtcgaagtactagttacgacacacgtaacgttacgtcccgtacggtaaccacgaaaccgtaaaaccgtcggacctaagaccctaccggacggccttacctcgtactagttacggtcggtacgaccgtacccgaaccggtacgggacctacggtacggtaacccgtcccgtaacggtacccggtaggtttaccggacgggtacggtaccggggtaggtacggggacggtaacggtaccgtaagttacgtttacgaccggttcctaccgaaccttacgacgtacgtacgtacgtccgtactagtacgtacgtaggttaactttacgttttagtaactttcgtatacgttcagtacgtaattaggtactaaccgtccggtccgttaactacccgttagtttaccgggttaacgggtcggtaaccgggggtacgtacgggttaagggtaacgtaacggttaaaccgaaacggttcggttaaacggcgttaacgtcgaaaccggttcttccgttacgtccc

SEQ ID NO: 270026 - DNA, 509 bp, Homo sapiens
  misc_feature: GYAE6OF02FTXY1.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactattagcagcaacttagcctggtaccagcaaaaacctggccagactcccaggctcctcatgtatggtgcgtccaccagggccactggtatcccagccaggttcagtggcagtgggtctgggacagagttcagtctcaccatcagcagcctgcagtctgaagtattttgtactttattactgtctagtcagtatgatacctggcctcactacttttggccgtaggggtaccagggttggagatacgaaacgtactggtcggctagcacctatctcg

SEQ ID NO: 270027 - DNA, 601 bp, Homo sapiens
  misc_feature: GYAE6OF02H13XJ.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcgagggccagtcagactattgcagcaacttagcctggtaccagacaaaaacctggaccagacctcccaggcctcctcatgtatggtgccgtccaccgagggccacgtggtactcccacgccgaggttcaggtcggcaggtcgggtcgtgggactaggtagttcaggttcctcgacctatcgacgtcagtcccctggactagtctaggtaagttagtttttacgttaactttttagtttacgttgttcgtacgtacgtaagttagtacgtaactaccgttggtacccttacgtaccttacgttttcggaccgtacgggtaccgtagggttggaacgtactacgaaacgtacgtggtacggtcgtacgccgtaactcgtcgttcg

SEQ ID NO: 270028 - DNA, 536 bp, Homo sapiens
  misc_feature: GYAE6OF02H13TX.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagcaaaaacctggccagactcccaggctcctcatgtatggtgcgtccaccgagggccacgtggtactcccagccaggttcagtggcaggtgggtcgtgggacagagttcagtctcaccatcagcacgcctgcagtctagaagttattttgttacttttattacttgtcagtctagtatgtactacctcggtcctctactacttttcgggaccgtacggggacctagggttcggaagtacgtacgaaacgtacgtggtcggactgacactcgtcttcg

SEQ ID NO: 270029 - DNA, 555 bp, Homo sapiens
  misc_feature: GYAE6OF02JG4T1.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccacctgtctgtgtctccgaggggaaanagcccaccctctcctgcagggccagtcagactattagcagcaacttagcctggtaccagacaaaaacctggccagactcccaggcctcctcatgtatggtgccgtccaccgagggccacgtggtactcccgagccaggttcagtggcaggtgggtctgggacagagttcagtctcacatcagcagcctgcagtctagaagtattttgtactttattactgtctagctagtatagtataccgtggtccttcacttacgttttcgggaccgtaacggggtacctagggttggaacgtacgttaaccgaaacggtaacgttgggtacggcgttcgacctacctacttcgttacg

SEQ ID NO: 270030 - DNA, 521 bp, Homo sapiens
  misc_feature: GYAE6OF02FYWHE.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactattagcagcaacttagcctggtaccagcaaaaacctggccagactcccaggctcctcatgtatggtgcgtccaccagggccactggtatcccagccaggttcagtggcagtgggtctgggacagagttcagtctcaccatcagcagcctgcagtctagaagtatttgtactttattactgtctagcagtatgataccgtggcctcacctacgttttggccgtaggggtacctagggttcggaagtataccgaaacgacgttggtggctggaccacctatcgttacg

SEQ ID NO: 270031 - DNA, 549 bp, Homo sapiens
  misc_feature: GYAE6OF02HDZTY.39.50.E06.1.454.CMB.1.raw
  modified_base (205)..(205): a, c, t, g, unknown or other
  misc_feature (205)..(205): n is a, c, g, or t
  modified_base (426)..(426): a, c, t, g, unknown or other
  misc_feature (426)..(426): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagngccaccctctcctgcagggccagtcagactattagcagcaacttagcctggtaccagcaaaaacctggccagactcccaggctcctcatgtatggtgccgtccaccagggccactggtactccccagccaggttcaggtggcaggtgggtctgggacaggagttcagtcctcaccatcagcagcctgcagtctagaagtatttgttacttttattactgtnagctagtatgataccgtcggtccctactaactacttttcggacccgtagggggacctagggttagggaggtaataccgaaacgtaacgtaggttacgggctcggacctaacctagtccttcgg

SEQ ID NO: 270032 - DNA, 575 bp, Homo sapiens
  misc_feature: GYAE6OF02I1ZMX.39.50.E06.1.454.CMB.1.raw
  modified_base (204)..(204): a, c, t, g, unknown or other
  misc_feature (204)..(204): n is a, c, g, or t
  modified_base (412)..(412): a, c, t, g, unknown or other
  misc_feature (412)..(412): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcaggccagtcagactattagcagcaacttagcctggtaccagcaaaacctggaccagactcccaggcctcctcaactgtatggtcgcgtaccaccagggccacgtggtactcccagccaggttcagtcggcaggtgggtactgggacaggtagttcaggtctacacatcagcagcctgactgtctagaacgtntttagtacttttattactgtacagtcagttatactattacccgtggacccttacgtaacttaccttttacgggaccgacggggtaccctaggggttacggtaacggtacttaccgaaaaccggtacttcggtaggtctacgaccggaccttaacggtcttacg

SEQ ID NO: 270033 - DNA, 628 bp, Homo sapiens
  misc_feature: GYAE6OF02IYJZ2.39.50.E06.1.454.CMB.1.raw
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (608)..(608): a, c, t, g, unknown or other
  misc_feature (608)..(608): n is a, c, g, or t
tcagtcgcactagtcacgaccggtgctcgatttagatctactgacaacacacaaggggaggaacgtgctcagttaggacccagacggaaccatggaagccccagcgcagcttctcttcctcctgctactctggctcccagataccactggagaagtagtgatgacgcagtctccagccaccctgtctgtgtctccaggggaagagccaccctctcctgcagggccagtcagactattagcagcaacttagcctgtaccagcaaaacctggcagactccaggctcctcangtanggtgcgtccaccagggccacgtggtactccccgacgcctacggttcaggtgggcctagggttgggtacgtggggaactaggtacgttcaggttctaccgaccatccgaagtccgagccctcgtctacggtacctaggtaacgtacgtttttcgttaaacgtttttactttaaccgttgtaactacggtacctaagtttaactacggtaacgtttaacccgtgggtacccctttacgtaaccgttacgttttcgggaccgtaggggtaccctaggggtttacgaagtactacggaaaccgtagttcggacggtcanaccggtacctagttacctcg

SEQ ID NO: 270034 - DNA, 505 bp, Homo sapiens
  misc_feature: GYAE6OF02F3OYQ.39.50.E06.1.454.CMB.1.raw
  modified_base (438)..(438): a, c, t, g, unknown or other
  misc_feature (438)..(438): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactattagcagcaacttagcctggtaccagcaaaaacctggccagactcccaggctcctcatgtatggtgcgtccaccagggccactggtatcccagccaggttcagtggcagtgggtctgggacagagttcagtctcacatcagcagcctgcagtctgaagattttgtactttattactgtcagtcagtatgatacctggccttnactacttttggcctaggggacctaggtggaagactacgaaacgacgttgtggctagcaccatctacg

SEQ ID NO: 270035 - DNA, 501 bp, Homo sapiens
  misc_feature: GYAE6OF02HIMTG.39.50.E06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (391)..(391): a, c, t, g, unknown or other
  misc_feature (391)..(391): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagactattagcagcaacttagcctggtaccagcaaaaacctggccagactcccaggctcctcatgtatggtgcgtccaccagggccactggtatccccagccaggttcagtggcagtgggtctgggacagagttcagtctcaccatcagcagcctgcagtcngaagtatttgttactttattactgtcagctagtatgatacctgcctcactctttgcgtagggacaggttggagtactacgaaacgactagtcggtctgacacctatctcg

SEQ ID NO: 270036 - DNA, 547 bp, Homo sapiens
  misc_feature: GYAE6OF02IM76P.39.50.E06.1.454.CMB.1.raw
  modified_base (204)..(204): a, c, t, g, unknown or other
  misc_feature (204)..(204): n is a, c, g, or t
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagacaaaacctggaccagactcccaggctcctcatgtatggtgcgtccaccgagggcccacgtcggtactcccgagccaggttcaggtggcaggtgggtcgtgggacaggagttcagtctcacntcagcagcctgcagtcagaagtnttttgttacttttattacgtgtcagtctagtatagtactacgtgtcctctactacgttttcgaccgtacggggtactagggttacggaagtaacgtaccgaaacgtacgttcggtacggtactgacctactagttcttacg

SEQ ID NO: 270037 - DNA, 515 bp, Homo sapiens
  misc_feature: GYAE6OF02IN73Y.39.50.E06.1.454.CMB.1.raw
  modified_base (387)..(387): a, c, t, g, unknown or other
  misc_feature (387)..(387): n is a, c, g, or t
tcagtcgcactagtcacgaccggtgctcgatttagatctactgacaacacacaagggggaggaactgctcagttaggacccagacggaaccatggaagccccagcgcagcttctcttcctccttctactctggctcccagataccactggagaagtagtgatgacgcagtctccagccaccctgtctgtgtctccaggggaaagagccaccctctcctgcagggccagtcagactattagcagcaacttagcctggtaccagcaaaaacctggccagactcccaggctcctcatgtatggtgcgtccaccagggccactggtactcccagccaggtcagtggcagtgggtctgggacaggagttcagtctcacatcagcagcctgcngtctgaagtatttgtactttattactgtacagcagttatgataccgtggcctcactacgttttcggccgtagggacctaggttggagtagtaccaaacgtacgtaggtggctacgccacatcctgttc

SEQ ID NO: 270038 - DNA, 510 bp, Homo sapiens
  misc_feature: GYAE6OF02IC346.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactattagcagcaacttagcctggtaccagcaaaaacctggccagactacaggctctcatgtatggtgcgtccaccagggccactggtatcccagccaggttcagtggcagtgggtctgggacaggagttcagtctcaccatcagcagcctgcagtctgaagtattttgttaacttttattacttgtcagctagtatgatacctggccctcactacttttggcctaggggacctagggttggagatacgaaacgtaactggtcggctgcaccatctcg

SEQ ID NO: 270039 - DNA, 542 bp, Homo sapiens
  misc_feature: GYAE6OF02HBTL8.39.50.E06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (398)..(398): a, c, t, g, unknown or other
  misc_feature (398)..(398): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctntcctgcagggccagtcagactatagcagcaacttagcctggtaccagcaaaaacctggaccagactcccaggctcctcatgtatggtgcgtccaccagggccactggtactcccagccaggttcagtggcagtgggtctgggacagagttcagtctcaccatcagcagcctgcagtctgaagtnttttgtacttttattacttgtctagtctagttatgtacttacctcgggtccttcgactacttttcggccgtaggggtacctagggttaggagtacgttaccgaaacgtacgttggtacggtcgtacgaccacctagtcttacgg

SEQ ID NO: 270040 - DNA, 546 bp, Homo sapiens
  misc_feature: GYAE6OF02JNOLD.39.50.E06.1.454.CMB.1.raw
  modified_base (204)..(204): a, c, t, g, unknown or other
  misc_feature (204)..(204): n is a, c, g, or t
  modified_base (379)..(379): a, c, t, g, unknown or other
  misc_feature (379)..(379): n is a, c, g, or t
  modified_base (402)..(402): a, c, t, g, unknown or other
  misc_feature (402)..(402): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactattagcagcaacttagcctggtaccagcaaaaacctggaccagactccaggctcctcatgtatggtgcgtccacgacgggccacgtggtactcccagccaggttcagtggcagtgggtctgggacagacgttcagtctcacctntcagcagcctgcagtctagagtntttgtactttattactgtcagctagtatgatccgtggccttcacttcgtttacgggcctacggggtacctagggttcggaagtactacgaaacggtaccgttaggttcggtaccgttacgacccgtacctacgtaccgttacgg

SEQ ID NO: 270041 - DNA, 562 bp, Homo sapiens
  misc_feature: GYAE6OF02GCAOP.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactattagcagcaacttagcctggtaccagacaaaaacctggccagactcccaggctcctcatgtatggtgcgtccaccgagggccactggtactcccagccaggttcaggtgcaggtgggtctgggacagagttcagtctcaccatcagcagcctgctagtctagaagtattttgttactttattactgtcagtctagttatgtacttaccgtcggtcccttactaccttacgttttcgggaccgtaggggtacctaggggttacggaacggtacgtaaccgtaaacggtaccgttggtacggtactcggaccacccgtagtcgttacg

SEQ ID NO: 270042 - DNA, 531 bp, Homo sapiens
  misc_feature: GYAE6OF02G85S7.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagcaaaaacctggccagactcccaggctcctcatgtatggtgcgtccaccagggccactggtatcccagccaggttcagtggcagtgggtctgggacagagttcagtctcacatcagcagcctgcagtctgaatattttgtactttattactgtcagctagtatgatacctggccttcacctacttttcgggacccaggggtaccctagggtttacggacgtagtacgtaaacgacttggtacggtcgtacggtccaacctacttcgttacg

SEQ ID NO: 270043 - DNA, 544 bp, Homo sapiens
  misc_feature: GYAE6OF02FYYAG.39.50.E06.1.454.CMB.1.raw
  modified_base (204)..(204): a, c, t, g, unknown or other
  misc_feature (204)..(204): n is a, c, g, or t
  modified_base (399)..(399): a, c, t, g, unknown or other
  misc_feature (399)..(399): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactatagcagcaactagcctggtaccagcaaaaacctggccagactcccaggctcctcatgtatggtgcgtccaccgagggccactggtactcccagccaggttcagtggcaggtggtctgggacagagttcagtctcaccatcagcagcctgcagtctagtaagtnttttgtactttattactgtcagctaagttgtagtactacccgtggtccttcgacttaccgttttcggaccgtacggggtacctagggttcggaagtacttaacgaaacgtacgtggtcggtctacgacctaccgtatccgttacg

SEQ ID NO: 270044 - DNA, 551 bp, Homo sapiens
  misc_feature: GYAE6OF02G53W0.39.50.E06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccaccctntcctgcagggccagtcagactattagcagcaacttagcctggtaccagcaaaaacctggaccagactcccaggctcctcatgtatggtgcgtccaccgagggccacgtggtactcccagccaggttcagtggcaggtgggtctggacagagttcagtctcaccatcagcagcctgcagtctagaagtattttgtacttttattactgtcagtctagttatgtactaccgttggcccttcgtaacgtacgttttacggcccgtaacggggtacctagggttcggaagtacgtacgaaaccgtacgttggtacggtcgtcgacgtaccgtatccgttcg

SEQ ID NO: 270045 - DNA, 560 bp, Homo sapiens
  misc_feature: GYAE6OF02HWYHP.39.50.E06.1.454.CMB.1.raw
  modified_base (387)..(387): a, c, t, g, unknown or other
  misc_feature (387)..(387): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagcccaccctctcctgcagggccagtcagactattagcagcaacttagcctggtaccagacaaaaacctggccagacctcccaggcctcctcatgtagtggtgcgtccaccgagggccacgtcggtactcccgagcctaggttcagtggcaggtgggtctgggacagtagttcagtctcaccntcagcagcctgcagtcagtaagttatttcgttacttttattacgttgtacagtctagttatgtactaccgtggcctctacgtacgtttggaccgtacggggtacctagggttacggaagtacgtaacgaaacgtacgttggtacgtccgtggtacccaccgtacgttcgtacg

SEQ ID NO: 270046 - DNA, 587 bp, Homo sapiens
  misc_feature: GYAE6OF02HWF1X.39.50.E06.1.454.CMB.1.raw
  modified_base (203)..(203): a, c, t, g, unknown or other
  misc_feature (203)..(203): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccacctgtctgtgtctccaggggaaancgccacctctcctgcagggccagtcagactatagcagcaactagcctggtaccagcaaaacctggaccagacctccgaggcctcctctactgtagtggtcgccgtccgaccgacgggcctacgtcggtactcccgagccgtaggttccgaggtcggcgaggtgggtcgtgggacgagtacgttcgacgttctaccaccgtagtcgagccacgtcctgcagtcgtaggtaagttacgtttttagttaactttttattacgttcgtacgagtctaagttatagtactaccgttcggccttctacgttacgttttcggaccggtacgggtacgtagggtacggagtactacgaacgtacgtggtcggctcgacctactcgtcttacg

SEQ ID NO: 270047 - DNA, 555 bp, Homo sapiens
  misc_feature: GYAE6OF02FPAB8.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactattagcagcaacttagcctggtaccagcaaaacctggccagactcccaggctcctcatgtatggtgcgtccaccagggccactggtactccccagccaggttcagtggcagtgggtctgggacaggagttcagtctcaccatcagcagcctgcagtctgaagtattttgttactttattacttgtcagtcagttatgtatacctggtccttcactacgttttcggacccgtaggggtaccgtagggttacggaggtacttaccgaaaacggtaaccgttaggttacgggtccttaggacctaccgtacgttccgttacgg

SEQ ID NO: 270048 - DNA, 553 bp, Homo sapiens
  misc_feature: GYAE6OF02F65A6.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactattagcagcaacttagcctggtaccagcaaaaacctggccagactcccaggctcctcatgtatggtgcgtccaccagggccactggtatcccagccaggttcagtgcagtgggtctgggacagagttcagtctcaccatcagcagcctgcagtctagaagtattttgttactttattactgtcagctagttatgacttaccgtggtcccttcaacctacgttttcggcccgtaaggggtaccctagggtttagggacgtaacgttaccgaaaacggtacgttggttacgggcttaggaccctaccgtattccgttacg

SEQ ID NO: 270049 - DNA, 595 bp, Homo sapiens
  misc_feature: GYAE6OF02I9MWJ.39.50.E06.1.454.CMB.1.raw
  modified_base (205)..(205): a, c, t, g, unknown or other
  misc_feature (205)..(205): n is a, c, g, or t
  modified_base (404)..(404): a, c, t, g, unknown or other
  misc_feature (404)..(404): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagatacccactggagaagtagtgatgacgcagtctccagccaccctgtctgtgtctccaggggaaangccaccctctcctgcagggccagtcagactatagcagcaattagcctggtaccagcaaaacctggaccagactcccaggcctcctacatgtatggtcgcgtccaccgagggccacgtaggtactcccagcctaggttcacgtggcaggtgggtctgggacagagttcaggtctcacctatcgagcagtcctgctgtacngaagtatttgtactttatacttgtctagctagtataggactaccgtggcctactaccgtacgttttacgggccgtaagggggtaccctaaggggttacggtaacggtaacgttaccggtaaaaaccggtaacggttcggttaccgggttaccttacggacccgtaaccccgttacgttacccggttaccgg

SEQ ID NO: 270050 - DNA, 701 bp, Homo sapiens
  misc_feature: GYAE6OF02HC7MN.39.50.E06.1.454.CMB.1.raw
  modified_base (207)..(207): a, c, t, g, unknown or other
  misc_feature (207)..(207): n is a, c, g, or t
tcagtcgcactagtcacgaccggtgctcgatttagatctactgacaacacacaagggggaggaactgctcgagttaggacccagacggaaccatggaagccccagcgcagcttctcttcctcctgctactctggctcccagactaccactggagaagtagtgatgacgcagtctccagccaccctgtctgtgtctccgaggggaaangcccaccctctcctgcaggccagtcagactatagcagcaacttagcctggtaccagaccaaaaacctggaccacgacctcccgaggcctccctacatgtagtggtcgccgtcccaccgacgggaccacgtggtactccccgagaccgtacggttcgaggttggacgtagggttcgggtcggtacgggaacgtaggtagtttcgtacggttcctaccgtaaccgtactccgacgtaccgaacgtcccgttacggcgtaacggttcctaaggttaattttacgtttttacgtttaacgtttttaacgtttaccgttggttacgtaacgtaccgtagtttaacgttacgtaaccgttacccgtccggttaccctaccgttaaccgtttaccggtttacggaccgggtacgggtaccgttagggttacggaacgttaaccgtaaccgtaaacgttacgttacggacggtacctacggacctacgttagtcgtttaccg

SEQ ID NO: 270051 - DNA, 564 bp, Homo sapiens
  misc_feature: GYAE6OF02GT4YH.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactattagcagcaacttagcctggtaccagacaaaaacctggccagactcccaggctcctcatgtagtggtgcgtccaccgagggccacgtggtactcccagccaggttcagtggcagtgggtctgggacaggagttcagttctcacatcagcagcctgcagtctagaagtattttgttactttattactgtacagctagtatagtatccgtaggcccttacaccgttacttttgggacccgtagggggtaccctagggttcgggaagtaacgttaaccggaaaacgtaccgttggtacgggtacttacggaccctacctagttcttaccgg

SEQ ID NO: 270052 - DNA, 516 bp, Homo sapiens
  misc_feature: GYAE6OF02F3WHR.39.50.E06.1.454.CMB.1.raw
  modified_base (204)..(204): a, c, t, g, unknown or other
  misc_feature (204)..(204): n is a, c, g, or t
  modified_base (371)..(371): a, c, t, g, unknown or other
  misc_feature (371)..(371): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactattagcagcaacttagcctggtaccagcaaaaacctggccagactcccaggctcctcatgtatggtgcgtccaccagggccactggtatcccagccaggttcagtgcagtgggtctggacagagttcagtctcacntcagcagcctgcagtctgaagattttgtactttattactgtcagtctagtatgataccgtggcctcactacttttggaccgtaggggacctagggttggaacggtataccgaaacgtacgttggtcggcctgccacctatcttcg

SEQ ID NO: 270053 - DNA, 557 bp, Homo sapiens
  misc_feature: GYAE6OF02G9XBC.39.50.E06.1.454.CMB.1.raw
  modified_base (204)..(204): a, c, t, g, unknown or other
  misc_feature (204)..(204): n is a, c, g, or t
  modified_base (318)..(318): a, c, t, g, unknown or other
  misc_feature (318)..(318): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactattagcagcaacttagcctggtaccagacaaaaacctggaccagacctcccaggcctcctcatcgtatggtgccgtccaccgngggccacgtggtactcccagccaggttcagtgcagtgggtctggacagacgttcagtctcgacctatcagcagcctcgctagtctggaagtatttagttactttattactgtacagctagtatagtactaccgtgtccctactacgttacgttttacggccgtaacgggtaccgtaggttagggagtactaacggaaccgtaacgtagtaggtccgtaggaccctaactacgtcttacg

SEQ ID NO: 270054 - DNA, 524 bp, Homo sapiens
  misc_feature: GYAE6OF02IEO06.39.50.E06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagactattagcagcaacttagcctggtaccagcaaaaacctggccagactccaggctcctcatgtatggtgcgtccaccaggggccacgtggtactccccgagcctaggttccagtggcagtgggtctgggacagagttcagtctcaccatcagcacgctgcagtctagagtatttgttactttattactgtcagcagtatgataccgtgaccttcactacttttggcctaggggaccagggtttggaagtactacgaaacgtacgtagtggactaggactacctacgtcttacg

SEQ ID NO: 270055 - DNA, 569 bp, Homo sapiens
  misc_feature: GYAE6OF02HTHZQ.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactatagcagcaacttagcctggtaccagcaaaaacctggccagactcccaggctcctcatgtatggtgcgtccaccgagggccactcggtatccccagccaggttcagtggcaggtggtcgtgggacagtagttcagtcctcaccatcagcagcctgcagtctgaagtattttggttaacttttattacttcgttcagctagttatgtaactacctggccctctaaccttacgtttcggccctaagggggtaccctagggtttcggaacggtaacgttacgtaaaaccggtacgttaggttacggtcctacgggtaccaaccgtagttccgttacgg

SEQ ID NO: 270056 - DNA, 504 bp, Homo sapiens
  misc_feature: GYAE6OF02FG997.39.50.E06.1.454.CMB.1.raw
  modified_base (383)..(383): a, c, t, g, unknown or other
  misc_feature (383)..(383): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccagggggaaagagccaccctctccctgcagggccagtcagactattagcagcaacttagcctggtaccagcaaaaacctggccagactcccaggctcctcatgtatggtgcgtccaccaggggccactggtatcccagccaggttcagtggcagtgggtctgggacagagttcagtctcaccatcagcngcctgcagtctgaagattttgtactttatttactgttcagtcagtatgatacctggccttcactcttttggccaggggaccaggttggagatacaaacgtactgtggctgcacctatctcg

SEQ ID NO: 270057 - DNA, 569 bp, Homo sapiens
  misc_feature: GYAE6OF02FTP8D.39.50.E06.1.454.CMB.1.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactatagcagcaatagcctggtaccagacaaaacctggaccagacctcccaggcctcctcatgtatggtcgcgtccaccgagggccacgtggtactcccagtccgaggttcgaggtggcgtaggtgggtcgtgggacaggtagttcagtcctcaccatcagcagcctgcngtctagtagttnttttacgttacttttattacttgtacagtctaggtatgacttacgtcggtacctctaacgttacgttttcggaccggtacgggtaccgtagggtggtaacggtaactacgtaaacgtacgttggtacggtcgtacgacctaccgtacgttgttccg

SEQ ID NO: 270058 - DNA, 578 bp, Homo sapiens
  misc_feature: GYAE6OF02HABW2.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagacaaaaacctggaccagacctcccaggctcctcatgtatggtgcgtccaccgaggggccacgttggtactccccagccaggttcaggtggcaggtgggtctgggacaggtagttcaggtctcacctatcagcagcctgcagtctgaagtatttgttactttattacttgtctagtcgtagttatgtacttaccgtcggcccttactaccttacgttttcgggacccgtagggggtacctaggggtttacgggaagtaacgtaaccgaaacgtaacgttggtacggtacgtacgacctaaccgtacgttccgttacgg

SEQ ID NO: 270059 - DNA, 540 bp, Homo sapiens
  misc_feature: GYAE6OF02GD4X7.39.50.E06.1.454.CMB.1.raw
  modified_base (204)..(204): a, c, t, g, unknown or other
  misc_feature (204)..(204): n is a, c, g, or t
  modified_base (451)..(451): a, c, t, g, unknown or other
  misc_feature (451)..(451): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccagggggaanagccaccctctcctgcagggccagtcagactattagcagcaacttagcctggtaccagcaaaaacctggccagacctcccaggctcctcatgtatggtgcgtccaccgagggccactggtactcccagccaggttcagtggcaggtgggtctgggacagtgtcagtctcacatcagcagctgcagtctgaagtattttagtactttattacttgtcgagtctaagtatagtactaccgtggcccttntaccttacgttttcggaccgtaggggtaccctagggttcggaagactacgaaacggtacgtggtcggcttcggactaccgtatcttacg

SEQ ID NO: 270060 - DNA, 521 bp, Homo sapiens
  misc_feature: GYAE6OF02GE1KX.39.50.E06.1.454.CMB.1.raw
  modified_base (204)..(204): a, c, t, g, unknown or other
  misc_feature (204)..(204): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtccagactattagcagcaacttagcctggtaccagcaaaaacctggaccagacctcccaggctcctcatgtatggtgccgtccaccgtagggccacgtggtactcccgagccaggttcaggtggcaggtgggtctgggacagagttcagtctcacatcagcagctgcngtctgtatntttgtactttattactgtcagcagttatgtatcctggcctctactactttcggccgtaggggtacctagggtcggagtacgtacaaacgtacgtggtgctcgtcaccgtatcttcg

SEQ ID NO: 270061 - DNA, 580 bp, Homo sapiens
  misc_feature: GYAE6OF02IOM61.39.50.E06.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctcgtccngcaggccagtcagactattagcagcaactagcctggtaccagacaaaactggccagactccaggcctcctcatgtatggtgccgtccacgtacgggccactggtactccagccaagttcagtcgcgagtcgggtctgggactagacgtttcgaggttccacaccgtactcgacgcaggcctggctagtcgagtaagttagttttacgtaacttttattaacgttgtactgactagtactgactactcggtaccctagaaccgttacgtttagaccggtacgggacgtagggtttaggaacgtacttaccgaaaaccggtcgtacggttcgggtcttcccgggactaccgtattcgttaaccgg

SEQ ID NO: 270062 - DNA, 607 bp, Homo sapiens
  misc_feature: GYAE6OF02GYX4T.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccaccctctcctgcagggccagtcagactattagcagcaacttagcctggtaccagacaaaaacctggaccagacctcccaggcctcctcatgtagtggtcgcgtccaccgagggccacgtcggtactccccgagcctaggttcaggtggctaggtgggtcgtgggacaggtagttcagtctcacatcgacgtcacgcctgctagtctagaagttatttgttaactttatttactgtacagtctaagttactagtacttaccgtcggtccctacgtaccgtttacgttttcgggaccgtaacggggtaccgtaggggtttacggtaacgtaacggttaaccgaaaccggttaaccgttgggtaccggtacgttacggacctaaccgtacgttccgttacgg

SEQ ID NO: 270063 - DNA, 606 bp, Homo sapiens
  misc_feature: GYAE6OF02JD1XS.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagactattagcagcaacttagcctggtaccagacaaaaaccgtggaccagacctacccaggcctcctcatgtatggtgccgtaccaccgagggccacgtggtactcccgagcctaggttcgagtcggcgaggtgggtcgtgggacagagttcgagtctaccacatcacgcacgtcctgcagtctagtaagtattttcgttaactttacttacgtgtacagtctaagtatagtacttaccgtcggtacccttacgtacttacgtttcggaccgtaacggggtaccgtaagggttacggaagtacgtaaccgtaaaaccggtacgtttacgggtacggtacgttaccggtaccctaaccgtacgtttaccgttaccgg

SEQ ID NO: 270064 - DNA, 536 bp, Homo sapiens
  misc_feature: GYAE6OF02I6QXZ.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactatagcagcaacttagcctggtaccagcaaaaacctggaccagactcccaggctcctcatgtatggtgcgtccaccgacgggccactggtactcccagccaggtcagtgcagtggtctgggacagagtcagtctcacatcacgcagctgcagtctgaatattttgtacttttattacgttgtacagtactagtatagtacttaccgtggtacctctaacttaccgtttaggccgtaggggtaccctagggttacggagtaactacgaaacgtacgtggtacggctgacctacctagtcgttcg

SEQ ID NO: 270065 - DNA, 565 bp, Homo sapiens
  misc_feature: GYAE6OF02G4F1J.39.50.E06.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (424)..(424): a, c, t, g, unknown or other
  misc_feature (424)..(424): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactattagcagcaacttagcctggtaccagacaaaaacctggaccagacctcccaggctcctnatgtagtggtgccgtccaccgacgggccacgtcggtactcccagccgaggttcaggtcggcaggtgggtcgtgggacaggtagttcgacgtctaccacctatcagcacgcctgccagtctagtaacgtnttttagttactttattacttgtcagtactagtatgtactaccgtcgtcctctacttacgtttcggaccgtacggggtaccgtagggttaggagtataccgaaacgtacgttggtacggtctcggacctactacgtcttacg

SEQ ID NO: 270066 - DNA, 685 bp, Homo sapiens
  misc_feature: GYAE6OF02HE4QU.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagacaaaacctggaccagactcccaggctcctcatgtatggtgtccgtccaccgacgggcctacgtggtactccccacgcctaggttacgagtcggacgtaggttcgggtccgtaggggaccaggtacgtttacgacgttcctaccgacctacgtccgaacgccgaacgcccgtaggaccgtagttccgtagtaacgtttaacgtttttacggtttaactttttaagtttaccgttagtacctaggtacctaagttagtacggtacttaccgtacggtccctacctaacgttaccgttttacgggacccgttaacgggggtacccgtaagggtttacgggtaacgtacgttaaaccggtaaaaccggttacgttagggttaccgtaccggttacgaccccgtaacgttacgttaccgtttaaccgg

SEQ ID NO: 270067 - DNA, 547 bp, Homo sapiens
  misc_feature: GYAE6OF02IQ9LQ.39.50.E06.1.454.CMB.1.raw
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccacctgtctgtgtcnccaggggaaagngccacctctctgcagggccagtcagactatagcagcaacttagctggtaccagacaaaaacctgccanactccaaggctccnactgtatggtgcgtacctaccaggaccactgtanccgagccaggttcagtcgctagtggtctaggcagngtcatctcacancacncagtcctgctactctagaagtatttagttactttattactagttcagtcagtatacgtactacgtcggtacctaccgtactacctttaggacccgtaggggtaccgacgggttacggaagtaaccgtaacaaaaccggtatacgggtggtacctaggacctaaccgtagtcttacg

SEQ ID NO: 270068 - DNA, 639 bp, Homo sapiens
  misc_feature: GYAE6OF02I4C8F.39.50.E06.1.454.CMB.1.raw
  modified_base (417)..(417): a, c, t, g, unknown or other
  misc_feature (417)..(417): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaagacgccaccctctcctgcacgggccagtcagacttatagcacgcaacttagcctggtacacgacaaaaccgtcggaccagacctcccgaggtcctccgtactagtgtagtcggtcgccgtaccaccgacggccctacgtcggtactacccgacgtccgtacggttcgaggtcggcgtacggtcgggtcgtacgggtactaacggtacgttacgngtctaccgacacgtcgaacgtcacgtcctcgactacggtacgtagtaacgttattttacggttacttttagttccttagtactaggtactaagttacgttagacgttactcggttacctcctaaccgttacggttttcggaccggtacgggaccgttaggtacggtaacgaagtaccgtaaacgtacgtgtacggtcctacgacgtccgtattccgttacgg

SEQ ID NO: 270069 - DNA, 722 bp, Homo sapiens
  misc_feature: GYAE6OF02GQ4JT.39.50.E06.1.454.CMB.1.raw
  modified_base (206)..(206): a, c, t, g, unknown or other
  misc_feature (206)..(206): n is a, c, g, or t
tcagtcgcactagtcacgaccggtgctcgatttagatctactgacaacacacaagggggaggaactgctcagttaggacccagacggaaccatggaagcccagcgcagcttctcttcctcctgctactctggctcccagactaccactggagaagtagtgatgacgcagtctccagcccacctgtctgtcgtctccgaaggggaanacgcccaccctctccgtgacgacgggaccagtacagacttatacgcagactaacttacgccgtacggtaacacgaacctaaaaccgtcgaccacgacctccgacgtcctacctacgagttacgtagtcgggtacgtccgtacccgtaaccgaccgggtacctaacgtcggttaaccctcccggtaacgtccggtacggttacgacgggtcggtacgtacgggttcgggttcggtaacggacgtaagtacgttcgtacgttacctaccgaaccgtacgtaccgaacgccgtacgtccgtacggtactacggttcggtaacgttaagtttacgtttttacgttaacgtttttacgttacgtcgttaacgtacgtaacgttagttactacggttacgttacccgtcggtaccctacgtaccgtttacgttaccgggacggttacgggtaccggtaggttacggaactaaggtaaacctaaggtaacgttcggacgtacctgaccttacgtcttacgtcg

SEQ ID NO: 270070 - DNA, 664 bp, Homo sapiens
  misc_feature: GYAE6OF02GXSUY.39.50.E06.1.454.CMB.1.raw
  modified_base (206)..(206): a, c, t, g, unknown or other
  misc_feature (206)..(206): n is a, c, g, or t
  modified_base (373)..(373): a, c, t, g, unknown or other
  misc_feature (373)..(373): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtcctccgaaggggaanacgccaccctctcctgcacgggccagtcagactatagcagctaacttagcctggtaccagacaaaacctcggaccacgacctccgacggtcctcctacacgttgtacgtcggtcgccgtaccgaccgacgggcctacgtcggtacctcccgacgccgtacggttacncggtggcgtaggtcgggtcgtcgggacaggtacgttcgtacgtctccgacctacgtcgacgctacgccgtcgactaggtcttaggtaacgttagttttacgttaacttttacttacgttctacgtacgtacgtacgttaaccgtacgttaccgttccgccttaccgtacgtttaccggttacggaccggacgggttaccgtagggttacggtaacgtaacgtaaccgtaaaccggtacgttacggttacggacttccggaaccgttaccgtacgtttccgtacgtttcccg

SEQ ID NO: 270071 - DNA, 516 bp, Homo sapiens
  misc_feature: GYAE6OF02GHVW6.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagatacccactggagaagtagtgatgacgcagtctccagccaccctgtctgtgtctccaggggaaangccaccctctcctgcagggccagtcagactattagcagcaacttagcctggtaccagcaaaaacctggccagactcccaggctcctcatgtatggtgcgtccaccagggccactggtatcccagccaggttcagtggcaggtgggtctgggacagagttcagtctcaccatcagcagcctgcagtctgaagtattttgtactttattactgtcagctagtatgatacctggcctcacacttttgacctaggggtaccaggttcggagtatacgaaaccgtaacgtgtacggctgaccgacctagtcttacg

SEQ ID NO: 270072 - DNA, 716 bp, Homo sapiens
  misc_feature: GYAE6OF02F9C40.39.50.E06.1.454.CMB.1.raw
  modified_base (204)..(204): a, c, t, g, unknown or other
  misc_feature (204)..(204): n is a, c, g, or t
  modified_base (708)..(708): a, c, t, g, unknown or other
  misc_feature (708)..(708): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggcctcccagataccactggagaagtagtgatgacgcagtctccagccacctgtctgtgtctccgaggggaanagccaccctctcctgcagggccagtcagactatagcagcaacttacgcctggtaccagacaaaaccgtgaccagacctcccaggctacctacatgtatggtcgcgtccaccgacggccacgtggtactcccgagccgtaggtttcaggtcggcgtagggtcgggttcgtaggggacctaggtacgttacgacggttcctacccgaacctacgttaccgtaacggacctaacggtcccttcggaccgtacggtcttaaacgggtaacgtttagttttttaccggtttaaactttttaaccttttaccgttcggtaacctacggtaccgttaagttacgttacggttaacctttacccggttacggtcccttaaccgttaccgtttaccgttttaccggggacccgttaacggggggtacccttaaggggttacggtaagttaaccgtaacgtaaaccggtaacgttcggtacggttaccggtaccgtacccggtacttacggttnttacccgg

SEQ ID NO: 270073 - DNA, 584 bp, Homo sapiens
  misc_feature: GYAE6OF02FIA8O.39.50.E06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaancgccaccctntccctgccagggcccagtcagactattagcagcaacttagcctggtaccagcaaaacctggccagactcccaggctcctcatgtatggtgcctccaccgagggccactggtactccccagccgaggttcagttgccgaggtcgggtctcggggacaggtagttcgagtcgtaccaccgatcgagtcagcctgcaagtctagaagtagttttacgtactttaagttactgtacgtacgtcaaggttactgtaacttaccctgggtacccttctactacgttttcgaccgacgggggtaccctagggttcggaagtcgtaaccgtaaaaccgacgttaggtcggtactccgtaccgacctacttcgttccgg

SEQ ID NO: 270074 - DNA, 521 bp, Homo sapiens
  misc_feature: GYAE6OF02IWTO7.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagngccaccctctcctgcagggccagtcagactattagcagcaacttagcctggtaccagcaaaaacctggccagactcccaggctcctcatgtatggtgcgtccaccagggccactggtatccagccaggttcagtggctagtgggtctgggtacagtagtcagtctcaccatcagcagcctgctagtctgaagtatttgttacttttattactgttcagtcagttatgactactggccttactactctttagggccgtaggggaccgtaggttaggagatacgaaacgtaacttggtaggtcgtgcacctatctacg

SEQ ID NO: 270075 - DNA, 658 bp, Homo sapiens
  misc_feature: GYAE6OF02F5I0Y.39.50.E06.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtccagtactattagccagcaacttagcctggtaccagacaaaaacctggaccagactcccgaggcctcctacntgtatggtgccgtccaccgaggtcctacgtgtactcccgactccgtagtccgagtcggacacggtgggtactgggacgagtagttacgagtccgtcaacactacgaacgtcgtaagccctgtaccgtagtcgttaggaagtttacgtttttacgttaacttttaacgtttaacgttcgttaactacggtaacttaacggttacgttacgttactaacccgttacggttccctactttaacgttaccgttttaccgggaccggtacggggttaccgtagggtttacgggaacgtacgttaaacgtaaaccgttaacggttgggttcgtacgtcggtaacctaccgtacgttccgttacg

SEQ ID NO: 270076 - DNA, 585 bp, Homo sapiens
  misc_feature: GYAE6OF02FKEOH.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactattagcagcaacttagcctggtaccagcaaaaacctggccagactcccaggctcctcatgtatggtgcgtccaccagggccactggtactccccagccaggttcagtggcagtgggtctggggacaggagttcagtctacaccatcagcagcctgccagtctaggaagttattttgttaacttttattacgttgtctagtctagttatagacttacccgtggccttacgaccttacgttttcggacccgtagggggtaccctaggggtttacggaacggtacgttaaccgtaaaaccggtaacgtggtacgggtccgtaggtaccctaaccgttagttacccgtttacgg

SEQ ID NO: 270077 - DNA, 545 bp, Homo sapiens
  misc_feature: GYAE6OF02GKQGO.39.50.E06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (406)..(406): a, c, t, g, unknown or other
  misc_feature (406)..(406): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctntcctgcagggccagtcagactattagcagcaacttagcctggtaccagacaaaacctggaccagactcccaggctcctcatgtatggtgccgtccaccgagggccactggtactcccagccaggttcagtcggcaggtgggtcgtgggacaggtagttcagtctcaccatcagcagcctgcagtctgaagtntttgtactttattactgtcagtcagtatgtactaccgtggtaccctcgactacgttttggaccgtaggggtacctagggttggagtaacgtaccgaaacgtaacgttggtacggtcgtaccgactacctagtccgtacg

SEQ ID NO: 270078 - DNA, 908 bp, Homo sapiens
  misc_feature: GYAE6OF02FUML0.39.50.E06.1.454.CMB.1.raw
  modified_base (222)..(222): a, c, t, g, unknown or other
  misc_feature (222)..(222): n is a, c, g, or t
tcagtcgcactagtcacgaccggtgctcgatttagatctactgacaacacacaaggggaggaactagctcagttaggacccagacggaaccatggaagccccagcgcagctctcttcctcctgctactctggcctcccagactaccactggagaacgtagtgaatcgacgctacgtctacccagacccaccctgtcctgtgtaccctccgaagggggaaacncgtcccaacccttcgtcccctaggccgacgggccctacggtcaaggacttaagttacgcgaatccgtaacttacgcgtacgaccgtacgaaccgtaaaaacctcggaccgaacgtaccgttacccccgaacgggtcccttaccccgttaacgaccgttaggtaaccgttacgggttaacgtaccccggtcccgtaaaccccgggaccggggtaacccgtaacccgggtttaccggttaaaccttaccccccggaaaaccggtccccggtaaacgggtttacccgtaagggttccggggtaccgttaaccgggggttcggggttacccggttccggggggtaaacccgtaggggttaaccccgttttagggtaccgttacccggttttaaccccgaaccgttaaccggccgtaaaacgggtccctaacgggcccctttaccgggacctaccggttacgtaccggtaaggttaccgtttttaggttaaacccttacgttttacgaacgttccgtacgtaccgggttattacggtacgttacgtttacccgtaggtaccttacttacgttaccgtttacggggtaccgcggggtaacccggtacggtttacgggtaaaccggtacttaaccgggaaacgttaccgttaggtcggaacgttacgcccgtaaaccttggtccctttaacgg

SEQ ID NO: 270079 - DNA, 617 bp, Homo sapiens
  misc_feature: GYAE6OF02GGS4J.39.50.E06.1.454.CMB.1.raw
  modified_base (205)..(205): a, c, t, g, unknown or other
  misc_feature (205)..(205): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagactattacgcagcaacttagcctggtaccagacaaaacctggaccacgacctccgaggcctcctcatgtactggtcgccgtaccaccgacggccacgtgtactcccgacgcgtacggttacgagtggcgaggtgggtcgtagggaccagtacgttcagtctaccacatcgacgcgtacgcctgccgtagtctagtaacgtatttttacggttaacttttacttacgtgtacacgtacgtagttatacgtacttaccgtcgtaccttacgtactttacgttcggaaccggtacggggtaccgtagggttacggaagttaaccgtaacggaaacgttaaccggtaggtaccggtacgtaccgaccgtaccgtacgttccttacgg

SEQ ID NO: 270080 - DNA, 750 bp, Homo sapiens
  misc_feature: GYAE6OF02H3JT9.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtctcgaaggggaaagcgcccaccctctcctgccgacgggccagtcaacgtactattagcagactaacttacgccgtggtaaccagaaccaaaaaccgtcggaccaacgacctcccgacggcctaccctacatggttacgtggtcgccgtaccaccggacggacctacgtcgtactccccgacgtaccgtacggttactacggtcggtacgtaggttcggggtcgtaggggaaccaggtagttacgtacggttcctaccaacctacgtacgacggactaccggtccctacggtaccgtacgttcgtaggttaacgtttagttttttacgttaacgttttacgtttacgtcgttaaccagtacctagttaacgtacgtaccgttaccgttccggtacccttacgttaaccgttaccggttttacgggacccgggttaacggggtaccggtttaggggttaacgggaacggttaaccgttaacccggtaaaaccggttaacggttcggttaccgggtccgttaaccggtacccgtaacccgttccgtttacggtttacccgg

SEQ ID NO: 270081 - DNA, 649 bp, Homo sapiens
  misc_feature: GYAE6OF02JYVX6.39.50.E06.1.454.CMB.1.raw
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (562)..(562): a, c, t, g, unknown or other
  misc_feature (562)..(562): n is a, c, g, or t
  modified_base (633)..(633): a, c, t, g, unknown or other
  misc_feature (633)..(633): n is a, c, g, or t
tcagtcgcactagtcacgaccggtgctcgatttagatctactgacaacacacaagggggaggaactgtctcagttaggacccagacggaaccatggaagccccagcgcagcttctcttcctcctgctactctggcctcccagactaccactggagaagtgtgatgacgcagtctccagccctacctgtctggtactctccgaaggggaaancgtcccacctcgtaccngcgacgggcctagtcacgacttataggccaggcctaacgtacgtccgtacggtaccaagtaaccgaaaaaccgttcggacctaagaccttcccgaacggtccttcccacgaacgtgtaactggccggtccgttaccgaccgtacgggacctacgtacggtacctccgaagtccgtaacggttcgaacggtcgaggtcggtagggtccgtagggactaaggtcgtacgtacgttccgactaccagtcgacgtcggtactcgtgacgtgtacgtagtaccttagtttactacttttagtcccgtatcgagtcttagacttacgtctaaccggttcnccgttaatcgtctacggacgtaacgggtcctaggtacgactacggtaacaacggttactcggtacgcggtnactacgtattccgtag

SEQ ID NO: 270082 - DNA, 527 bp, Homo sapiens
  misc_feature: GYAE6OF02GLZAL.39.50.E06.1.454.CMB.1.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
  modified_base (521)..(521): a, c, t, g, unknown or other
  misc_feature (521)..(521): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaancgccaccctctcctgcagggccagtccagactattagcagcaactagcctggtaccagacaaaacctggccagactcccaggctcctcatgtatggtcgccgtccaccgagggccacgtcgtactcccagccaggttcagtggcagtggtctcggacagagtcagtcgtcaccatcagcagcctgcagtctgaagtntttgttactttattactgtcagtcagtatagtactacgtgtacctctactacgtttcggaccgtagggtacgtaggtggtagtactaccgaacgtacgtgtacggtctcgccacgtactnttaccg

SEQ ID NO: 270083 - DNA, 701 bp, Homo sapiens
  misc_feature: GYAE6OF02G58HY.39.50.E06.1.454.CMB.1.raw
  modified_base (213)..(213): a, c, t, g, unknown or other
  misc_feature (213)..(213): n is a, c, g, or t
  modified_base (649)..(649): a, c, t, g, unknown or other
  misc_feature (649)..(649): n is a, c, g, or t
  modified_base (688)..(688): a, c, t, g, unknown or other
  misc_feature (688)..(688): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggcctcccagataccactggagaagtagtgatgacgcagtcctccgacgcccaccctgtctgtcgtctaccgaaggggaaanacgcccaccctctccgtgccgacggccagtcacgacttatagcagacctaacgttacgccgtacgtaaccagaaccctaaaacgtcgaccagaccctccgacgtccctaccgtctagtgtacgtcggtaccgtccgtacccgaccggacggtccctacgttacggtaccctaccccggacggtcccgttaggttacgacgggttcgggacgtacgggttcgggtcggtagggactagggttacttaccgcgttcccgtaccgactcgtacgacgtccggaccgtcctcgtaccgtagttaccgtaagttaacggtttacgttttacgttaacttttacgttcgtaacgtcgtacgtcgtaagttaccgtccgtaacgttccgttccgtacttaccgttacgttcggttccggacgggtcggtaccgtggtaccggngtaacgaccgtaaagtcgttaggacgttgaccgttaccngtaccgtttccgg

SEQ ID NO: 270084 - DNA, 518 bp, Homo sapiens
  misc_feature: GYAE6OF02FYSKS.39.50.E06.1.454.CMB.1.raw
  modified_base (357)..(357): a, c, t, g, unknown or other
  misc_feature (357)..(357): n is a, c, g, or t
tcagtcgcactagtcacgaccggtgctcgatttagatctactgacaacacacaaggggggaggaactgctcagttaggacccagacggaaccatggaagccccagcgcagcttctcttcctcctgctactctggctcccagataccactggagaagtagtgatgacgcagtctccagccaccctgtctgtgtctccagggggaaagagccaccctctcctgcagggccagtcagactattagcagcaacttagcctggtaccagcaaaaaacctggccagacctcccaggctcctcatgtatggtgcgtccaccagggccactggtactcccagccaggttcagtgcaggtgggtcngggacagacgttcagtctcacatcagtcagcctgctagtctgtaagtattttgtacttttattacttgtctagctagtatgtctactcggcttcactcgtttcgcgtacgggctagggtcgagtatacgaaacgtacgtgtggactggtacactatcgtcg

SEQ ID NO: 270085 - DNA, 786 bp, Homo sapiens
  misc_feature: GYAE6OF02F5LTX.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtcgtctccgaggggaaacgacgtcccacccttctcccgtacgtcgaacgggtcccaaggttaccaacggtactaacgtttaggaccaacggtacctaaacgtttacgccgttacggtaaccgacggtaaccaaaaaccgttcggaccaacggacctacccgacggtcctacctactagttacggtacgtcgggtcgtcccgtaccgaccggacgggtacctacgttaccgggttacctccccggaacggtccgtaacggtttaccaacgggttcgggacgtacggggtttacgggtcggtacgggtacgacggtacggttacgaccggttcctaccgaaccgtaccgttaccgacgtaccgacgtaccgttcggacgttacgtacgttacggtaaagtttacgtttttaccggtttaactttttaacgttacgttaccggttaacgtacgtacgtaaggttacgtacgttaccgttacccgtcgtacccgttacgttaaccgttcgtttccgggaacggttacgggtacgtagggtaacggtcgaagtttaccgaacgtacgtcggttacgacgtacgaccgtaccgtgtcccttacg

SEQ ID NO: 270086 - DNA, 852 bp, Homo sapiens
  misc_feature: GYAE6OF02H923R.39.50.E06.1.454.CMB.1.raw
  modified_base (206)..(206): a, c, t, g, unknown or other
  misc_feature (206)..(206): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccacctgtctgtgtcctccgaggggaaancgcccaccctctcctgccgacgggccagtcagacttattagcacgactaacttgaccttaggtaaccaacggtaaccaaaaaccgtcggaccctaacgacccgtaccccgacggtcccttacctacctacgttacgttaacgttcgggtacgtacccgtaccccgaaccggtacgggtaccctaacggttacggttaacccgtccccgtaaggtaccccgttaagggttccgtaacgggttacgggtacccgtaagggttcggggttacggtacggggtaaaccgtacggtacggtttacgtaccggttaccctaccgtaaccctacgttaccgaacggtaccgaccgttcccgtacggaccgtacggttaccgttaaggttaaccggttttagtttttaacggttaacctttttaacgtttaaccggttacggttaccaacggtacttaacgtttacgtaacgttacccgttacccggttaccgtacccttaacgttaacccggtttaggttttacccgggacccgggtaacgggttaccggttaacggggtttacggaaacggttaccgttaaacggaaaacccggttaagtccgggttacgacccggttacgtacccggttaactacccggttccgtttaccg

SEQ ID NO: 270087 - DNA, 704 bp, Homo sapiens
  misc_feature: GYAE6OF02G228L.39.50.E06.1.454.CMB.1.raw
tcagtcgcactagtcacgaccggtgctcgatttagatctactgacaacacacaagggggaggaactgctcagttaggacccagacggaaccatggaagcccagcgcatcttctcttcctcctgctactctggctccagataccactggagaagtagtgatgacgcagtctccagccacctgtctgtgtctcgaagggaagacgccaccctctctgcgacgggccagtacacgtacttatacgcgagactaacttacgcctacggtaccagaccaaaaccgtcggaccacgacctacccgagtcctaccgtactaactcggttacgtcggtacgtcccgtacccgaccggtaccgggtacctaacgttcgggtacctccccgacggtaccgttacggttacgacggtcggtacgtgggtcgggtacggtacgggtacgtaggttacgttactacggtacctaccgtaacctactacgacggtcgaccgtccgtacggtacgtacgtacgttacgttaacggtttacgttttacgtttaacgttttacttagttacgttacgacgttatagttacgtactacgtaccgtcgtaccttacgtaccgttacgttccgggacgtaccggtacgggttcggtaggtaacgtaacgtaacgtaacggttacgtgggttactacggtacgaccgtacgttacgttcttaccg

SEQ ID NO: 270088 - DNA, 744 bp, Homo sapiens
  misc_feature: GYAE6OF02IQN1P.39.50.E06.1.454.CMB.1.raw
  modified_base (522)..(522): a, c, t, g, unknown or other
  misc_feature (522)..(522): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctcacgccaccctgtctgtgtcctaccgaggggaaacacgcccaccctcctcctggcgacgggccagtacaggtaacttagttacgctacgactaacttacgaccgttcggaacccgaacgaacctaaaaccgtcggtacccaacgaccttcccgaacggtccctacctactagtcgttaacgttcggtcgaccgttacccgacccggtacgggaccctacggttacggtaacctaccccgaacggtcccgtaacgggttactacgggtcggacgtacgggttacgggtcggtacgggagtacggtacgtccgtacgtccttaccgaccacgttacgtacgacgacggtccncggtactcgtcgtaacggtaagttacgttttacgttaacttttacgttcgttacgtacgtagttaccgaagttacgttacgtaccgttacgtccggttaccttaccgtaaccttcgggtttaccgaccgggtaacgggtacccggtaggttacggaacgttaacgtaaccggtaaccgttaagttccggtacgtacgttacgacctaccgtactacgttccg

SEQ ID NO: 270089 - DNA, 549 bp, Homo sapiens
  misc_feature: GYAE6OF02FMR41.39.50.E06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctccctgcagggccagtcagactattagcagcaacttagcctggtaccagcaaaaacctggccagactcccaggctcctcatgtatggtgcgtccaccgagggccacgtggtactccccagccaggttcagtggcaggtgggtctgggacagagttcagtctcaccatcagcagcctgcagtctgaagttcttttagtaacttttattactgtacagcaagtatagtataccgtggccttcacttacgttttggcccgtaggggtaccagggttgggacgtaagtacctaaacggtacgttaggtacgtcgtaccggactaaccctagtccgttcg

SEQ ID NO: 270090 - DNA, 605 bp, Homo sapiens
  misc_feature: GYAE6OF02JYRON.39.50.E06.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (386)..(386): a, c, t, g, unknown or other
  misc_feature (386)..(386): n is a, c, g, or t
  modified_base (558)..(558): a, c, t, g, unknown or other
  misc_feature (558)..(558): n is a, c, g, or t
  modified_base (579)..(579): a, c, t, g, unknown or other
  misc_feature (579)..(579): n is a, c, g, or t
  modified_base (586)..(586): a, c, t, g, unknown or other
  misc_feature (586)..(586): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcngcncgggccagtcagactacttagccagactaacttggccttaggaccagacctaaaaccgtggaccagacctccgaggtcctcctgatgtatcggtgcctaccacgtcggccctaagtcggaactcccgagccgtaggtcacggtcgctaggtcggtcgtagggacnggtacgttacgcgtcctaccgacgacgtccgaagccgtacgtcccgtagtcacggttctaacggagtttactttgttaaccgtttatacgtagtcctaagtacgtaacgttctaagtccttaacgtccggtacctactaacttcggtaccgtaccgtcggacgtggtaacgngtaacctggaaacgtcgtagnggtacgngacctacctagtcgtaacg

SEQ ID NO: 270091 - DNA, 658 bp, Homo sapiens
  misc_feature: GYAE6OF02JF0JN.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcaggggccagtcagactattagcagacaacttagcctggtaccagacaaaacctggccagactcccaggctcctcatcgtatggtcgctccaccgacgggcctacgtggtactccccgagccgtaggttccaaggtcggactagggtcggggtacgtcggggaacaggtaacgttcacggttctaccaacctataccgtagcctaagccccgtgaccgtaggttcctagtaaacggttatttttaggttaaccttttaattaacgttcggttacacggtacgtaagttagtagtaaccttacccgttacgcccttactacgtttacgtttcggacccgtaacgggggtacctaggggttcgggaacgttaacttaaccgaaaccggtaacgtttggacgggttaccgtcggtaccctaccgtacgttacccgtttacgg

SEQ ID NO: 270092 - DNA, 593 bp, Homo sapiens
  misc_feature: GYAE6OF02HEPQR.39.50.E06.1.454.CMB.1.raw
  modified_base (205)..(205): a, c, t, g, unknown or other
  misc_feature (205)..(205): n is a, c, g, or t
  modified_base (372)..(372): a, c, t, g, unknown or other
  misc_feature (372)..(372): n is a, c, g, or t
tcagtcgcactagtcacgaccggtgctcgatttagatctactgacaacacacaagggggaggaactgctcagttagggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactatagcagcaactagcctggtaccagacaaaacctggccagactccaggcctcctcatgtatggtcgcgtccaccgagggccactggtactcccacgccaggttcagtggcgagtgggtctgggacagagttcagtcncacatcagcagcctgctagtctagtaagtacttttgtaacttttatacgtgtacagtactacgttattacgtacttaccgtggtcccttaccgtaccgtttacgttttacgggacccgtagggggtacccgtaaggggtttaggaacgtaacggttaccgaaaaccggttaacgttacgggttacgggtacttacggtaccacccgttactccgtttacgg

SEQ ID NO: 270093 - DNA, 887 bp, Homo sapiens
  misc_feature: GYAE6OF02JV6EJ.39.50.E06.1.454.CMB.1.raw
  modified_base (167)..(167): a, c, t, g, unknown or other
  misc_feature (167)..(167): n is a, c, g, or t
  modified_base (262)..(262): a, c, t, g, unknown or other
  misc_feature (262)..(262): n is a, c, g, or t
  modified_base (460)..(460): a, c, t, g, unknown or other
  misc_feature (460)..(460): n is a, c, g, or t
  modified_base (821)..(821): a, c, t, g, unknown or other
  misc_feature (821)..(821): n is a, c, g, or t
tcagtcgcactagtcacgaccggtgctcgatttagatctactgacaacacacaagggggaggaactgctcagttaggacccagacggaaccatggaagccccagcgacagctttctcttcctcctgctactctgcctccagtactaccagtaggaagtaagtagtancgggacctctacgtctcccaacggccctaccctggttcttcgaacgttccggaaccgggaagggaaaccgccctccccgttaacccctcggttcncccgggacgggtaccgtacgtacgtaaccggtaacttacttaggacgttacgaaccttaaccgtttaccgccgttaccggtaaccgacgaaacccgtaaaccgtaccggacctttttaaccgccccgtaacccggtccggtacccgttccctacgttacgttacgttccgggttcgacccacgggtttttaaaccccncgggggggttttaaccccccttaacccccggtttttttaggaccgttacggtacccgaaccggttcggttacggagttttccggtttaaaggtaccgggtacggttcccctaaggtaccgttaccgtaaccggtacctaccgtaaccgtaccgtacggtaccgttaccgacgtaccgtaccgttacggaaacccttcggggtttacgtaacgtttagtttaccgtttacgtacgttacgttagcccctaagttcgtacgttactagtaccttactacgtaaccgtttacggtaccgtaacgggttacggtaccgtttacgggaaccttaggtcgaacgtacgtacccgctcgaaaccgttnttaccgttacgtaaccgtacccgttaccgtccgtaacccttaccggtaccttaccgttaccgtacg

SEQ ID NO: 270094 - DNA, 792 bp, Homo sapiens
  misc_feature: GYAE6OF02HHF7J.39.50.E06.1.454.CMB.1.raw
  modified_base (121)..(121): a, c, t, g, unknown or other
  misc_feature (121)..(121): n is a, c, g, or t
  modified_base (278)..(278): a, c, t, g, unknown or other
  misc_feature (278)..(278): n is a, c, g, or t
tcagtcgcactagtcacgaccggtgctcgatttagatctactgacaacacacaagggggagaactgctcagttaggaccagacggaaccataggacgcccagcgcacgctctctcctcctnctctctggcctaccagactaccactggaacgtaagtacgtgagtgacggctacgtctccaaggccaccctgtcctggtcgtactaccgaaggggaaacgtgaccctaacttcgtcctagacggacggccgtaagtacggaactacgttacgtaacgngtaacggtactaaaccgtaacgtccgtacggtaacgaacgaacgaaaaacctcggaccgaagtacctaccgtacgtaccgttacctacctaagttacgtacgtacggtcgtcgtaccccgaccggacggacctacggtaacgaccttacccgacggtaccgtacggttacctacggacggtacgtacggcgggtttacgacgggtaacgtacggtaacgttcgtaacggtaccgttcccgtaaaccgttacacggtaaccggtctaaacccgggtcgtacccgggactaccggttaacgtaaccggtaaacggttttctttaaccggttaacttttaaacgtttacgaacgggttctaacgggtaacctcggttaaacctacggtaacgtttacccgacgggttccttaacgacgtttacggttaaccggcggtaacggtaccgtagggttcgtaaagacgttaaacggacgttaacggacggtgtaaccgacgttaccgacttaccgtgtacg

SEQ ID NO: 270095 - DNA, 739 bp, Homo sapiens
  misc_feature: GYAE6OF02G20TM.39.50.E06.1.454.CMB.1.raw
  modified_base (175)..(175): a, c, t, g, unknown or other
  misc_feature (175)..(175): n is a, c, g, or t
  modified_base (620)..(620): a, c, t, g, unknown or other
  misc_feature (620)..(620): n is a, c, g, or t
  modified_base (632)..(632): a, c, t, g, unknown or other
  misc_feature (632)..(632): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagatacccactggagaagtagtgatgaccgcagtccnccagccaccctgtctgtcgtctccgaagggaaagcgcccaccctctccctggacgacgggtacctagtccgaacgtacttaacgttacggaccaagtaccgtaacttacggcccgttaccgggttaaccacggtaaaccctaaaaaaccggtcggtaacccgaacggaacccccgttacccgaacgggtccttaccctacgaacgtttagtacgttcgggtccgtcccggtaacccgaccggtaccgggaccgttacgtaggttcccgtaccccgtacggtaccgttacgggttaccgtaacgtcggggaccgttaggggttacggtccggtagggaactacggtagttaccgacggttacccacctaacccgtatcgacgcctacggtctccggacgtacgttgaacgtagtttgtttacgtttaacgtttacgtacgtacgtntacgtattaagngttactcgtaccgttcgaccttatccgtttaaggtcgaccggaccgtagtacggtgaacgttactaacgaaccgtgtacggtcgacgtaccgtctactcgtagttcc

SEQ ID NO: 270096 - DNA, 704 bp, Homo sapiens
  misc_feature: GYAE6OF02JCZTD.39.50.E06.1.454.CMB.1.raw
  modified_base (675)..(675): a, c, t, g, unknown or other
  misc_feature (675)..(675): n is a, c, g, or t
tcagtcgcactagtcacgaccggtgctcgatttagatctactgacaacacacaaggggggaggaactgctcagttaggacccagacggaaccatggaacgccccagcgcagcttctcttcctcctgctactctggcctcccagactaccacgtggagtaagttagtgatgacgcagtcctaccacgccctaccctgtcgtgttcgtctaccgagggggaaaccgccctacccttctccgtgcgacgggccagtcagtacttatacggcagcctaacttagccgtacggtaccaacgaaccaaaaccgtcggaccgtacgtacctcccgacgtcctacctactagttcgtacggtcgtcgtccgtaccgaccggtacggtacctacggttacggtacctacccgacggtaccgtcggttacacgggttcggtccggtagggttcggtacggtacgggtacgttaacgttacgtttaccaacggttcaaccctacgtactaccgacgtcgtacgccgtcgtacgtacgttcgtagttagtttactttactttctttacgtttctgtacctagtctagttctacgtactcgaacgtctacgtaccgttcgttacggaccgtcgggtacgtaagggtcgtaacgtaacgtaacggtaacgtcggttacgtcgggttacnccgggtaacctactacgtttcttaaccgg

SEQ ID NO: 270097 - DNA, 873 bp, Homo sapiens
  misc_feature: GYAE6OF02G98IW.39.50.E06.1.454.CMB.1.raw
  modified_base (531)..(531): a, c, t, g, unknown or other
  misc_feature (531)..(531): n is a, c, g, or t
tcagtcgcactagtcacgaccggtgctcgatttagatctactgacaacacacaagggggaggaactgctcagtaggacccagacggaaccatggaacgcccagcgcagtcttctccttcctcctgctactcgtcggcctcccaagactaccacgtggaagtaacgtagtgatacggacgactgtcctccgaacgtcccgaccctgtaccttgttaccggtccgtaccggaaagggggtaaagaccgacccctacccgttccgttacccgtcgaccgggacgggtacctaacgggaccaacgttaacttacgtacggactaaacggtacctaaaccgttacgaccggtacgtaaccgaaacgtaaacctaaaacccgtcggaaccaacgtacccgtaccgaacggtcccttacgactacgtagttacgtggtccgaccgtaccaccggaacgggaccacggttacggtacctcccggaacgaccggttagtacggtagtacggggacgttacggggttagggttacccgggngggaacgtacgggtaaccgttccggtaacgtttaacccacccgttaaacgtaccgggtacgaccgaccggtaaccgtcggtccaacgttacggttccgaaaagtttaaccggttacgttttacggtttaccttttaaagtccgttaacgtcgtaacgttacgttagttacgtaccggttaccgttaccggtcgtaaccccttacgttaacccggttaccggttacgggaacccgggttagtacccggggttggttaacgggaaagttaaaccccgtaacggttaaaaccgtcggttaacgggacgttacggtacgacccgtaacgtttccgtaaccgtttcg

SEQ ID NO: 270098 - DNA, 702 bp, Homo sapiens
  misc_feature: GYAE6OF02HDGU8.39.50.E06.1.454.CMB.1.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtcgtcctaccgagggggaaagacgcccacccctctccctagcgacgggcctagtccgagtaccttagttagactagactaaacttacggccttagggtacccaacggaaccctaaaaacccgtcgggacccaacgaaccctacccgacggccctccgtacagttacgtacgtggtcgaccgtcccgaccggacgggtacccacgtcggtacctacccgacggaccgtacggttccagggtcggacgtacggtcggggtcgtacggggacgtaggtacgttcgagtcctactacctgtaccagtccacgtccgtacgctagtcgtaacggttaagttagttttacggttaactttttacgttcgtacgttcaacgtctacgttagtaccgtcgtttaccgtcgttaccctaccgttaacttacggtttaccgggaccggttacggtacggtaggttacggaagtacgtaaccgtaacggtagttggtcgttacgcgacctacgtactcgttaccg

SEQ ID NO: 270099 - DNA, 863 bp, Homo sapiens
  misc_feature: GYAE6OF02FOLX3.39.50.E06.1.454.CMB.1.raw
  modified_base (122)..(122): a, c, t, g, unknown or other
  misc_feature (122)..(122): n is a, c, g, or t
  modified_base (229)..(229): a, c, t, g, unknown or other
  misc_feature (229)..(229): n is a, c, g, or t
tcagtcgcactagtcacgaccggtgctcgatttagatctactgacaacacacaagggggagaactgctcagttaggacccagacggaaccatggaagccccagcgcagcttctcttcctccngctactctagcctcccagactaccactggagaagtagtagatgacgctagtacctccgagccctaccctgttacctggtctaccgtaccggaagggtaaaccggacncccctaccctccttcccgcgacggtacgggaccctaagggtcaacggtacttacgtaacgactaacgtacctaactacggtccgtacggtaaccaacgaacctaaaaaccttcggaaccgtaccggaacccgtacccgttaggccctttacccaacggtacgttacggttaacgttacgggtccggtacccgttaccccgaaccgggtttaccgggaacccgttacggttaccgggtaacctaccccggtaccggttccttaaccggggtcggtaagtccggtaaccggttggttccgggtaccgtaaggtaaccgtcgggtaacggtttctaccggtctaaccgtaacgtatacgacgtacgaaccgtcgtacggtactacggtcttaacggttacgttagtttttaccgttaaacgttttccgttacgtacgtaaccgttaacggtaccgtacggtttaacgtacgttacccggttaccgttacgtccgtttaacccgtaacgtttaccggttaaccgggtacccggttacggggacgttacgggttaacggaaccgttaaccgtaaaccgtaaaccggttcggtaacgccggtttacggaaccttacccggtatacccgttggttaccccg

SEQ ID NO: 270100 - DNA, 805 bp, Homo sapiens
  misc_feature: GYAE6OF02HQ1CE.39.50.E06.1.454.CMB.1.raw
  modified_base (209)..(209): a, c, t, g, unknown or other
  misc_feature (209)..(209): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggctcccagactaccactggagaagtagtgatgacgcagttctccacgccctacctgtctgtgtctccgaagggaacncgcccaccctctcctgaccacggccagtcaacgacttagttacgcacgactaacgttacgccgttaggtaaccagaaccgtaaaaaccgtcggaccacgtaccctacccgacggtaccttcctacgacttacgtagttcgggcgtaccgtaccgaccgacgggcctacggtacgtactaccccgacgtaccgtaacggtccgtaggtccgggacgtacggggttacgggtacggtaggggaaccgtaggtaacggttccgtaacggttaccgtaccgtaccgtacgttcggaacgtaccgtaaccggccgttacggaccggttacgtacggtacggttaaacggttttaagtttttaaccggtttaaactttttaacgttaacctttagttaacccgtacggttacgtaacgtttacgttacgtaacccgttacgttaccgttaccgttaccgttaacgtttaccggtttaaccgggaccgggttaacgggacccggttaggggtaccggtaaacgttaaccgtaaccggtaaaccgttaacggtacggttacgggtacctaccggaacccggttacgtaccgttttacgtaccgg

SEQ ID NO: 270101 - DNA, 787 bp, Homo sapiens
  misc_feature: GYAE6OF02IAZGN.39.50.E06.1.454.CMB.1.raw
  modified_base (92)..(92): a, c, t, g, unknown or other
  misc_feature (92)..(92): n is a, c, g, or t
  modified_base (212)..(212): a, c, t, g, unknown or other
  misc_feature (212)..(212): n is a, c, g, or t
  modified_base (309)..(309): a, c, t, g, unknown or other
  misc_feature (309)..(309): n is a, c, g, or t
tcagtcgcactagtcacgaccggtgctcgatttagatctactgacaacacacaagggggaggaactgctcagttaggacccagacgaaccanggaagccccagcgcagcttctcttcctctgctactctgcctcccagactaccacgtggagaagtgtgatgacgcagtctcgacgcccaccctgtctgtagtcctaccgaagggggaaacncgcccacccttctaccgtgccagggccagtacagtacgtattacgacacgactaacgttacgaccgttagtaaccgaagaaacccgtaaaaacccgnggaaccctaacgaacccgttaccccgacggtaccccttctaccgtaagttacgttacggtcggtacggtcccgttacccgaaccgacggggtaccctacgttacgggtactaccccgtacgacctacggtacgtacggtcggtagtacgggtacgggtaccgtaggacctacggttacttccgtaggtccctacaccctgtacgaccgaccgtcgtacccgtgacctcggtaccgtaaggtttacgttttaattttaacggttacctttttaaggtctaacgtacgtacgacgttacgtttaacgacgttaccttcccggtagttccctaacgtttcgttaacccggtttggaaccccgggttaggtaaccgggttaaggttaacggtaacgtaaaacctttaaccggaaaaccgggtttctttaaccgggacggtttaccctaccggaacccgtttaaccttcgggttacttccccg

SEQ ID NO: 270102 - DNA, 652 bp, Homo sapiens
  misc_feature: GYAE6OF02H1QXT.39.50.E06.1.454.CMB.1.raw
  modified_base (154)..(154): a, c, t, g, unknown or other
  misc_feature (154)..(154): n is a, c, g, or t
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
tcagtcgcactagtcacgaccggtgctcgatttagatctactgacaacacacaagggggaggaactgctcagttaggacccagacggaaccatggaagccccagcgcagcttctacttcctcctgctactctggctcccagactaccactgganaagtagtgatgacgcagtcctcagccacctgtctgtagtctcgaggggaaangccaccctntcctagccgacgggcctagtcaacgacttagttagcagacaactttagcctaggtaaccaagacgaaaaaaccgtggaccaagtacctacccgaaggcctacctaccgaattcgtacgtggtagtccgtacccacgaacgggccaacgtcggtaactcccgacgcctaacggttcacggtgaacgtggtacgggtcgtacgggacaggtagttacgagttcactaaccacgttcagtacctagccctggactacgggtacaagtaagttaacgttttagttaacgtttttaacttactgtacgtagctaagtatacgacttaccgttcgaccttacaaccgtttagtttaccgggccgtaagggtccgttaaggttcggaagtacgttaccgaaaactacgtcgggtagtaccgtagaccctagtacttacgttacg

SEQ ID NO: 270103 - DNA, 746 bp, Homo sapiens
  misc_feature: GYAE6OF02FQSXC.39.50.E06.1.454.CMB.1.raw
  modified_base (214)..(214): a, c, t, g, unknown or other
  misc_feature (214)..(214): n is a, c, g, or t
tcagtcgcactagtcacgaccggtgctcgatttagatctactgacaacacacaagggggaggaactgctcagttaggacccagacggaaccatggaagccccagcgcagcttctcttcctcctgctactctggcctccagataccatggagaagtagtgatgacgcagtcctccacgccctacccgtgtcctgtactccgtccgaaggggaacncgccctaccctctccgtgccgaggcccagtcacgtactagtacgcagctaacttacgccgtcggtacaacgaccaaaaccgtcgaccgtacgtacctacccgacggtccctacctacgacgttaggtacgtcggtaccgtccgtacccgaccggaccgggtaccctacggtacggttacctaccccgacgtaccgtacggttaccgaggtcggtacgtagggtcgggtacgtacgggactacggtacgttcgtacggtaccacctactcgtacgtacgaccgtacgcccgtaggtccgtagttacgtaacggtaacgttacgttttacgtttaactttacttacgttacgtacgtacgtacgttacgttaacggtaccgtaacgttccgtacgtaccttaacgttaccgttacggttacggacccgggttaacggtaccgggttaggttacggtaacgtaaccggttaaccgaaacggtttcggtacggttacggtaccgtaccgtaccgttaaccgtcgttaccgttaccg

SEQ ID NO: 270104 - DNA, 792 bp, Homo sapiens
  misc_feature: GYAE6OF02IVIFT.39.50.E06.1.454.CMB.1.raw
  modified_base (70)..(70): a, c, t, g, unknown or other
  misc_feature (70)..(70): n is a, c, g, or t
  modified_base (228)..(228): a, c, t, g, unknown or other
  misc_feature (228)..(228): n is a, c, g, or t
  modified_base (293)..(293): a, c, t, g, unknown or other
  misc_feature (293)..(293): n is a, c, g, or t
  modified_base (578)..(578): a, c, t, g, unknown or other
  misc_feature (578)..(578): n is a, c, g, or t
  modified_base (783)..(783): a, c, t, g, unknown or other
  misc_feature (783)..(783): n is a, c, g, or t
tcagtcgcactagtcacgaccggtgctcgatttagatctactgacaacacacaagggggaggaactgctnagttaggacccagacgggaaccatggaagccccagcgcagcttctcttcctctgctactctaggcctccaagactaccactagggaataaggtagtgagtgacgtcagtctccacggccctacccgtgttctgtcgtcctaccggaaagggggaaacnccggtacccacccgttccttccgtggaccgaacggggtccaacggtcaagtacgttaacgtacgnacgaaccttaacgttacggaccgttaggtaaccaacgaacccgtaaaaaccgtcggaaccctacttaaccccgtacccgtaggtacccttacccgtacttaacgttacggttaacggttccgggtacgtacccggtaccccgaaccgggtaccggggtacccttacgggttaccgtaccctacccgtacggaccccggtttaggtaccggtaggtaccgggtcgtaacggggttcggggtacgtacggggactacggtacgttacgtacgtccttaccgaccgtntaccgagtaccgaccgtccgtcggaaccgttagtacgtaggttaacgttttacgtttcgtttaaccttttaggtttaccgtacggttacagtacgttaactaggtacttaccgtcgtaccgtacttccttaggttacgtccggacgtagggtcgtaggtacgacgtaatacgggaacgtacggtgtaccgcgtacgtaccgtacnccgttagtc

SEQ ID NO: 270105 - DNA, 532 bp, Homo sapiens
  misc_feature: GYAE6OF01AI4CS.51.27.C05.1.454.CMB.1.raw
  modified_base (305)..(305): a, c, t, g, unknown or other
  misc_feature (305)..(305): n is a, c, g, or t
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttggtggttataattatgtctcctggtaccaacaccacccaggccaaagcccccaaactcatgatttangatgtcagtgatcggccctcgaggggtttcgaatcgcttctctggctcaagtccggcaacacggcctccctgacccatctctgggctccgaggccgaggacgaggctgatttatactgcacctcatatacaagcaagcaacaattgggtgttcggacggaggaccaagctgaccgtcgtacggtcacggcccaaggctcgccccctcggtcacctcgtcgtcccccg

SEQ ID NO: 270106 - DNA, 531 bp, Homo sapiens
  misc_feature: GYAE6OF01ELB2C.51.27.C05.1.454.CMB.1.raw
  modified_base (445)..(445): a, c, t, g, unknown or other
  misc_feature (445)..(445): n is a, c, g, or t
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccaccaggcaaacgcccccaaactcatgatttatgatgtcagtgatccggccctcgagggtttcaatcgcttctctggctccaagtccgcaacacggcctcctgaccatctctgggctccgaggccgaggacgaggctagtattattactgaccacctcatatacaagcagacaanagttgggtgttcggcggacggacaagctagaccgtcgtacgtcacgcccgaagcctcgccccctggtaccactcgtccgttccccg

SEQ ID NO: 270107 - DNA, 519 bp, Homo sapiens
  misc_feature: GYAE6OF01ERA0Z.51.27.C05.1.454.CMB.1.raw
  modified_base (427)..(427): a, c, t, g, unknown or other
  misc_feature (427)..(427): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccaccaggcaaagcccccaaatcatgatttatgatgtcagtgatcggcctcgaggggtttcaatcgcttctctggctccaagtccggcaacacggcctccctgaccatctcgtgggctccgaggccgaggacgaggctagtattattactgcacctnatatacaagcagacaacagttggtgttcggacggaggaccagctgacctcgtagtcagcccaaggctcgcccctggcacctcgtcgttcccc

SEQ ID NO: 270108 - DNA, 539 bp, Homo sapiens
  misc_feature: GYAE6OF01ADK7T.51.27.C05.1.454.CMB.1.raw
  modified_base (365)..(365): a, c, t, g, unknown or other
  misc_feature (365)..(365): n is a, c, g, or t
  modified_base (429)..(429): a, c, t, g, unknown or other
  misc_feature (429)..(429): n is a, c, g, or t
tcagcgatcgtatacacgaccggtgctcgatttagacgcgatcgaaggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaacgcccccaaactcatgattttatgatgtcagtgatcggccctcgaggggtttcaatcgcttctctggctccaagtccggcaacncggcctccctgaccatctcgtgggcctccgaggccgaggacgaggctgatttatactgcacctnatatacaagcagacaactagttgggtgttcggacggaggaccaagctcgaccgtcgtaggccagcccgaaggcctccgcccccgtggtacccacttccgtcgttaccccc

SEQ ID NO: 270109 - DNA, 544 bp, Homo sapiens
  misc_feature: GYAE6OF01D00OP.51.27.C05.1.454.CMB.1.raw
  modified_base (228)..(228): a, c, t, g, unknown or other
  misc_feature (228)..(228): n is a, c, g, or t
  modified_base (368)..(368): a, c, t, g, unknown or other
  misc_feature (368)..(368): n is a, c, g, or t
  modified_base (438)..(438): a, c, t, g, unknown or other
  misc_feature (438)..(438): n is a, c, g, or t
  modified_base (534)..(534): a, c, t, g, unknown or other
  misc_feature (534)..(534): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaaccngcagtgacgttggtgttataattatgtctcctggtaccaacaccaccaggacaaacgcccccaaatcatgatttatgatgtcagtgatcggccctcgtaggggtttacatcgcttctctggctccgaagtccggacaacncggcctccctgaccatctcgtcgggcctccgacggccgaagggacgaggctagattattactgctacctnatacacaagcagacaagtagttgggtacgtcgggcggaaggaccaggcctacgtacccgtcgtaggcgacgcccgaagccgtccgccccgtgtccncgtcgtcccg

SEQ ID NO: 270110 - DNA, 669 bp, Homo sapiens
  misc_feature: GYAE6OF01B8HMS.51.27.C05.1.454.CMB.1.raw
  modified_base (227)..(227): a, c, t, g, unknown or other
  misc_feature (227)..(227): n is a, c, g, or t
  modified_base (441)..(441): a, c, t, g, unknown or other
  misc_feature (441)..(441): n is a, c, g, or t
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccngcagtgtacgttggtagttaatattatgtctcgtgtaccaacaccaccaggacaaacgacccccaaatcatgtatttatgatgtacagtgacgtccggtccctaggtacggggtttacaagttccgtcttctcgtcggctaccgaaggtccgacaaccgaccggtccctccgtacgacctatccgtcgtacgggcctccgacggccgaggacgnggtctagtattactactcgacctacctacaagtactaacgaacgcaacgtaacctaaacgttaagtttcggggtacggttaccggggaacgggtaacggaaccctaaggtccgttaccggtaacccggttaccgtacgggttacccgaaccggtaccccggaaacgggttccctacccggtacccccgttcgggtaccctacccttcccggttcccgttacccccccg

SEQ ID NO: 270111 - DNA, 778 bp, Homo sapiens
  misc_feature: GYAE6OF01ED5LI.51.27.C05.1.454.CMB.1.raw
  modified_base (198)..(198): a, c, t, g, unknown or other
  misc_feature (198)..(198): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatcctcctgcactggaaccagcagtgacgttggtggttataattatgtctcctggtaccaacacccacccaggacaaacgacccccaaactccatacgattttagtgaatgtcagtgagtccggcccgtgtaggggtttacgaatcgtcttctctcggctaccgaagtcccggacaaccgaccggtccctcccgtacgaccctactccgttaccgtcgggtaccttaccgacgggacccggtacgggaaccgggtacgggtaccgttaggtaacggttttaactttacgttaccggtaccctaaccgttacgtaactttaacggttaaaccaaacggtaccaacggaaccttaaaacgttaacgggttttaacgggggttcgggtttacccggggggaaccgggaaccgggggtaacccgtaaaccggtccgttaccgggtaaccccggtttacccggttaaccgggttacgaaacccgggtaccccgaaacggggtccccttaccccgggtaccccccggttaccgggttacccctaccttaccccggttcccggtttaccccccccgg

SEQ ID NO: 270112 - DNA, 556 bp, Homo sapiens
  misc_feature: GYAE6OF01AIYE4.51.27.C05.1.454.CMB.1.raw
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (422)..(422): a, c, t, g, unknown or other
  misc_feature (422)..(422): n is a, c, g, or t
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaacgcccccaaactcatgatttangatgtcagtgatcggccctgaggggtttcatcgcttcnctgctcaagtccgcacncggcctcctgacctatctcgtgggctccgaggccgaggacgaggctgattatactgctacctnatatacaagcagacaacgtagttgggtacgttcggcgggaggaccagctacggacccgtccgtacggtaccacggccccgaaggtccctaccggccccccgttcggtacctaccttccgttccgttaccccccg

SEQ ID NO: 270113 - DNA, 472 bp, Homo sapiens
  misc_feature: GYAE6OF01CB7MQ.51.27.C05.1.454.CMB.1.raw
  modified_base (260)..(260): a, c, t, g, unknown or other
  misc_feature (260)..(260): n is a, c, g, or t
  modified_base (383)..(383): a, c, t, g, unknown or other
  misc_feature (383)..(383): n is a, c, g, or t
  modified_base (405)..(405): a, c, t, g, unknown or other
  misc_feature (405)..(405): n is a, c, g, or t
  modified_base (439)..(439): a, c, t, g, unknown or other
  misc_feature (439)..(439): n is a, c, g, or t
  modified_base (445)..(472): a, c, t, g, unknown or other
  misc_feature (445)..(472): n is a, c, g, or t
tcagcgatcgtatacacgaccggtgctcgatttagacgcgatcgaagggtttgggggctttgcctgggtggttataattatgtctcctggtaccaacaccacccaggcaaagcccccaaactcatgatttatgatgtcagtgatcggccctcgagggggtttcaatcgcttctctggctccaagtcccggcaacacggccctccctgaccatctcgtgggcctccgaggccgaggacgaggctgattatacgtgcacctnatagacaagcagacaacagttgggtgttcggcgggaacgggaccaagctacggaccgtaccaagggtccacgacccaaggcctcgacccccgttggccactccgtcgttcccccgcccttccnccgttcgacgtcaaccgttcgnggacgccgggctagggacctaaagggcccgtaanagagcnnnnnnnnnnnnnnnnnnnnnnnnnnnn

SEQ ID NO: 270114 - DNA, 620 bp, Homo sapiens
  misc_feature: GYAE6OF01DC0AI.51.27.C05.1.454.CMB.1.raw
  modified_base (252)..(252): a, c, t, g, unknown or other
  misc_feature (252)..(252): n is a, c, g, or t
  modified_base (304)..(304): a, c, t, g, unknown or other
  misc_feature (304)..(304): n is a, c, g, or t
  modified_base (466)..(466): a, c, t, g, unknown or other
  misc_feature (466)..(466): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctcctggtaccaacaccaccaggacaaacgccccaaatcatgtatttangatgtcagtgatccggcctgtagggtttcatcgtcttctctacggctaccgaacggtcccgacaaccgtaccgggcccttcccgtagaccctagttccgtcgtcgggccctacgacgggaccgaacggacgaggtctagtaatttagtactgacctacctanaatactaacgaagtcaagtccaaacgttaagttcgggtacgttcgggacggtaacggaacctaggtccgtacggacccggttaccgtaggtaccacggaacccgtaacgggtccctcccgtacccccgttcggtaccctcgtccgttacccccg

SEQ ID NO: 270115 - DNA, 680 bp, Homo sapiens
  misc_feature: GYAE6OF01CC6AS.51.27.C05.1.454.CMB.1.raw
  modified_base (304)..(304): a, c, t, g, unknown or other
  misc_feature (304)..(304): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatcctcctgccactggaaccagcagtgacgttggtgttatattatgtctctgtaccaacaccaccaggacaaacgaccccaactcatgtatttangtatgtcagtgacgtccggcccttacggtaggggttttacgaagttccgtctttccgtcgtcggtcctaccgtaacggtcccggaacaaccgacccggtccctacccgtacgaccctactccgttcgtcgggccctaccggacggccggacggacggacggtcgtagtaagtttaacttacgtcgacctaacctactaactaactaacaacgacaacgaactaacgtaggttcgggtaggttacgggacgggtaacggaccgaaggtaccgtaccggtaacccgtccggtacggtacgaccggtaccccgaacgggtccccgtaccggtcccccccgttcggtaccttcccttcccggttcccgttacccccccgg

SEQ ID NO: 270116 - DNA, 597 bp, Homo sapiens
  misc_feature: GYAE6OF01CDLWE.51.27.C05.1.454.CMB.1.raw
  modified_base (295)..(295): a, c, t, g, unknown or other
  misc_feature (295)..(295): n is a, c, g, or t
  modified_base (576)..(576): a, c, t, g, unknown or other
  misc_feature (576)..(576): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttatattatgtctctggtaccaacaccacccaggcaacgcccccaaatcatnatttatgatgtcagtgatccggccctgaggggtttcaattccgctttctcgtgtcctacgaacggtcccggacaaccgcggtccctcccgtagaccctatcctcgtcgggcctccgacggaccggaggaccggaggtcctagtatttacgttactgacctaacgtctaatactacaacgcacacaacgtaagttgggtacgttcgggaccggaggaccaaggcctacggacccgtccgaggtaccacggcccgacggtcctccgtcccccgtagttacccncgttcccgtccggttcccccg

SEQ ID NO: 270117 - DNA, 605 bp, Homo sapiens
  misc_feature: GYAE6OF01EAE0Q.51.27.C05.1.454.CMB.1.raw
  modified_base (371)..(371): a, c, t, g, unknown or other
  misc_feature (371)..(371): n is a, c, g, or t
  modified_base (392)..(392): a, c, t, g, unknown or other
  misc_feature (392)..(392): n is a, c, g, or t
tcagcgatcgtatacacgaccggtgctcgatttagacgcgatcgaagggtttgggggggggtctcaggaggcagcgctctcgggacgtctccaccatggcctgggctctgctattcctccaccctcctcactcagggcacagggtcctgggcccagtctgccctgactcagcctgcctccgtgtctgggtctcctggacagtcgatcaccatctcctgcactggaaccagcagtgacgttggtggttataatatgtctctggtaccaacaccacccaggacaaacgcccccaaactcatgtatttatgatgtcagtgatccggccctcgtaggggtttcaatcgtcttctcgtggctccaagtccgcaacncggccctcctgaccatctcgngggcctccgacgggccgagggacgaggctagtactttatactcgcctaccgtctaactatacaagcgaacgacaacgtaaggtttgggtacggttacgggcgggaagggacccaagtccgtacgggaacccgttccgtacgggtacaccggaccccgaacggccgtaccccgtcccccggtacggtacctaccctcgttcccggtccccccgg

SEQ ID NO: 270118 - DNA, 564 bp, Homo sapiens
  misc_feature: GYAE6OF01CG52E.51.27.C05.1.454.CMB.1.raw
  modified_base (333)..(333): a, c, t, g, unknown or other
  misc_feature (333)..(333): n is a, c, g, or t
  modified_base (446)..(446): a, c, t, g, unknown or other
  misc_feature (446)..(446): n is a, c, g, or t
  modified_base (467)..(467): a, c, t, g, unknown or other
  misc_feature (467)..(467): n is a, c, g, or t
  modified_base (549)..(549): a, c, t, g, unknown or other
  misc_feature (549)..(549): n is a, c, g, or t
tcagcgatcgtatacacgaccggtgctcgatttagacgcgatcgaaggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttatattatgtctctggtaccaacaccaccaggcaaacgcccccaaatcatgtatttatgatgtcagtgatcggtcctcgtaggggttttnaagtcgctttctcgtcggctaccgaacgtccggactaaaccgccggtccctccctgacctatccgtcgtcgggcctccgacgggccgaaggacgaggtctagtattacttacngccacctcataacacaagcanacaacgtagttgggtacgttcggacggtacggacagtcgtcgaccgtcgtacggtcacgcccgagcctccgtcccgtcgccncttccgtcgttcccc

SEQ ID NO: 270119 - DNA, 598 bp, Homo sapiens
  misc_feature: GYAE6OF01BGQ8V.51.27.C05.1.454.CMB.1.raw
tcagcgatcgtatacacgaccggtgctcgatttagacgcgatcgaaggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccaccaggcaaacgcccccaaactcatgtatttatgatgtcagtgatcggcctgtacgggtttcgaatcgcttctctcggctccgaacgtccgacaaccgaccggccctccctgaccctatcctcgtcgggcctcgacggccgaggacgaggctgtattagttactcgcctacctcatataacgaagcagacaacgtagtttggggtacgttcgggacgggacgggtaaccgagtccgtcggacccgttaccgtacggtacgacggccccgaaggtcccgtacccggtccccccgttggtaccctccgttccgtccggtttaccccccc

SEQ ID NO: 270120 - DNA, 634 bp, Homo sapiens
  misc_feature: GYAE6OF01DLZ4D.51.27.C05.1.454.CMB.1.raw
  modified_base (249)..(249): a, c, t, g, unknown or other
  misc_feature (249)..(249): n is a, c, g, or t
  modified_base (297)..(298): a, c, t, g, unknown or other
  misc_feature (297)..(298): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtgttatattntgtctctgtaccaacaccaccagcaaacgccccaaatcatgtatttannatgtcagtgactcggccctcgtaagggttcaatccgcttctcgtcggctccaacggtccgacaaccgccggtccctcccgtgacctatcctcgtcgggtccctcgacgggccgagggacgaggctagtatttactactcgaccacctataatacaacgaacgtcaacgtacaaacgttaaggtttcggggtacggtttccgggaacggggtaacggaaccgaaacggtccgttacggacccccggttcgttaaacggccgacggaccccggaacggtccccgtacccggtccccccgttacggtaccctaccggttcccgttcccggttccccccg

SEQ ID NO: 270121 - DNA, 697 bp, Homo sapiens
  misc_feature: GYAE6OF01BSMTO.51.27.C05.1.454.CMB.1.raw
  modified_base (270)..(270): a, c, t, g, unknown or other
  misc_feature (270)..(270): n is a, c, g, or t
  modified_base (333)..(333): a, c, t, g, unknown or other
  misc_feature (333)..(333): n is a, c, g, or t
tcagcgatcgtatacacgaccggtgctcgatttagacgcgatcgaaggtttggggggggtctcaggaggcagcgctctcgggacgtctccaccatggcctgggctctgctattcctcaccctcctcactcgagggcacgacgggtcctcgggcccagtctcgccctgacctcacgcctcgccctccgtgtcgtcgggtctccgtggacagtcgatcacctatcctcctgcctacgtaggaaccagcagtgacgttggtagtaattaattntcgtcttcacggtaccaaccaccaccgaggacaaaccgaccccaaactcagtacgtaatttanagtatgtactagtcgaactccggtaccctcggtacggggtttacgaacgtccgtcttccgtcgttcggtcctaccgaccgtaccgaccgtaaccgtccggtcccctccctacgactacctcgttcggtcgggtcctccggacggacccgggtaacggacggtacggtccttaggtaactttaacgtacgtacggtacctaccttaactataacgtaacgaaccgacaacgtaaccaaacgttaagggttcgggtacgggttcggaacggggtacggacgaaggtccgaccgtaccgtccgtaggtccacggacccggacggtccctacccggtcccgtcgtaccaccgttccgtccgtcccccg

SEQ ID NO: 270122 - DNA, 629 bp, Homo sapiens
  misc_feature: GYAE6OF01AQXEG.51.27.C05.1.454.CMB.1.raw
  modified_base (300)..(300): a, c, t, g, unknown or other
  misc_feature (300)..(300): n is a, c, g, or t
  modified_base (377)..(377): a, c, t, g, unknown or other
  misc_feature (377)..(377): n is a, c, g, or t
  modified_base (430)..(430): a, c, t, g, unknown or other
  misc_feature (430)..(430): n is a, c, g, or t
tcagcgatcgtatacacgaccggtgctcgatttagacgcgatcgaaggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctcctgtaccaacaccaccaggcaaacgcccccaaactcatgatttangatgtacagtagctccggcctcgtacggggtttcaagttcgcttctcgtgctaccgagtccgacacgacgccctccncgaccatcgtcgtcggcctccgaggaccgaggacgaggtctagtattattacncgtccctaaccgttcctaactaacgacgacgaacgactaaacgtaggttcgggtcggttaccgggacgggtacggaaccgaaggtccgtacgtacccggttcgtaacggtccgacggacccgaaccgggtcccttcccggtaccccccgttacgggttaccctacccgtttcccgttcccgttccccccgttacccccg

SEQ ID NO: 270123 - DNA, 719 bp, Homo sapiens
  misc_feature: GYAE6OF01C613L.51.27.C05.1.454.CMB.1.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (247)..(247): a, c, t, g, unknown or other
  misc_feature (247)..(247): n is a, c, g, or t
tcagcgatcgtatacacgaccggtgctcgatttagacgcgatcgaaggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntctccngcactgaaccagcagtgacgttggtgtatattngtctctgtaccaacaccaccagacaaacgccccaaatcatagtatttatgtatgtcaggtgacgtccggtacccgttcggtaaggggtttaccaagttccgtcttcgttcgtcggtacctaccgtaacggtcccgaacctaaaccgcccggtcccctaccctcgaacccctattcccgttcgtcgggtacctacccgacgggtaccggaggaacggacggtacgttagtaactttacgttacctagtaccctaaccgtactaacttaacgaaccgaagacctaaacgtaactaaacggttaaggtttcggggtacggttacggggaccgggtaacgggtaccctaacgggtccgtaccgtaacccggtaccggttaaccgggaccgtacccggtaacccgaacgggttccctaccccggggtccccccgtttacggtaccttaccccgttcccgttaccccggttacccccc

SEQ ID NO: 270124 - DNA, 557 bp, Homo sapiens
  misc_feature: GYAE6OF01AKPZL.51.27.C05.1.454.CMB.1.raw
  modified_base (250)..(250): a, c, t, g, unknown or other
  misc_feature (250)..(250): n is a, c, g, or t
tcagcgatcgtatacacgaccggtgctcgatttagacgcgatcgaaggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtggttataattntgtctcctggtaccaacaccacccaggacaaacgcccccaaactcatgattttatgatgtcagtgatccggccctcgaggggtttcgaatcgcttctctcggctccaacgtccgacaacgacggccctcccgtgaccctatcctcgtcgggtcctccgacggccggacggacgaggctagtatttactacgtcgaccactcatatacatcacgacaacgtagttggtggttcggacggacggacgaagctcgacgtccgtacggtcacgcccgacgctccgtcccctgtactctcgtccgttccccg

SEQ ID NO: 270125 - DNA, 691 bp, Homo sapiens
  misc_feature: GYAE6OF01A5KAJ.51.27.C05.1.454.CMB.1.raw
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
tcagcgatcgtatacacgaccggtgctcgatttagacgcgatcgaagggtttggggtgggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcacctatctcctgcactggaaccngcagtnacgttggtagttanagttatgtctctggtaccacaccaccagacaaacgccccaaatcatcgtatttagtcgatgtacagtgactccggcctacggtacggggtttacaagtccgtcttcgtcgtacgggtcctaccgtaacggtcccggactaacccgaccggtcccttcccgtacgaacctcgttccgtacgtcgggtccttacccgagggtaccccggaggacggtacgggtcttaggtaatttacgtacgttacggaccctacgtactaataccgtaacgaagaccgaacggtaacctaaacgttacggtttaggggtacgttacgggggaccgggaaccggtaccgtaaagtcccgtacgggtacccgtttaccggaacggtacccgtaccggacccgtaacggtccctaccccggtaccccctaggtacccttaccgtccgtttaaccccgg

SEQ ID NO: 270126 - DNA, 637 bp, Homo sapiens
  misc_feature: GYAE6OF01DDWFN.51.27.C05.1.454.CMB.1.raw
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (296)..(296): a, c, t, g, unknown or other
  misc_feature (296)..(296): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccngcagtgacgttggagttatatntgtctctggtaccaacaccaccagacaaacgccccaatcatgattangatgtacagtgacgtcgacctgtaggttacgaagtcgtcttctcgtcggctacgacgtccgacaaccgaccggtccctccacgaccctatccgtcggcggtcctaccgacgggtaccggagggacgtcggtatacgttaattacttacgtcgtacccaaccgttctaaactaactaaaccgagaaccaacgaacctaaacgttaggttcgggttacgttacggggaacggtacgggtaaaccacgtcggtaccgacccggtttacgtaaggtaccgaccggtacccggaacgtccgtcccccgtaccccgttaggtccctaccggttcccgttacccccgg

SEQ ID NO: 270127 - DNA, 719 bp, Homo sapiens
  misc_feature: GYAE6OF01CF5XH.51.27.C05.1.454.CMB.1.raw
  modified_base (318)..(318): a, c, t, g, unknown or other
  misc_feature (318)..(318): n is a, c, g, or t
tcagcgatcgtatacacgaccggtgctcgatttagacgcgatcgaaggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccagcagtgtacgttggtagttaataattatgtctccgtaggtaccaacaccaccgacggaccaaaccgaccccctaaactcagtgtaatttanagtatgtacaggtcgtacgtccggacccgttacgggtacggggtttacaacgttccgtctttccgtcgtcggtcctaccggaacggtcccggaacctaaccgacccggtacccttaccccgtacgtaaccctacgttcccgtaccgtccggggtacctacccgggacgggacccgggtaacgggaccggtacggtacgttacggttaactttaacgttacctacggaccctaaccgttactaactaactaacgaacgacgaacgaacgtaacgttagggtttcgggtacggttacgggacgggaacgggaccaacgtccgtacgtacccgtagtaccggacaccggaccgacggtccctacccgtcccgtacgtacctaccgttcccgtcccgttcccccg

SEQ ID NO: 270128 - DNA, 591 bp, Homo sapiens
  misc_feature: GYAE6OF01CZ4KI.51.27.C05.1.454.CMB.1.raw
  modified_base (252)..(252): a, c, t, g, unknown or other
  misc_feature (252)..(252): n is a, c, g, or t
  modified_base (302)..(302): a, c, t, g, unknown or other
  misc_feature (302)..(302): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgccactggaaccagcagtgacgttggtgttatattntgtctcctgtaccaacaccaccagcaacgacccccaaactcatgatttangatgtcagtgatcgcctcgtagggttcgatcgtcttctcgtgctaccgagtccgacacgcgcctccctgacctactctcgtcggcctcgacggccgagacgacggtctagtattacgtacgtcgcctaccgtctaataactacgaagcaacgactaaacgtaagttgggtcgttacgggacggtacgggaaccaggtaccgtacggaccgtaccgtacggtaccaacggcccgaaacggccgtccggtccccccgtacgggtcctacgtcccgttccggttaccccccg

SEQ ID NO: 270129 - DNA, 560 bp, Homo sapiens
  misc_feature: GYAE6OF01DP7VS.51.27.C05.1.454.CMB.1.raw
  modified_base (198)..(198): a, c, t, g, unknown or other
  misc_feature (198)..(198): n is a, c, g, or t
  modified_base (252)..(252): a, c, t, g, unknown or other
  misc_feature (252)..(252): n is a, c, g, or t
  modified_base (313)..(313): a, c, t, g, unknown or other
  misc_feature (313)..(313): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacngtcgatcaccatctcctgcactggaaccagcagtgacgttggtgttataattangtctcctggtaccaacaccacccaggcaaacgcccccaaatcatgatttatgatgtcagtnatcggccctcgagggtttcaatcgcttcnctgctccagtccgcacncgcctccnaccatctcgtgggctccgaggccgaggacgaggctagtattacttactcgaccacctcatactacaagcagacaagtaagtttgggtcggtcggacgggagggaccaagtccgtacggtacccgtcgtacggtcaccggcccgaacggccgtacccgtcccccgttacggtcctacctccgttccgtaccccc

SEQ ID NO: 270130 - DNA, 742 bp, Homo sapiens
  misc_feature: GYAE6OF01AC83X.51.27.C05.1.454.CMB.1.raw
  modified_base (251)..(251): a, c, t, g, unknown or other
  misc_feature (251)..(251): n is a, c, g, or t
tcagcgatcgtatacacgaccggtgctcgatttagacgcgatcgaaggtttgggggggtctcaggaggcagcgctctcgggacgtctccaccatggcctgggctctgctatttcctcaccctcctcactcagggcacagggtcctgggcccagtctgccctgactcagcctgcctccgtgtctgggtctcctggacagtcatcaccatcctctgacacgtcggaaccagcagtgacgttggtgttatattntgtctctgtaaccacaccaccgagacaaacgccccaatcatagatttatgatgcagtcacgtccggcccttagtacgggtttacaacgttccgtctttccgtcgttacggccttaccgaacgtcccgacaaccgtaccggtccctcccgtacgaaccctcgttccgttaccggtcgggtccctccggacgggtcccgggaaggaccgggtaggtacgttaggttaattttaccgtttaacgtcgtaccctaacccgttactaaagttaactaacgtaaccgacgtaaccgtaacgtaaaccgttaacgggttttacggggtaccgggtttacgggaaccgggggaacggtaacccgaaacggtccgttaacccgggtaacccgttccggtaacgggtacccgaaccggtaccccgggtaacggttccccgttccccggtacccccccgttaggttacccccaccgtttcccgttccccggtttaacccccc

SEQ ID NO: 270131 - DNA, 704 bp, Homo sapiens
  misc_feature: GYAE6OF01AOQTI.51.27.C05.1.454.CMB.1.raw
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacaggggtcctgggcctagtctgccctgactcagcctgcctccgtgtctgggtctcctggacagtcatcaccatctcctgcactggaaccngcagtgacgttggtgttaataattatgtctctggtaccaacaccaccaggaccaaacgcccccaaatcatgatttaangatgtcagtgactccggcctcgtaggggtttcaatcgtcttctcgtcggcttaccaacggttccgacctaaccgaccggtcccctacccgtacgaaccctacttcccgttacggtacgggtccttacccggaacgggacccgggtaacggggaaccgagggtaccgttaagtaacttttaacgttaccgtacggtccctaacccgtactaactaactaacgaacgtacaacgaaccgtaaacgttaagggtttcgggttagggtttccgggaacgggaccgggtaacctaacggccgtaccggtaacccgtacccggtacggtcccgaacggccccgtaaaggccctacccggtcccccgttcggtaaccctacccgttccggttacccgttccccccg

SEQ ID NO: 270132 - DNA, 671 bp, Homo sapiens
  misc_feature: GYAE6OF01CTHTI.51.27.C05.1.454.CMB.1.raw
  modified_base (489)..(489): a, c, t, g, unknown or other
  misc_feature (489)..(489): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgtacgttggtaggttaatattatgtctcctaggtaccaacaccacccaggaccaaaccgacccccaaatcatagtaactttatgattgtacagtgactccggccctcggtacgggtttcaactcgtacttcctcgtcgtcctacgtacggtccggacaccgtaccgtccctaccctcgacctatccgtcgtcgggccctaccgacggccggtaggacgacggtctaagtactttaacttcgacgacctaccgtanattacactaacgactaacgacctaaggttaaggttcgggttcgttaccggggaggaccggtaaccacggacctcggtacccgttaccggtacggtacctaaccgggcccgaacgggtccccgtacccggtacccccccgtaggttaccctccccggttaccgttcccccgtttaccccccgg

SEQ ID NO: 270133 - DNA, 626 bp, Homo sapiens
  misc_feature: GYAE6OF01EBFMO.51.27.C05.1.454.CMB.1.raw
  modified_base (229)..(229): a, c, t, g, unknown or other
  misc_feature (229)..(229): n is a, c, g, or t
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccngcagtgacgttggtgttaataattatgtctctgtaccaacaccaccaggcaaacgcccccaaatcatgatttangatgtcagtnagtccggcctcgtagggtttcgaattcgcttctcgtggtcctccgtaacggtccgacaaccgaccggtccctccctagaccctatctcgtggacctccgacggaccgaggacggagtgtagtaatttacttacgtcgactacctactaactataacgaagacaacgtacaaagtaagtttcggggttacgtcgggaccgggaaggggaacctaagcgtacgaaccggttccgtaacgggtaccaccggaccccgaacggtcccgtaccggtccccccgtaggttacccctacgttcccgtccgttaccccccg

SEQ ID NO: 270134 - DNA, 707 bp, Homo sapiens
  misc_feature: GYAE6OF01BQGOJ.51.27.C05.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacgagggtcctgggcccagtctgcctgactcagcctgcctcgtgtctgggtctcctggacagtcatcaccntctctgcatcgaacngcagtgacgttgtgtaatattntgtctctgtaccaacaccaccagacaacgaccccaatcatgtattagtnatcgnagtnatcgcctggtacggttcatcgcttcngtcgcctacgtacgcgacaaccgtaccgcctaccgagtacctatcctcggtacggtctacggacggtaccggagggtaccgacgtcgtaacgttaactttacgtacgtaccgtacctaccgtactaacttacaaccgtaagtcgaaacgtaacgttaaacccgttaagggggtttccgggtttaaccgggtccgggaaacggggttaacggaaccccggtttaaacggtacccggtttaccggtaaccccgggttaccttaaaccggggtacccgtaccccggtaaacccggtaccggttaccccggacccccccgtttaccgggtaccccggtttaacctaccccggtttttccccgaccccgggttttacccccccg

SEQ ID NO: 270135 - DNA, 665 bp, Homo sapiens
  misc_feature: GYAE6OF01BYQC1.51.27.C05.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagcgatcgtatacacgaccggtgctcgatttagacgcgatcgaagggtttggggggggtctcgaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcaccatctcctgcactggaaccngcagtgacgtttggtgttataattntgtctccgtagtaccaacaccaccgaggaccaaacgcccccaaactcagtagtatttatgtactgtacgtagtagtcgtccgccgttacgtacggggtttacaacttcgtcttctcgtcgccgtaccgtacgtccggacaaccgtaccgtccctaccgtcgactactcgtcgtcggcctcgacggcgacggtacgacgtctagtaacttactacgtacgtacctacctactaactactacgaagtcaagaaccgtaacgtaggttacgggttacggtccgggtaacggacggaacctaaggtccgtaacggtacccggttccgtaacggttacccgaaccggacccgtacggtacccgtccccgggacccgtttcccggtacctaccgttcccggttcccgttccccccg

SEQ ID NO: 270136 - DNA, 684 bp, Homo sapiens
  misc_feature: GYAE6OF01CVEX5.51.27.C05.1.454.CMB.1.raw
  modified_base (156)..(156): a, c, t, g, unknown or other
  misc_feature (156)..(156): n is a, c, g, or t
  modified_base (228)..(228): a, c, t, g, unknown or other
  misc_feature (228)..(228): n is a, c, g, or t
tcagcgatcgtatacacgaccggtgctcgatttagacgcgatcgaagggtttgggggtggggtctcaggaggcagcgctctcgggacgtctccaccatggcctggctctgctattcctcaccctcctcactcaggcacagggtcctggcccagtcngcctgactcagcctgcctccgtgtctggtctcgtgacagtcgactcaccatcctccgtgcacgtaggaaccngacagtgtacgttggtaggttatattatacgtctacgtacggacctaacgaccctaccgaggaccaaaccgtacccccaatctagtagtatttagtacgtagtcgtacgtagtgacgtcccggtaccctaggtacggttacacgtcgtccttcgtcgtcgtaccgtaccgacgtaccgtacaaccgtcccggtccctaccgtacgtaccacgtccgtcggtccggtcctaccgacggaccggtacggaccggtgtccgtaagttacgtttactacgtcgacctacgttaactataacgaaccgtacgacgacgtaaccgtaacggtttacggttcggggttacggtacggggacggaaaccggtacgacggtcctaaccggtacccgtcggtacgtacgacccggtaccgtacggccctaccgttcccccgtagtaccttccgttaccttccccgg

SEQ ID NO: 270137 - DNA, 673 bp, Homo sapiens
  misc_feature: GYAE6OF01B5O5T.51.27.C05.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
tcagcgatcgtatacacgaccggtgctcgatttagacgcgatcgaaggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcgtggacngtcgatcaccatctctgcactggaaccngcagtgacgttggtagttatattatgtctcctgtaccaacaccaccgagacaaacgccccaaatcatgtatttagngatcgtcgagtgacgtccggtccctcggtagggtttcaagtccgtcttcgtcgtcgcctaccgaacgtccgacaaccgtaccggtccctcccgtacgacctacgttccgtcgtcgggcctaccgacgggtcgtacgggacggtaacggacggtctagtaactttactaccgtcgaccctacctactaagttactaacgaacgtccgaacgtacctaaacgttacggtttcggggttacgttacggggaccggtaacgggaccctaggtccgtaccggtaacccggttccgtacgggtaccaccgggtaccccgtaagggtcccgtacccggttacccccgtacgggtacccttacccgttcccgttaccccgg

SEQ ID NO: 270138 - DNA, 715 bp, Homo sapiens
  misc_feature: GYAE6OF01BBQ0V.51.27.C05.1.454.CMB.1.raw
tcagcgatcgtatacacgaccggtgctcgatttagacgcgatcgaaggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccaccaggccaaacgccccaaatcatgatttatgatgtcgagtgatccggtcctacgtaggggtttacaagtccgtcttctcgtcggtcctaccgtaacggtcccggaccgtaaccgcccggtaccccttcccctacggtaccccacgtttccgttaccggtccggggtccctacccggaccggggacccggaacgggaaccggtacgggtaccgttacggtaactttacgttaccgttacgacctacccgttactaactaacttaaccaacggtaccaacgaaccgtaaacgttaacggtttcggggttacgggtttacccggggacggggtacgggaacccgtaacggtaccgtaccggtacccggttacgtacggtacgaccggtacccgaacgggtcctacccggtcccccgtacggtacctccttccgttcccggttcccccg

SEQ ID NO: 270139 - DNA, 765 bp, Homo sapiens
  misc_feature: GYAE6OF01AZ11B.51.27.C05.1.454.CMB.1.raw
  modified_base (251)..(251): a, c, t, g, unknown or other
  misc_feature (251)..(251): n is a, c, g, or t
  modified_base (303)..(303): a, c, t, g, unknown or other
  misc_feature (303)..(303): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctctggtaccaacaccaccaggcaaacgcccccaaactcatgtatttancgtatcgtcgagtgactccggcctggtacggggtttcaagtccgtacttcgtcgtcggacctaccgaacggtcccggactaaccggtccggcccttcccgtaggaaccctagttccgtccggttacggggcccttaccggacgggcccggtaacgggaccggtacggtcttaggtaactttaacgttaccgtcgtaccctacccgttacgtaacttactaaaccgaagacctaacggtaacctaaacggtaacgggttttaccgggggttaggtttaacccggggacggggtaaccggaacccgtaaggtaccccggttaggacccccggtttaccgtacggggttacccaacccggttacccccggtaacggggtcccctttacccccggggtacccccccggtttacgggttacccccgttacccggtttccccggttttaccccggttcccccccccgg

SEQ ID NO: 270140 - DNA, 607 bp, Homo sapiens
  misc_feature: GYAE6OF01BASGJ.51.27.C05.1.454.CMB.1.raw
  modified_base (318)..(318): a, c, t, g, unknown or other
  misc_feature (318)..(318): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgactcaccatcctcctgcactggaaccagcaggtgacgtttggtaggttaataattatgtctccgtaggtaaccaacaccaccaggaccaaaacgcccccaaactcatagtatttangtatgtcagtgactccggccctagtacggggtttacaacttcgtctttctcgtcggtcctaccgaacgtccggacaaccgccggcccttccgactaccatccgtcgtcgggtcctaccgaggaccggaggacgacggtctagtattacttacgtgacctactacaattacacagcaacgtcaaacgtaggttggtacggtacggacggtacggacagtcgtacggacctccggtacgcgacggcccaaggtccctccgccccgttagccctacgtcgtcccggtccccg

SEQ ID NO: 270141 - DNA, 671 bp, Homo sapiens
  misc_feature: GYAE6OF01A2W5E.51.27.C05.1.454.CMB.1.raw
  modified_base (210)..(210): a, c, t, g, unknown or other
  misc_feature (210)..(210): n is a, c, g, or t
  modified_base (253)..(253): a, c, t, g, unknown or other
  misc_feature (253)..(253): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntctcctgcactggaaccagccagtgacgttggtgttataattntgtctcgtgtaccaacaccacccaggacaaacgcccccaaaactcattagatttatggactcggtcagtagacgtccgcccgtagagggtttcgaatccgactttctcgtcgacctacaacggtccgacaaccgtaccggccctccgtagaccctacttccgttccggtcggcctaccgggaaggccccgtaagggacccggaggttcctagtaacgttttactaccctacggtaccctaaccgtccttaagtacctaaccgtaacgccgtaacgaacctaaacgttaaggtttcgggtacggttaccggaggtaaacgggtacctaggtaccgccggtaaccgttccgtaaggtcgaaccggtcccgaagggtcctacccggcccccgttaaggtccttaacggtcccgttaccccg

SEQ ID NO: 270142 - DNA, 698 bp, Homo sapiens
  misc_feature: GYAE6OF01BIUCI.51.27.C05.1.454.CMB.1.raw
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcaccatcctctgacacgtaggaaccagcaggttcgacgttgggtagttaataattatgtcctctacgtaccaacaccaccacggacaaacgccccaaatcgatacgtattangtatgtanagtgactccggacccgtaggtacggggttacaacgtcgtctttacgtcgtgggccttaccgaacggttccggacctaacgaccggtccctcccgttagaccgtaactccgtccggtggtaccgtacccgacgggtaccggaacgggacgtacggacgttaagtaactttacgtacgtcgtaacctacctaactaataacgtaacaagaccgtaacgaaccgaagtaacggttgggtacgttacggggacggtaacggaaccgtaacggtccgtaaccgggtaccgtaccggtaaggaccgaaccggaccccgtaaacggtccgtccccgggtacccccttaggaccccttaccgggtctttaaccccccgg

SEQ ID NO: 270143 - DNA, 608 bp, Homo sapiens
  misc_feature: GYAE6OF01BSX91.51.27.C05.1.454.CMB.1.raw
  modified_base (225)..(225): a, c, t, g, unknown or other
  misc_feature (225)..(225): n is a, c, g, or t
  modified_base (296)..(296): a, c, t, g, unknown or other
  misc_feature (296)..(296): n is a, c, g, or t
  modified_base (362)..(362): a, c, t, g, unknown or other
  misc_feature (362)..(362): n is a, c, g, or t
  modified_base (428)..(428): a, c, t, g, unknown or other
  misc_feature (428)..(428): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactgaaccngcagtgacgttggtgttatattatgtctctgtaccacaccaccagacaaacgccccaaatcatgtatttangtagtgtcagtgagtccggcctggtagggttacaatcgtcttctcgtgctacgacgtccgacaacncgtcctccgtacacctactcctcgtacggcctaccgacgggccgaggacgagtctgtaattactcncgactactanaacttanaacagcaagacctaacgtagttgggtcgtcggacgggtaggacccgaagtcgtacggtacccttaccggtacggtaccaaccggtaccccgaacgggtcccgttcccccgggtaccccccgttacgggtaccctaaccgtttccccgttcccgttcccccccg

SEQ ID NO: 270144 - DNA, 801 bp, Homo sapiens
  misc_feature: GYAE6OF01DCHXR.51.27.C05.1.454.CMB.1.raw
  modified_base (185)..(185): a, c, t, g, unknown or other
  misc_feature (185)..(185): n is a, c, g, or t
  modified_base (246)..(246): a, c, t, g, unknown or other
  misc_feature (246)..(246): n is a, c, g, or t
  modified_base (781)..(781): a, c, t, g, unknown or other
  misc_feature (781)..(781): n is a, c, g, or t
  modified_base (787)..(787): a, c, t, g, unknown or other
  misc_feature (787)..(787): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacgagggtcctgggcccagtctcgccctgactcagcctgccttcggtntcgtgggtctccgtggacctgtcgatccgaccattccgtcctgaccaccgtacggaaaccngtcgaggttcggtacggttttgggtaggtttaacttaagttagtgtccctttaccggtacggttaaaccccaaaccctaacccccgtaccccaaggggaaccctaaaaaccccggtaccccccctaaaacgtttcaaagttcggtttaaacttttagtacggtaattccggtacgtaggtaccggtaagttcccccgggtacccgtgggtttaacggggttaccgaacgtttccggttctttaccgttccgtacgggccccttaaccggtaacgggtaccccggaccgaaacccgtccccggttaaccccgttcccgtacggtaccctacggtttcccgtcggtaccgggtccctaaccgggaccgggtaccggaagggtccgacggtctacgttattaaccgttccgtactaccgtcctagtaactacgaactacggacagaacccctaagtgttacggggtcttacgggacggaaccggtacacgtccgtacggaccgttcgagtacgtccggaaccagcccgtccgttaccncgttcncccgttctccccgg

SEQ ID NO: 270145 - DNA, 782 bp, Homo sapiens
  misc_feature: GYAE6OF01EHPV3.51.27.C05.1.454.CMB.1.raw
tcagcgatcgtatacacgaccggtgctcgatttagacgcgatcgaaggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtcgtacgttggtaggttattaattatctctctacgtaccaccaccaccgacgacaaccgacccaacacactagttatttagtagtatgtacgtagtcgtacgtaccggtccctacggttacgggttacggctaactttccggcgtttccggtaccttaccgggtaaccggttccccggaaaacgttaaccccgggtcccgtaaacccctacccggggtacctaacccccttacggtaccccgtacgttaccggtctaccgggaccggttcccgaaggggtaccccggagggtaacccgtaagggtaccttagtaaccttacgtacctacgtctaacccttaacactaactaccgaaagtacctaaacgtacgttacgggtaaagtttacggggtacggttaaccggggaccgggaacgggtacccgtaacgggaaccgttaccgtaaccgggttcccgtaacgggtacccggaacggtccccgtaaccgggttcccccttaccgggttacccccttaccggttccccgttaaccccgttccccgtttaccccg

SEQ ID NO: 270146 - DNA, 904 bp, Homo sapiens
  misc_feature: GYAE6OF01ENTWT.51.27.C05.1.454.CMB.1.raw
  modified_base (198)..(198): a, c, t, g, unknown or other
  misc_feature (198)..(198): n is a, c, g, or t
  modified_base (255)..(255): a, c, t, g, unknown or other
  misc_feature (255)..(255): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacgagggtcctgggcccagtctgccctgactcagcctgcctcgtgtctggtctccgtggacngtcgatcaccatctcctgcacgtcggaaccagcagtgtacgttggtgttaataattntcgtcttccgtaggtaccaacctaccacccaggaccaaacgacccccaaactcattacgtacttttagtacgtattcgtacgtagtacggtacgtccggtacccgttacggttaacgggggttttaccgtaaacgttccggttcctttccgtttaccggtcggtacccgttaacccggtaaaccggttacccggggaacctaaacccggtaacccgggtccccttaacccccggtacgtaaccccgtaacgtttcccgttaccggttaccggggtacccgttaccccgggtaaccggggaacccgggtaacggggtaacccggtaacgggtaccgttaacgttaattttaaccgtttaaccgtacgtaaccccgtacccgttaacctaattaaaccgtaacggtaaaccgacggtaacgaaacccgttaaacggttacgggttttacgggggtaccgggtttaaccggggaccggggtaaaccgggtaacccggtaacgggtaaccgttacccgggtaaccccggttacgggttaaaccgggttacccgaaacccggtaccccgggtaaaccggtcccggttacccccggtaccccccgttacggttaccctaccccgttttacccggttccccgtttaccccccccgg

SEQ ID NO: 270147 - DNA, 760 bp, Homo sapiens
  misc_feature: GYAE6OF01BUX1N.51.27.C05.1.454.CMB.1.raw
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccntctctgcactggaaccngcagtgtacgttggtaggtttataattatgtctctcggtaaccaacaccacccaggacaaacgacccccaaatccgatagtatttactgattcgtcagtaggtactccggtcccttaggtacggggtttacaacgttccgtactttcgtcgtcggaccttacgaacggtcccgacaaccgtaccgcccttccctacgacctacgttcccgtacgtccggacccgttaccggaccgggtaccggaacgggaccgtacgggtaccgtagtaactttaacgtacgtaccgtacctacccgttactaacgttaccgtaaacaacgtacgaagtaaccgtaaacgttaacggggtttacggggttacggtttccggggaacgggtaacggggaaccgtaacgggttccgtaaacccgggtacccggttaccggtaacgggtaccacccgggttacccggaaaccggttcccggtaccccgtccccccggtttaccggacccggttacccttccccgggtttcccgttacccccccgg

SEQ ID NO: 270148 - DNA, 801 bp, Homo sapiens
  misc_feature: GYAE6OF01CXXMO.51.27.C05.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcgagggcacgagggtcctgggccctagtctcgccctgactcagcctgcctccgtgtcgtggtctcgtggacngtcgatcacctntcctcctgccacgtcggaaccagcgagtggtacggtttggttagttaatatttagtcgttccttccgtacggtaaccccaaaccaccccgtaacccgaacggaacccaaacccgaccccctaaactcctaagttacgttatttacgtgtacgttcgttacgaaggtcggtaccgtcccggtacccgttacgggttaacgggtttaccgaacgttccgttccttccgttcgtcggacctacgacggtcccgaacctacgtcccgtacccctccgactacctacttccgtcggtcgaccgtacggccgggtacgacggacgtagtcgttagttaacttcgtacgtccgacctacgttactaacgttaacgaacccgtaaggtacccaaaggtacccgtttaaaagggtttcgggtttccggggtacggggttaacccgggaacggggaaccgtaaccggtaccgttacggtaccccggttacgttaccgggtaacccggtcccaaccgggtcccgtaaccgggtcccttacccccggtccccgtttacgtaaccccttaccgttcccccggtttccccgttaacccccc

SEQ ID NO: 270149 - DNA, 764 bp, Homo sapiens
  misc_feature: GYAE6OF01EHLWH.51.27.C05.1.454.CMB.1.raw
  modified_base (199)..(199): a, c, t, g, unknown or other
  misc_feature (199)..(199): n is a, c, g, or t
  modified_base (543)..(543): a, c, t, g, unknown or other
  misc_feature (543)..(543): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgccttccgtgtcgtggtctcctggacngtcatcaccatctctgcacgtaggaaccagctaggtgtacggtttggtaggttttaataattagtcgtcctccgtaggtaacccaaccacccaacccgaggaccaaaccgaccccctaaaactcaattacgtaatttacgtgtaagttgtacgtagtcggtaaccttccgggtcccttagggttacggggtttaccaacgtttccggtacctttcgtccgtcgtcctaccgacggtccggacaaccgccggtaccctccgtacgaacctgtcctcggtccggtacctaccgacggaccggaggaccggcgtctaggtactttacgtacgacgtactacccttanaacttacgtaacacgtacgaacgtaaccaaaggtttaggggtttacgggttaccgggttacgggaccggggtaacgggtaacccctaaggtcccgttaccggtaacccggtttaccggtaaccggggttaccaaacccgggtacccgtaaccggtcccggttacccccgtccccgttcccgggtaaccttccccggtttcgttcccccggtttaccccccg

SEQ ID NO: 270150 - DNA, 773 bp, Homo sapiens
  misc_feature: GYAE6OF01DGQIL.51.27.C05.1.454.CMB.1.raw
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacgagggtcctgggcccagtctcgccctgactcacgcctcgcccttccgtgtctcgggtctccgtggacngtcatccaccagtctcctgcacgtcggaaccngacaggtcgtacggttggtagttaattatagtcgtctcgtacgtaaccaaccaccaccgagaccaaaccgacccaaatcaatgtattatcgtatcgtactgtgtacgtccgtcctaggtacgggttacagttcgtcttcgtacgtcgacctccgtaacgtcccgaacaaccgtaccggtcccttaccgacgacctacgttcgtccgtcggtcccgtccggacggtaccggacggcggaaaaaaacggtcgtaagttacgttacgttacgtaccgtaccgtacctactaactacgtaacgtaacgaaccgtaacggtaacgtaaacggttaacggttacgggttacggggttaaccggggtaccggggtaacgggaaaccggtaaccggtaaccggttacccggtaccccggttaacccgggtaacccggtaaccggtaaaccgggtaaccccggtaaccgggtaccccggttacccccggttaccccgggttacccggtttacccgtaccccgttttacccgtttaacccccgg

SEQ ID NO: 270151 - DNA, 719 bp, Homo sapiens
  misc_feature: GYAE6OF01CNSGM.51.27.C05.1.454.CMB.1.raw
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
tcagcgatcgtatacacgaccggtgctcgatttagacgcgatcgaagggtttgggggggggtctcaggaggcagcgctctcgggacgtctccaccatggcctgggctctgctatttcctcacccttcctcactcagggcacagggtcctgggcccagtctgccctgactcagcctgcctcgtgtctgggtcctccgtggacagtcgatcaccatctcctgcacgtggaaccngcagtcgacggttggtaggttanaatttagngttcctccgtacggtaacccaacctacccaacccgaggaccaaaccgcccccaaactcatagtatttanagntgcagtgacgtccgcccgtaggtagggttacgacgttccgtcttaccgtcgtacggtaccctaccgtaaacggtcccgaaccgaaccgaccggtaccctcccgtaccgacctacgtcccttaccggtcgggtaccgtacccgacggggtacccggaacgggtaccgggtacgggtacgttacgtaacgtttacgttaccgtaccgtaccttaccgtaacctaactaacgtaacaacggacaacgaacgtaaccgtagggtttcgggtcggttacgggacgggtacggaaccgtaggtccgtaccggtaccgttccggtaacggtcgaaccggccgaacggtccgtaccgccccgttacgacctccgttcccgtccgttaccccg

SEQ ID NO: 270152 - DNA, 856 bp, Homo sapiens
  misc_feature: GYAE6OF01BNICT.51.27.C05.1.454.CMB.1.raw
  modified_base (232)..(232): a, c, t, g, unknown or other
  misc_feature (232)..(232): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctctggacagtcgatccaccatcctcctgccacgtcggaaccngcagtgtacgttggtagttataatgtctctctagtaccaacacccaccacggacaaaccgacccccaaactcatgtatttagtcgtatgtcgagtcgacgtccggcccttacggtagggtttcgtaacgttccgtcttccgtacgtcggtacctacgtaaccggtcccggaaccgtaacccgaacccggtcccgttacccgtaccgtacctaccttccgtaccgttacggggtcccgttacccggaaccggggtcccggtaagggaacccggttacgggtaccgtttaacgttaaacgttttaaccgttaccgttccgtaacccgtaacccgttaaccgtaagtttaaacgtaacccgaaacgaaccgtaacgtaaaccgtaaacgtttaagggggtttccgggggttttaacggtacccgggggaaccggggtaaccggggaaacccgtaaccgggttaccgttaccgggtaaacccccggttttccccggtaaacgggttaccccgaaccccggttaaaccccgggaacgggttcccccggttaaccccccgggtaccccggtttaccccgggtaccctttacccggtttcccggtttccccccgggtttaaccccccccgg

SEQ ID NO: 270153 - DNA, 521 bp, Homo sapiens
  misc_feature: GYAE6OF02JQTXQ.51.27.C05.1.454.CMB.1.raw
  modified_base (301)..(301): a, c, t, g, unknown or other
  misc_feature (301)..(301): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (495)..(495): a, c, t, g, unknown or other
  misc_feature (495)..(495): n is a, c, g, or t
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaatcatgattangatgtcagtgatcggcctcagggtttcatcgcttcnctgctcaagtccgnaacacggcctcctgacccatcctcgtgggcctccgaggccgaggacgaggctgtattatactgcacctcatactacaagcaagcaactaagttgggtcgttcggcgagggaccaagcctgaccgtcgtaggtcagcccaaggcncgccctcggtcacgtctcgttccccg

SEQ ID NO: 270154 - DNA, 509 bp, Homo sapiens
  misc_feature: GYAE6OF02I2XHQ.51.27.C05.1.454.CMB.1.raw
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccaccaggcaaagcccccaaatcatgatttatgatgtcagtgatcggccctgaggggtttcaatcgcttctctggctcaagtccggcaacacggcctcctgaccatctctgggctccaggccgaggacgaggctgattattactgcacctcatatacaagcagcaacagttgggtgttcggcggaggacaagctagaccgtctaggtcacgccaaggctcgcccctggtcactctccg

SEQ ID NO: 270155 - DNA, 524 bp, Homo sapiens
  misc_feature: GYAE6OF02G0204.51.27.C05.1.454.CMB.1.raw
  modified_base (305)..(305): a, c, t, g, unknown or other
  misc_feature (305)..(305): n is a, c, g, or t
  modified_base (424)..(424): a, c, t, g, unknown or other
  misc_feature (424)..(424): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccaccaggcaaacgcccccaaactcatgatttangatgtcagtgatcggccctgagggtttcaatcgcttctctggctccaagtccgacaacgcgcctcctgaccatctctgggcctccgaggccgaggacgaggctgattatactgcacctnatactacagcagacaacaagttgggtgttcgggcggaacgaccaagctcgaccgtccgtaggtcacgcccaaggctccgcccctcggtcctactcgtccg

SEQ ID NO: 270156 - DNA, 530 bp, Homo sapiens
  misc_feature: GYAE6OF02GEZHD.51.27.C05.1.454.CMB.1.raw
  modified_base (302)..(302): a, c, t, g, unknown or other
  misc_feature (302)..(302): n is a, c, g, or t
tcagcgatcgtatacacgaccggtgctcgatttagacgcgatcgaaggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccaccaggcaaagcccccaaatcatgatttangatgtcagtgatcggccctgaggggtttcaatcgcttctctggctcaagtccggcaacacggcctccctgacccatcctctgggctccgaggccgaggacgaggctgattatactgcacctcatatacaagcagacaacgaagttgggtcgttcgggcggagggaccaagctgaccgtcgtaggtcacgcccgaagcctcgcccccgtggtccactcctcgttccccc

SEQ ID NO: 270157 - DNA, 527 bp, Homo sapiens
  misc_feature: GYAE6OF02GMW93.51.27.C05.1.454.CMB.1.raw
  modified_base (301)..(301): a, c, t, g, unknown or other
  misc_feature (301)..(301): n is a, c, g, or t
tcagcgatcgtatacacgaccggtgctcgatttagacgcgatcgaagggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaatcatgatttangatgtcagtgatcggccctcgaggggtttcaatcgcttctctggctccaagtccggcaacgacggcctccctgacccatcctctgggctccgaggccgaggaccgaggctgattatactgcacctcatatacaagcagacaacagttgggtgttcggcggaggaccaagctgaccgtcgtaggtcacggcccaaggcctcgcccccgtggccacttctcgttcccc

SEQ ID NO: 270158 - DNA, 625 bp, Homo sapiens
  misc_feature: GYAE6OF02I982Q.51.27.C05.1.454.CMB.1.raw
  modified_base (309)..(309): a, c, t, g, unknown or other
  misc_feature (309)..(309): n is a, c, g, or t
  modified_base (500)..(500): a, c, t, g, unknown or other
  misc_feature (500)..(500): n is a, c, g, or t
  modified_base (605)..(605): a, c, t, g, unknown or other
  misc_feature (605)..(605): n is a, c, g, or t
tcagcgatcgtatacacgaccggtgctcgatttagacgcgatcgaagggtttggggtggggtcgtcgaggaggcagcgctctcgggacgtctccaccatggcctgggctctgctattcctcaccctcctcactcagggcacagggtcctgggcccagtctgccctgactcagcctgcctccgtgtcctgggtctcctggacagtcgatcaccatctcctgcactggaaccagcagtgacgttggtggttataattatgtctcctggtaccaacaccaccaggcaaacgccccccaaatccatgatttancgattgcagtgactaccggccctgacggggtttcaactcgtcttactcgtcggctccgtaacgtcccggacaaccacggcccttccctaggtacccatcctcgtcgggtcctaccgcgggcccgtaaggaccgaacggtcctagtacgttattacgtcgtacctaccctacacttaataaccgaagaaccnggaaccaaagtaacgtttgggttcgtaccgggacggaacgggtaccaaggtcctacggaccccgttcgtaagtccgacgacccgtaaggccctaccggcccccgnggttacccacgttcctcccg

SEQ ID NO: 270159 - DNA, 561 bp, Homo sapiens
  misc_feature: GYAE6OF02H1NO7.51.27.C05.1.454.CMB.1.raw
  modified_base (309)..(309): a, c, t, g, unknown or other
  misc_feature (309)..(309): n is a, c, g, or t
tcagcgatcgtatacacgaccggtgctcgatttagacgcgatcgaagggtttgggggtggggtctcaggaggcagcgctctcgggacgtctccaccatggcctgggctctgctattcctcaccctcctcactcagggcacgaggtcctgggcccagtctgccctgactcagcctgcctccgtgtctgggtctcctggacagtcgatcaccatctcctgcactggaaccagtcagtgacgttggtgttataattatgtctctggtaccaacaccacccaggacaaaacgcccccaaatccatgtatttangatgtcagtgacgtcgccctgtagggttacatcgtctctcgtcgctacagtccggacaactcggccctcctacgaccatctcgtggctccgagcgacggacgagctagtattatctgccacgttacattagacaaggcaagaccaaactaaggttggtacgtcggacggaacgacgagtcgtacgtaccgtcgtacggtacaccggtaccgaggtccgtaccggtcccctacgggtctaccgtcgttccccg

SEQ ID NO: 270160 - DNA, 717 bp, Homo sapiens
  misc_feature: GYAE6OF02FNJN8.51.27.C05.1.454.CMB.1.raw
tcagcgatcgtatacacgaccggtgctcgatttagacgcgatcgaagggtttgggggtggggtctcaggaggcagcgctctcgggacgtctccaccatggcctggactctgctattcctcaccctcctcactcagggcacagggtcctgggcccagtctgccctgactcagcctgcctccgtgtctggggtctcctggacagtcgatcaccatctcctgcactggaaccagcagtgacgttggtggttataattatgtctcctggtaccaacaccaccaggcaaagcccccaaactcatgatttatgatgtcagtgactccggccctggtacggggtttcgaagtcggtcttcgtctggtctccgaaggtcccggacaaccgaccggtccctacccgtcgaccctatccgtcgtcggggtcctaccgacgggtacccgtagggtaaccgtagggtccgttacggtaacttttaacgtttaaccgtcggtaccctaacccgttactaaacgttaactaaaccgaacggtaccgaacggtaccaaaaccgttaaaggtttcgggggttacgtttaccggggaccggtaaacggggaaccctaagggtccgtacgggtaaccccggttaccggtaacgggttacccacggtaaccccgtaacgggtccctaccggtacccccccggttcgggtaccccgttaccgttcccgttaccccgg

SEQ ID NO: 270161 - DNA, 588 bp, Homo sapiens
  misc_feature: GYAE6OF02HID1S.51.27.C05.1.454.CMB.1.raw
  modified_base (228)..(228): a, c, t, g, unknown or other
  misc_feature (228)..(228): n is a, c, g, or t
  modified_base (441)..(441): a, c, t, g, unknown or other
  misc_feature (441)..(441): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataattatgtctcctggtaccaacaccaccaggcaaacgcccccaaactcatgatttatgatgtcagtgatccggccctcgaggggtttcaatcgcttctctggcctccaagtccgacaacaccggcctccctgaccatcctcgtcgggcctccgagggcccgaggaccgaggctagtattactactgccacctnaatataacagcagcaaacagttgggtacgttcggacggaacggacctaaggcctacggacccgttccgtaacggtccaacggaccccgaacgggtcccgttcccggccccccgttacgggttccctacccgttcccgtttaccccgg

SEQ ID NO: 270162 - DNA, 467 bp, Homo sapiens
  misc_feature: GYAE6OF02GBMEM.51.27.C05.1.454.CMB.1.raw
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (432)..(467): a, c, t, g, unknown or other
  misc_feature (432)..(467): n is a, c, g, or t
tcagcgatcgtatacacgaccggtgctcgatttagacgcgatcgaagggtttggggcgtttgcctgggtgggttataattaatgtctccttggtaccaaacaaccaccccagggcaaaagcccccaaacgtccgactcgattttactcgatcgtcagtgatcggccctcaggggtttcgaatcggccttctctggctccaagtccggcaacacgcctccctgaccatcgtcctgggctccgaggccgaggaccgaggtcttgagttattactgccacctcataattacagcagcaacaattgggtgttcggccggagggaccgaacgctgaccgtcctaggtcagcccaaaggctgccccctcgggtccactcctggttccccgcccctcctctccgtagcactctgacgcgggctgggctaggccncancnnnnnnnnnnnnnnnnnnnnnnnnnnnnnnnnnnnn

SEQ ID NO: 270163 - DNA, 539 bp, Homo sapiens
  misc_feature: GYAE6OF02IX0RU.51.27.C05.1.454.CMB.1.raw
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctcctggtaccaacaccacccaggcaaacgcccccaaactcatgatttatgatgtcagtgatcggccctgtaggggtttcatcgcttcnctggctcagtcgcacacgcctccngaccatctcgtggcctccgaggccgaggaccgaggctgtaattattacctgcctacctcaatactacaagtcacgacaaacgtagtttgggtggttcgggacggaacgggaccaagctggacccgtcgtacggtcacgccaaggcctccgccccgtggtcctactctcccg

SEQ ID NO: 270164 - DNA, 585 bp, Homo sapiens
  misc_feature: GYAE6OF02HAXO9.51.27.C05.1.454.CMB.1.raw
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtggttataattatgtctcctgtaccaacaccacccaggcaaacgccccccaaactcactgatttatgatgtcagtgatcggccctcgaggggtttcgaatcgtcttctctggctccaagtccggacaacgaccggccctccctgaccatcgtcgtcgggctccgacggccgaaggacgagctgtacttacttacgtgccacctcactataacaagcacgacaacgtagttcggtcgttcgggcggacgggaccgaagccgtacgtaccggtccgtacggtacgacggacccgaacggtccgtaccggtccccccgtaggtaccctacgttcccgttaccccgg

SEQ ID NO: 270165 - DNA, 550 bp, Homo sapiens
  misc_feature: GYAE6OF02IBK87.51.27.C05.1.454.CMB.1.raw
  modified_base (413)..(413): a, c, t, g, unknown or other
  misc_feature (413)..(413): n is a, c, g, or t
  modified_base (445)..(445): a, c, t, g, unknown or other
  misc_feature (445)..(445): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctgtacaacacaccagacaaacgccccaactcatgtatttatgatgtcagtgactcgcctgtagggtttcgaatcgtcttctcgtgcctctaacgtccgacaaccgcgccctccctcgacctatcctcgtacgggcctccgagggccgaggacgngctgattatactcgcactctaatactacgaancagacaaacgtagttgggttcgtcggacggtaggaaccagcgtacgtaccgtctaggtcaccggaccaggtcctccgtcccccgtggtacctaccgtcttacccg

SEQ ID NO: 270166 - DNA, 515 bp, Homo sapiens
  misc_feature: GYAE6OF02G4PJJ.51.27.C05.1.454.CMB.1.raw
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (504)..(504): a, c, t, g, unknown or other
  misc_feature (504)..(504): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccaccaggccaaacgcccccaaatcatgatttatgatgtcagtgatccggccctcgaggggtttcgaatcgcttctctggctcagtccgcaacncgcctccngaccatctctcgggctccgaggccgaggacgaggctgtattatactgacacctcattatacaagcagacaactagttgggtgttcggcggaggacagctgaccgtcgtaggcacgccagctcgcccctgcnctcctcgtccc

SEQ ID NO: 270167 - DNA, 583 bp, Homo sapiens
  misc_feature: GYAE6OF02F9SFW.51.27.C05.1.454.CMB.1.raw
  modified_base (304)..(304): a, c, t, g, unknown or other
  misc_feature (304)..(304): n is a, c, g, or t
  modified_base (442)..(442): a, c, t, g, unknown or other
  misc_feature (442)..(442): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccaccaggcaaacgcccccaaactcatgatttangatgtcagtgatcggccctcgtaggggtttcaatcgcttctctggcctccgaacgtccggacaacgaccggccctcccgtcgacccatccgtcgtcgggcctccgaggccgaggacgaggctgattatactgcacctnatactacagcagaccaagtaagtttgggtagttcgggacggacgggaccaagccgtacgacccggtcgtaacgggtccaacggacccgaaggtcctcccggtcccccggttcggtacctaccgttccggtccttacccccg

SEQ ID NO: 270168 - DNA, 556 bp, Homo sapiens
  misc_feature: GYAE6OF02JCRPA.51.27.C05.1.454.CMB.1.raw
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
tcagcgatcgtatacacgaccggtgctcgatttagacgcgatcgaaggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttaataattatgtctcctggtaccaacaccacccaggcaaacgcccccaaactcatgatttatgatgtcagtgatccggcctcgaggggtttcaatcgtcttctctggctccaagtccgacaacacggcctccctgaccatctctcgggcctccgaggccgagggacgaggctgatttactactgcacctnatactacaancagacaactagttggtagttcggcggaggaccaagcgtcgaccgtcgtaggtccacggacccgtaaggcccgttacgcccccgtacggtccaccgtttctccgttacccccc

SEQ ID NO: 270169 - DNA, 819 bp, Homo sapiens
  misc_feature: GYAE6OF02HIM3O.51.27.C05.1.454.CMB.1.raw
  modified_base (251)..(251): a, c, t, g, unknown or other
  misc_feature (251)..(251): n is a, c, g, or t
  modified_base (302)..(302): a, c, t, g, unknown or other
  misc_feature (302)..(302): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattngtctctgtaccaaccaccaccaggacaaaccgccccaaatcatgtatttangtatgtacaggtgtacgtccgggtacccttcgggtacggggttttacgaacgttccggtcctttaccgtcgttcgggtccttaacccgtaacggttcccgggaacctaaaccgtacccggtacccttaccccgtcgaacctacgttccgttcgtcggggtccctaccggacgggacccgggaacggggtaaccggtacgggtaccgttaggttaacttttaaccggtttaaccgtccggttaacccttaaccccgttacgtaaacttaaacgttaaaccgaacgtaccgaacgtaaccgtaaaaccgtttaagggtttccgggggttacggtttaccggggaaccggggtaacgggaacccgtaaccggttccggtaccgggttaacccggttacccggttaaacgggtacccgtaacccgggtaaccccggtaacgggtcccccgtttaccccgggtaccccccgttaccgggttacccctttaacccgttcccggttacccccggtttacccccc

SEQ ID NO: 270170 - DNA, 615 bp, Homo sapiens
  misc_feature: GYAE6OF02ICQCK.51.27.C05.1.454.CMB.1.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggcagtcgatcaccatctctgcacgtggaaccngcagtgacgttggtgttatatntgtctctgtaccaacaccacagacaaacgaccccaactcatgtatttatgtatgtctagtgactccggtcctgtagggtttacattcgtacttcgcgtcggctaccgaaggtccgaacaacgaccggtcccttaccctacgaccctagttcctcggtcgggtcctccggacgggaccggaaggacggaggtcgtagtattacgtacgtgtacctactagaattacgaacagctaacgaataacgtaggttcgggttacgtacggcggtacggaccaagtctacggtaccgtacgacggtaccacgacccgtacgtccctacccggcccgtacgttaccctacgttacccgttccttaaccccccg

SEQ ID NO: 270171 - DNA, 509 bp, Homo sapiens
  misc_feature: GYAE6OF02HPKUN.51.27.C05.1.454.CMB.1.raw
  modified_base (251)..(251): a, c, t, g, unknown or other
  misc_feature (251)..(251): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (456)..(456): a, c, t, g, unknown or other
  misc_feature (456)..(456): n is a, c, g, or t
  modified_base (502)..(502): a, c, t, g, unknown or other
  misc_feature (502)..(502): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattntgtctctgtaccacaccaccagcaaacgcccccaaactcatgatttatgatgtcagtgagtccggccctgtaggggttacgacgtcgcttctctggctccagtccgacaaccgcgccctcctcgacctactctcgtcggctccgcggccgaggacgnggctgattatctgacnctcatatacagcagcaagtagttggtgtcggnggagacagctcgtacgtcgtagtcacgccgagctccgcccgtcgcnctctccg

SEQ ID NO: 270172 - DNA, 546 bp, Homo sapiens
  misc_feature: GYAE6OF02F7FAX.51.27.C05.1.454.CMB.1.raw
  modified_base (252)..(252): a, c, t, g, unknown or other
  misc_feature (252)..(252): n is a, c, g, or t
  modified_base (333)..(333): a, c, t, g, unknown or other
  misc_feature (333)..(333): n is a, c, g, or t
  modified_base (387)..(387): a, c, t, g, unknown or other
  misc_feature (387)..(387): n is a, c, g, or t
  modified_base (411)..(411): a, c, t, g, unknown or other
  misc_feature (411)..(411): n is a, c, g, or t
  modified_base (437)..(437): a, c, t, g, unknown or other
  misc_feature (437)..(437): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgccctcgtgtctgggtctcctggacagtcgatcaccatctcctgcactggaaccagcagtgacgttggtgttataattngtctcctggtaccaacaccacccaggcaaacgccccccaaatcatgtatttatgatgtcagtgatcggcctgtagggtttnaatcgcttctctggctaccgaagtccggacaacgacgcctccctgaccctatcncgtgggctccgaggccgaggacgngctagtattatactgaccactcatanacaagcagaccaatagttgggtgttcggacggaggacagcgtgaccgtccgtaaggcacgtacccgaggcctaccggccccgtaggtcctacgtccctcggttcccccg

SEQ ID NO: 270173 - DNA, 734 bp, Homo sapiens
  misc_feature: GYAE6OF02H22T0.51.27.C05.1.454.CMB.1.raw
  modified_base (210)..(210): a, c, t, g, unknown or other
  misc_feature (210)..(210): n is a, c, g, or t
  modified_base (251)..(251): a, c, t, g, unknown or other
  misc_feature (251)..(251): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntctctgcactggaaccagcagtgacgttggtgttataattngtctctgtaccaacaccaccaggacaacgaccccaactcatgatttatgatgtcgtagtgacgtccggtccctcgtacgggtttcgaattccgtcttctcgttcggtctaccgaacggtcccggaacaacgtacccggtcccctcccgtacgaaccctactccgttccggtcgggtcccgtacccggacgggaccccgggaacggacggacggtcgttacgtagtttaacttaccgttcgacccgtaaccctactaactttaacgaaacgaacgtacgaaacgtaaccgtaaaacgtttagggtttacgggggtttacgggttccggggaccggggtaaacggggaacccgaacggttccgtaccgggtaaccccggtttccggtaaacgggtacccgtaacggaccccggtaacgggtcccgtaccccggtcccccgttaaccggttcccgtaccgtttcccggtaccccgtttaccccccg

SEQ ID NO: 270174 - DNA, 658 bp, Homo sapiens
  misc_feature: GYAE6OF02FHIZ2.51.27.C05.1.454.CMB.1.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
  modified_base (332)..(332): a, c, t, g, unknown or other
  misc_feature (332)..(332): n is a, c, g, or t
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgccactggaaccngcagtgacgttggtgttatattngtcncngtaccacncaccaggcaaacgccccaatcatgatttangatgtcagtgatcgcctgaggggtttcaagtcgcttcncgtggcctcgaacgtccggacaaccgtcggtccctacccgtcgacctacgttcctcgcggccttacggacggtacccggaaggtaccgacgggtcttaggtaactttacgtacctcggtaccacccttacgaaccttagtaaccgaactcgtaacgaccgttaaacgtaacggtttcggggtttaccgggttaccgggacggttaaacgggacctaacggtcccgttacggacccggttaccgtacggacctaaccggaccccggtaaggcccctacccggtacccccgttaggttcccaccctttccgttacccgttaccccccg

SEQ ID NO: 270175 - DNA, 720 bp, Homo sapiens
  misc_feature: GYAE6OF02IB2KN.51.27.C05.1.454.CMB.1.raw
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
tcagcgatcgtatacacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccagcagtgacgttggtgttataattangtctcgtgtaccaacaccaccaggcaaagccccaaatcatgatttanagtatgtcagtgacgtcggcctacgtagggtttacgaatcgtacttctactcggctccgaaggtccgactaaacgaccggcctacccgtacgacccgtaatccgttacggtcgggtcctacccgagggacccgaagggacccggagccgttagtaactttacgttaaccgtcggtaacctaacccgttacaaacttaataaaccgaaacggtccaaacgtaactaaaccgtaaaggttttccgggggtttagttaccggggacggggtaaacggtaacccgtaacgggcctttaccgggaaaccccggtttcccgtaaaggggtcccaacgggtaacccccgtaacgggtcccgttcccggtaaccccccgtttacgggtcccctaaacggttttccccggtacccgtttacccccccgg

SEQ ID NO: 270176 - DNA, 553 bp, Homo sapiens
  misc_feature: GYAE6OF02FTV5D.51.27.C05.1.454.CMB.1.raw
  modified_base (248)..(248): a, c, t, g, unknown or other
  misc_feature (248)..(248): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (429)..(429): a, c, t, g, unknown or other
  misc_feature (429)..(429): n is a, c, g, or t
tcagcgatcgtatacacgaccggtgctcgatttagacgcgatcgaaggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggtttanaattatgtctcctggtaccaacaccacccaggcaaagcccccaaatcatgatttatgatgtcagtgatcggcctcgaggggtttcaattcgcttctctggctccaagtccgacaacncggcctcccgngaccatctcgtgggctccgaggccgaggacgaggctgattattctgccacctnataatacaagcagacaactagttcgggtgttacgggcggaacggaccaagccgtagacccgtcgtaggtccacggcccgaagccgtccgtcccccgttcggtactaccgttctaccgttccccc

SEQ ID NO: 270177 - DNA, 688 bp, Homo sapiens
  misc_feature: GYAE6OF02HZ5Z3.51.27.C05.1.454.CMB.1.raw
  modified_base (259)..(259): a, c, t, g, unknown or other
  misc_feature (259)..(259): n is a, c, g, or t
  modified_base (305)..(305): a, c, t, g, unknown or other
  misc_feature (305)..(305): n is a, c, g, or t
tcagcgatcgtatacacgaccggtgctcgatttagacgcgatcgaagggtttggggtggggtctcaggaggcagcgctcgtcgggacgtctccaccatggcctgggctctgctattcctcaccctcctcactcagggcacgagggtcctgggcccagtctgccctgactcagcctgcctccgtgtcgtgggtctccgtggacaggtcgatcaccatcctcctgcacgtggaaccagcagtgacgttggtgttataattntgtctctgtacacaccaccagacaacgccccaaatcatgtatttangatgtacagtgacgtccggcctggtaggggtttacaagttcgtacttctcgtcggacctacgaacggtccggacaaccgaccggtcccttacccgtacggaaccctattccgttaccgtcggggtaccctaccggacggggacccgaagggacggacgggtctacggtaacttttacgtacgtcgacctaaccgtactaaataactaaccgaagaccgaagaacctaaacgttaaggtttcgggggttacgttaccggggacgggtaacggaaccgtaggtccgttacgggtacccgtcggttaacggtccgaacccggtacccggaacgggtccctcccgggtacccccgttagggttaccctaccgttcccgttaccccgg

SEQ ID NO: 270178 - DNA, 725 bp, Homo sapiens
  misc_feature: GYAE6OF02F1Z20.51.27.C05.1.454.CMB.1.raw
tcagcgatcgtatacacgaccggtgctcgatttagacgcgatcgaagggtttgggggggtcgtcgaggaggcgagcgctctcgggacgtctccaccatgcctggctctgctattcctcaccctcctcactcaggcacagggtcctgggcccagtctgccctgactcagcctgcctccgtgtctgggtctcctggacagtcatcacatctctgccatcggaaccagccagttgacgtttggtaggttataagtttatgtctccgtaggtaccaacgtaccaacccaggacaaacgaccccccaaatcaatacgtatttatgattgtcagtgatccggcctacgtagggtttcgaatcgcgtttctcgcggtcctaccgtaagtccgctaaacgccggtaccctccccgttgaacccctattcctcgttcggccttaccgacggtacccggaacggtaccggaacggtccttacggaaatttacgtaacttcggtacctacccgttactaattaactactaaaacgccgttaaacgaaccgtaactaaaacggttttcggggttaacggtttacgggaaccgggttaaaccggggaactaaaccgggcgtttacggaccggtttaacccgtacgggtttacccggaacggtccccgtaaacgggtaccctaccggtcccccccgttagggttacccaacccggttttccgtacccgtttaccccccg

SEQ ID NO: 270179 - DNA, 530 bp, Homo sapiens
  misc_feature: GYAE6OF02GNK4U.51.27.C05.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (513)..(513): a, c, t, g, unknown or other
  misc_feature (513)..(513): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctcctggtaccaacaccacccaggcaaacgcccccaaactcatgatttangatgtcagtgatcggcctgagggttcgaatcgcttctctggctcaagtccganaacncggcctcctgaccatctcgtcgggctccgaggccgaggacgaggctagattatactgcacctnatanacaagcagacaactagttgggtgttcggcggaggacagctgaccgtcgaggtcacggacccaaggcctccgccccgtggtaccnccttcgtccgttccccg

SEQ ID NO: 270180 - DNA, 642 bp, Homo sapiens
  misc_feature: GYAE6OF02IVN29.51.27.C05.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
tcagcgatcgtatacacgaccggtgctcgatttagacgcgatcgaaggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccagcagtgacgttggtggttataattatgtctcctggtaccaactaccaccaggcaaagccccccaaatcatcgatttangatgtcagtgatcggcctgagggtttcaatcgcttctctggctccaagtccggacaacaccggcctcccgtgaccctatcctcgtgggcctccgaggtccgaggacgaggcctgtattactacgtgacctacctcgaactaagtaccaaggtcaacggacctaaaccgtaagtttgggggttacgtttacggggaccgggtaaacggggaaccaaagggtccttacgggaacccggtttcccgtaaagggtcccaacggtacccccgaaagggtcccgttacccggcccccccgttagggtaccctaaccccgtttcgttaccccggtttacccccc

SEQ ID NO: 270181 - DNA, 812 bp, Homo sapiens
  misc_feature: GYAE6OF02I84AZ.51.27.C05.1.454.CMB.1.raw
  modified_base (199)..(199): a, c, t, g, unknown or other
  misc_feature (199)..(199): n is a, c, g, or t
  modified_base (332)..(332): a, c, t, g, unknown or other
  misc_feature (332)..(332): n is a, c, g, or t
tcagcgatcgtatacacgaccggtgctcgatttagacgcgatcgaaggtttggggggggggtctcaggaggcagcgctctcgggacgtctccaccatggcctgggctctgctattcctcaccctcctcactcagggcacagggtcctgggcccagtctgccctgacccagcctgcctccgtgtctgggtctcctggacngtcgatcaccatctcctgcacgtggaaccagcagtgacgttggtagttataattatcgttctccgtacggtaaccaacgacccacccaaggaccaaaaccgtaccccccaaaactcacgttagtaacttttanaggtatacgtactaggtacgacgtccggtcccgttacggtacgggggttttacaacgttccggtcttcttccgtacgcccgtaccgtaaacgtcccggactaaaccgccggtcccttcccgacgtacccctattaccgttccggtccggtcctacccgacggggacccggtaagggaccgggtaacgttcgttaacggttaactttaacgtttaccctacggtaccctaaccgtttaaccaaacgtttaacgaaaccgtaaaccgcgaaacgtaccgtaaaacgttacgggttttaccgggggttaaggttacccgggggaacgggttaaacggaacccgtaagggtacccgttccgggtaaccggttaccggttaacggtccgtaaccgggtaacccggtaccggttacccgtccccggttaccccttcccgggtaacttacccgtttccccgtttaccccggttccccgttacccccg

SEQ ID NO: 270182 - DNA, 538 bp, Homo sapiens
  misc_feature: GYAE6OF02GFBLN.51.27.C05.1.454.CMB.1.raw
  modified_base (197)..(197): a, c, t, g, unknown or other
  misc_feature (197)..(197): n is a, c, g, or t
  modified_base (252)..(252): a, c, t, g, unknown or other
  misc_feature (252)..(252): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacngtcgatcaccatcctcctgcactggaaccagcagtgacgttggtgttaataattntgtctcctggtaccaacaccaccaggcaaagcccccaaatcatcgatttatgatgtcagtgacgtccggccctcgtaggggtttcgaatcgtcttctcgtggctccagtccgcaacacggcctccctgacctactctctcgggctccgaggccgaggacgaggctgacttatactggcacctnactatacacgcagacaanagttggtgttacggcggacggacagctagccgtcgtaggctacgaccgaagctccgccccgtgtccacttccgtccgttaccccg

SEQ ID NO: 270183 - DNA, 686 bp, Homo sapiens
  misc_feature: GYAE6OF02FJOPK.51.27.C05.1.454.CMB.1.raw
  modified_base (257)..(257): a, c, t, g, unknown or other
  misc_feature (257)..(257): n is a, c, g, or t
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
tcagcgatcgtatacacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctccgtgccacgtcggaaccagcagtgacggttggtggttataattntgtctccgtggtaccaacaccaccaggcaaagcccccaaactcatgatttagngatgtcagtgatccggcctcgtaggggtttcaagtcgcttctctgctcagtcgacacgcgccncctcgaccatctcgtcgggctccgacgggtccgaacgggacggaggtctagtaactttacttacgcgtaccgtacccttctaacgtaatacgaaacgcgaacgaacttaaacgaaaggttttcggggtaggtttcccggggaacgggtaacggggtaacccgaaagggtccgttaccgggtaaccccgtttccggtaaccggggttacccgacccggtaaccccggtaacggggtccccgtaaccccggtcccccccggttacgggtttaccccgtaccccgtttacccggtttacccggtttaacccccccg

SEQ ID NO: 270184 - DNA, 814 bp, Homo sapiens
  misc_feature: GYAE6OF02IEZPX.51.27.C05.1.454.CMB.1.raw
  modified_base (210)..(210): a, c, t, g, unknown or other
  misc_feature (210)..(210): n is a, c, g, or t
  modified_base (256)..(256): a, c, t, g, unknown or other
  misc_feature (256)..(256): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (515)..(515): a, c, t, g, unknown or other
  misc_feature (515)..(515): n is a, c, g, or t
tcagcgatcgtatacacgaccggtgctcgatttagacgcgatcgaagggtttgggggggggtcgtcgaggaggcagcgctctcgggacgtctccaccatggcctgggctctgctattcctcacctcctcactcaggcacaggtcctgggcccagtctcgccctgactcagcctgcctccgtgtctgggtctccgtggacagtcgatcacntctcctgcactcggaaaccagcaggtgaccggtttggtaggtttanaagtttaatgtactccgttgtaccaaccaccaccaggccaaacgaccccaaactcagtntattactnaatntctagtgactccggcctgtagggtttacaacgtcgtccttactcgtcggtactaccgtaacggttaccggaccgaaaccgtacccggtccccttaccccgttacggaaccccttaacgttcccggtccggtttacgggtcccgttaacccggtaccggggaccccgggtaaacgggtaaacccggggnggttacccgtaaggtaaacgtttaacgttttaaccgtaccggtaaccccttaacccttaacccttaaacgtaaccgttaaacaaacccggttcgaaaccgttaaactaaacccggttaaagtttaacggggtttcgggtttacccgggaacgggggttaaaccgggaacccgtaaaacgggccgttacccgtaacccggggttccgttaaaccgggttaccgacggtaaccccgtaacggtcccggtaacccgtccccggttaccggtcctaacccgttccgtacccgtttaccccccg

SEQ ID NO: 270185 - DNA, 667 bp, Homo sapiens
  misc_feature: GYAE6OF02I9QCQ.51.27.C05.1.454.CMB.1.raw
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtcgtggtcctccgtggacagtcgatcaccatctcctgcacgtggaaccagcagtgacgttggtaggttataattagtgtctcctggtaccaacaccaccgaggaccaaacgtcccccaaatcatgatttancgtagttgctagngtactcggtaccctggtacgggtttccaaggtctccttactcgtcggtaccgttaccgaacgtaccggacctaacggccggtaccctccgtacgaccctagttccctcggtcggcctcgacggacggacgacggacgtgtacgtatttagtacctgtaccgtctacagttaacacgaagctaagacctaaagtagttcggggttacggtccgggacgggtaaaccgggacgaaccggtccgtaccggtaaccggttacggtaccggtccgaacccgggtcctaaacgggtcccgtacccgtcccgggtccgtaacctccgttcccgtcccggttacccccg

SEQ ID NO: 270186 - DNA, 637 bp, Homo sapiens
  misc_feature: GYAE6OF02JNWDV.51.27.C05.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (404)..(404): a, c, t, g, unknown or other
  misc_feature (404)..(404): n is a, c, g, or t
tcagcgatcgtatacacgaccggtgctcgatttagacgcgatcgaagggtttgggggggggtcgtcaggaggcagcgctctcgggacgtctccaccatggcctgggctctgctattcctcaccctcctcactcagggcacagggtcctgggcccagtctgccctgactcagcctgcctccgtgtctgggtctccgtggacngtcgatcaccatcctctgcactggaaccngcagtgacgttggtggttataattntgtctctgtaccaacaccaccagacaaacgcccccaaatcatnatttagtatcgtnagtnatccggcctcgtaggggttcgaatcgtcttctcgtggcctacgacggtccgacaaccgcgccctcctacgacctctcgtccgtggtccnccggacggaccggacgggaccggaggctaggtacttacgttacgtcgtacgtaccctactactaactaaccgacacgacgtaacgaacttaacgttcgggtttacggttcggggacgggaaccggtaacgacgtaccgtacggtacccgttaccgtacggtaccaaccggacccgaacggtccctcccggtacccgtccggttcccggtaaccttccgttccccgttaccccc

SEQ ID NO: 270187 - DNA, 807 bp, Homo sapiens
  misc_feature: GYAE6OF02G62ES.51.27.C05.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (460)..(460): a, c, t, g, unknown or other
  misc_feature (460)..(460): n is a, c, g, or t
tcagcgatcgtatacacgaccggtgctcgatttagacgcgatcgaagggtttgggggggggtctcaggaggcagcgtctctcgggacgtctccaccatggcctgggctctgctaattcctcaccctctcactcagggcacagggtcctgggcccagtctgccctggactcagcctgcctccggtgtcgtgggtcctcctggacngtcgatcacatcctctgcactcggaaccngcagtcgacgttggtagttatacttncgtctccgtggtaccaacaccgaccgagaccaaaccgacccccaaatccatacgtatttacgtacggattcgtacgtagtcggaactccggacccttacggttacggggtttaccaacgttccgttcctttccgttacggtccgggaccttaccgtaaacggtcccgggtaaccaaacggtaccggtcccttacccggtanacccgtaagttcccttcgggtcggaccgtacccggacgggtaaccggacggggaacggtcggtacgttacggttaactttacgttaacctacggtaccctaaccgttaactaacgttaaacgttaaaccgaacgtaacgaaccgtaacgtaaaccgttaacgggtttcggggttacgggtttaccggggacgggtaaaccgggaaaccgtaacgggtcccgttacgggtaaccccggttccggttaaaccgggtacccgtaaccggtaacccggaaccggttcccgtaccccggtacccccgttaggttacccctaaccggtttcccggttccccggtttacccccg

SEQ ID NO: 270188 - DNA, 669 bp, Homo sapiens
  misc_feature: GYAE6OF02FRGXQ.51.27.C05.1.454.CMB.1.raw
  modified_base (252)..(252): a, c, t, g, unknown or other
  misc_feature (252)..(252): n is a, c, g, or t
tcagcgatcgtatacacgaccggtgctcgatttagacgcgatcgaaggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactggaaccagcagtgacggttggtggttaataattntgtctctgtaccaacaccaccaggacaaacgcccccaaactcatgatttatgatgtacagtgtacgtccggccttcgtagggtttcaagtcgtcttctcgtcggcctcgaacggtccgacgaacaccggtccctcccgtacgaccctactccgtcgtcgggtaccgttccgacgggaccggaggaaccggtacggtcctagtaactttattaccgtacacctacccgtactattaaccgtaacaacgactaacgaacgtaaacgttaaggtttagggtacggttaccggggacgggaacgggtaaccgaaacggtccgttaccggtacccgtaccggttacggaccaccggtaccccgaacggtccgtacccggtcccccggtacgttaccctaccgttacgtccccgttacccccg

SEQ ID NO: 270189 - DNA, 724 bp, Homo sapiens
  misc_feature: GYAE6OF02IC63I.51.27.C05.1.454.CMB.1.raw
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (345)..(345): a, c, t, g, unknown or other
  misc_feature (345)..(345): n is a, c, g, or t
tcagcgatcgtatacacgaccggtgctcgatttagacgcgatcgaagggtttggggggggggtctcaggaggcagcgctctcgggacgtctccaccatggcctgggctctgctattcctcaccctctcactcacgggcacgagggtcctgggcccagtctgccctgactcagcctgcctccgtgtcgtcgggtctcctggactagtcgactcaccatctccgtagctaccgtgaaccgagcgaagtcggtacggtttggtagtttaanaactttnttcgtacttccgtacggtaacccaacacccaccgaggaccaaacccgtaccccctaaactcgttaacgtntaagtttacgtagtagttagtaccgaaggttcgacggtcccggtacccgttacgggttaacggggtttaccaagttccggtaccttctccggtccgtccgtaaccggtaccggccgtacgaacccgaccggtccccttacgactaccctacttcgtcgtcggtacaaccgggtcgaccggaggtcggactgttacgtaatttacgtactcggaaactctaacgtactacgtaacgaacgctaaccgttacaaccgtttagggttacgggtcggtaccgggtacgggacggaactacgcgacggtaacccgtggtccggaacgaccgtcggaaccgcttacccggccgttaccgtccctccgttccgtacccgttccccg

SEQ ID NO: 270190 - DNA, 809 bp, Homo sapiens
  misc_feature: GYAE6OF02JPFF4.51.27.C05.1.454.CMB.1.raw
  modified_base (355)..(355): a, c, t, g, unknown or other
  misc_feature (355)..(355): n is a, c, g, or t
  modified_base (641)..(641): a, c, t, g, unknown or other
  misc_feature (641)..(641): n is a, c, g, or t
tcagcgatcgtatacacgaccggtgctcgatttagacgcgatcgaaggtttggggggggggtctcaggaggcagcgctctcgggacgtctccaccatggcctgggctctgctattcctcaccctcctcactcagggcacgagggtcctcgggcccagtcctgccctgactcacgcctgccttccgtgtcgtgggtcctcctaggacagtcgatccacattcctcctgacactacggaaccagcaggtcgtacggttggtacggttaataattgtcgtcttccgtacggaacctaaccaccctaacccacggtaaccaaaccctaccccaaaacttccgaattacgtaatttacgngtaacgtcgtactacggtcgtaacgtccgcccgttacggttacgggttacgtacgttaccggtcctttccgccggttacgacccgttaacggtacccggttaccgggacccgtaaaccgcccgggtcccttaccgtaccgtaaccgtacgtttacccgtcggttaccggtacccgtacggtaaccgggtaccgggaaggtaccgcggtaccgttaagttacgtttaacgtccgttggtaacccctacgttacctaaattacccgtaaaggccgaagaaccgttaanaaaaccggtttggggtaccggggtttaccggggtacggaaaccggggtacgtaaccgtaacgggttccgaccggttaccgggtacccttgggtaaccggtaacccgcccggtaacggttccccgtcccggtacccgtacggttcccacttcccggttacccctccccg

SEQ ID NO: 270191 - DNA, 662 bp, Homo sapiens
  misc_feature: GYAE6OF02ICUMJ.51.27.C05.1.454.CMB.1.raw
  modified_base (251)..(251): a, c, t, g, unknown or other
  misc_feature (251)..(251): n is a, c, g, or t
  modified_base (305)..(305): a, c, t, g, unknown or other
  misc_feature (305)..(305): n is a, c, g, or t
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaccagcagtgacgttggtgttataattntgtctctggtaccaacaccaccaggcaaacgcccccaaatccatcgtattttangatgtcagtgactccggccctggtacgggtttacagttcgcttctcgtggcctccgaagtcccggacaaccgacggtccctcccgtcgacctacttctccgtcgggccttaccgacgggtacccggaagggtaccggaacgggtcttaggtaacgttttaacttaccggttcgtccctaacccgtactaactaactaacaacggtaccaacggtacctaaaccgtaaggtttcggggttacgggttcgggacgggtaacgggaaccgacgtccgtacgtacccggtcgtaacggtccgaaccgtacccggaagtcccgacccgtaccccgtaccggtcctacccgtccgttcccccg

SEQ ID NO: 270192 - DNA, 1050 bp, Homo sapiens
  misc_feature: GYAE6OF02GUFD0.51.27.C05.1.454.CMB.1.raw
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctcgccctgactcagcctgcctcgtgtctgggtctccgtggacagtcgatccactatcctctgccacgtaggaaccagcagtcgacgttggtaggttaataatttgtcgttaccttccgtacggtaacctaaccgaacccacccgtaaggtacccaaaaccggaccccccctaaaactccgtaacgttacggttaactttttacgtacggttaacgttcggttacctaaggggttacgtaaccggtttccccggggtaccccgttacggggtttaaacggggggtttttacccgaaaaccgtttcccggttaccgttttcccggttaccggtttaccggggtaacccgtttaaccccggtaaacgggttcccccgggttaaacccgaaaacccggttaccccggggttaccccttaccccggttaaccgtaaacccgttacccgtttcccggttaccgggttccggggtaccccgttaaccccgggacggggaaccccggggtaacgggtaaaccgggttaccgggtaacctttaacggggttaacttttaaccggttaccgacccggtttacccgtaacccgtttaaaccggtaaacgtttaaccgtaaaccggtaaacgtacccggtaaacgtaaccggttaaaacggtttaaacggggtttccgggggtttaccggttaacccggggggaacggggtaaacccgggtaaacgtaacccgggtttaccgggtttacccgggaaacccggtttcccgggtttaaaccggggtaacctaaccccggggtaaacccggtaaccgggttccccggtacccccggtttacccccggggttacgttaacccccggtttacccggtttacccggtttaccccccgttttaccccccggg

SEQ ID NO: 270193 - DNA, 844 bp, Homo sapiens
  misc_feature: GYAE6OF02HHKGH.51.27.C05.1.454.CMB.1.raw
tcagcgatcgtatacacgaccggtgctcgatttagacgcgatcgaagggtttggggggggggtctcaggaggcagcgctctcgggacgtctccaccatggcctgggctctgctattcctccaccctcctcactcaggcacgagggtcctgggcccagtctgccctgactcagcctcgcctccgtgtcgtcgggtcctccgtggacagtcgatcaccattcctcctgctacgtacggaaccagctaggttacggtacggttttggggttacggtttaaattaagttttagttcgttccttacccgttacggtaaacccctaaacccaaccccgaacccgtaacgggaaccccaaaacccggaaccccccctaaaacgttcctaagttacgttaactttacgtagtacgttcgtacgtaggtacggtaccgtccggtaccgttacgggttacgggtttacgtaacgttccggtttcttccgtcgtacgtacccttaaccgtaccggtccgaaccaacccgccggtacccctacccgtacgaacccgtcttcccgtcggttaccggccgtaccgaccggggtacggaccgggaacgcggttactagttaacgtttacgtccgtcgaacctacctataactaacaacacggaactacgtaacgtaacggtacggtttcgggggttacgttccggggaaaccggggtcggtaaaccgtaacggtccgtaaccgggttaacccggttacccggtaagggtaaccccgacccggtaacccgtacggttcccgtccccggtacccgttaccggtaccccgttaaccttaccccggttaccccggttaccccc

SEQ ID NO: 270194 - DNA, 640 bp, Homo sapiens
  misc_feature: GYAE6OF02JENOT.51.27.C05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
tcagcgatcgtatacacgaccggtgctcgatttagacgcgatcgaagggtttgggggggggtctcaggaggcagcgctctcgggacgtctccaccatggcctgggctctgctattcctcaccctcctcactcagggcacgagggtcctgggcccagtctcgccctgactcagcctgcctcgtgtcgtgggtctccgtggacngtcgatcacntctcctgcacgtcggaaccagcagtgtacggttggtagttataattatcgtctcgtacgaccaacaccaccagaccaaacgaccccaanctatagtattangntgctagtgactccggcctcggtaggttcgatcgtcttcgngtcgcctacacggtccggaacaaccggtacgtccctccgtacacctactccgtcggtcgccgtacgacggacggaggtacgagtacgtagttacttagcgtacgactactagtaaactacgaacgcctaacgaacgtaacgttaaagttcggggttacgggtacgtaccgggggaacgtacggtaacgcgtaccgtaccggtacgtaccggtaacggtaccgtacgacccgtacggacccttcccggccggttacctacccgtcttcccgttaccccgtaccccg

SEQ ID NO: 270195 - DNA, 721 bp, Homo sapiens
  misc_feature: GYAE6OF02IB4SP.51.27.C05.1.454.CMB.1.raw
  modified_base (235)..(235): a, c, t, g, unknown or other
  misc_feature (235)..(235): n is a, c, g, or t
  modified_base (573)..(573): a, c, t, g, unknown or other
  misc_feature (573)..(573): n is a, c, g, or t
  modified_base (678)..(678): a, c, t, g, unknown or other
  misc_feature (678)..(678): n is a, c, g, or t
tcagcgatcgtatacacgaccggtgctcgatttagacgcgatcgaagggtttggggggggggtctcaggaggcagcgctctcgggacgtctccaccatggcctgggctctgctatttcctcaccctcctcactcagggcacgagggtcctgggcccagtctgccctgactcagcctgcctccgtgtctgggtcctcgtgacagtcatcaccatcctcctgacacgtacggaaccngcaggtaggtacggttggttagttaaattaattagtcgttctccgtacgtaaccaaccacccgaccgaggaaccaaaccgacccccgaaactacagtagtactttaagtacgtacgtacggtacgtagtacgacgtaccgtacccgtaggttacgggtttaccgagttcgttaccttcgtacgtccggtaccgtacgtaacggccgtaaccaaccgaccggtccctacccgacgacctcgtacgtcggtcggtcgtaccgacgggaccgaacggacggtaagtccgtaagttaacttacgttacgaacctacgtaccttagtaagttaacaccgaaancgaacgaaactaacgtaacgggtttggtccgggttaccgggagggtaacgaacgttaacggcgttaccgaacgttcccgaaggtaccacggacccgtaaggtccncccggttaccgaccgtaccctcctttaccgccccttaaccccg

SEQ ID NO: 270196 - DNA, 708 bp, Homo sapiens
  misc_feature: GYAE6OF02HABVB.51.27.C05.1.454.CMB.1.raw
  modified_base (240)..(240): a, c, t, g, unknown or other
  misc_feature (240)..(240): n is a, c, g, or t
  modified_base (320)..(320): a, c, t, g, unknown or other
  misc_feature (320)..(320): n is a, c, g, or t
  modified_base (496)..(496): a, c, t, g, unknown or other
  misc_feature (496)..(496): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
tcagcgatcgtatacacgaccggtgctcgatttagacgcgatcgaagggtttgggggggggtctcaggaggcagcgctctcgggactctccaacatggcctgggctctgctattcctcaccctctcactcagggcacagggtcctgggcccagtctgccctgactcgagcctgcctccggtgtcgttgggtctaccgttggacacgtcgaatccacctatcctccgtgcacgtcggaccngacgagtcggacggttgggttagttacttaattacgcgttacctccgtacgtaacccaaccaccaccaggaccaaacccnccccaatctaatgtactttaaggtactgtacgtagtacggacgtccgtacccgtacgggttacgggtttacggtaacgttccgttacgtttccgtacgtcgtaccttacgaaccggtacgacaccgtaccgtcctaccgtacgactacgtctacgtcgctaccggcgacgaggcgngtacctaggtctactccgtgaccctactactaacgtactaccgtanaacncgtaactaacgttacgggttcggtaccggttacggaaccggggtacgaacgtacgtcgggtaccgttaaccgtcggtacctaacgaccccggtaacgtaccgggtacccttccccgggtccccgtaggttaaccccttcgttaccccgtacccgttcccccg

SEQ ID NO: 270197 - DNA, 937 bp, Homo sapiens
  misc_feature: GYAE6OF02F9I4X.51.27.C05.1.454.CMB.1.raw
tcagcgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctagactcagcctgcctccgtgtcgtgggtcctccgtggactagtcgatccaaccctattcctcctggcctacgtacgggaaccaggcctaacgggtcgtaacggtttgggtagggtttaattaaacgtttagttgttccttccgttacgggtaacccaacctaccccgacccgacggtaccaaaaccggacccccctaaaacgtcctacgtaggtaacttttaggtacgtaattcggtaccgtaggttacgtaaccgttcccgggtaccccgttcgggtttaaccggggggttttacccgtaaaggttttccggacccctttttcggtaccgttccggggttacccttaacccggttaacccggggtttaccccgggacccttaaaacccggggtaccccggggttcccctttacccccggttaacgggtaaacccctaaaccgggttttccttaaccgggttaccggggtaccgtttaccccgggaaccggggtaccccgggaaaccggggtaaaccgggtaacggggccctttaggttaaccgttacgtttaaaccgtccggtacccttacggtacctaaacgtttacgttaaccgaaacgacgaacgggtaacccagttaaaccgggtttggggttacgttaacccggggtacggtaacgggacccgtaggtccggtaccggtacccgttcggaaccgtagtacccggtaccgaacggttcccgtaaccccggttcccgtccgggttaaccctacccgttacgttacccccg

SEQ ID NO: 270198 - DNA, 665 bp, Homo sapiens
  misc_feature: GYAE6OF02I1L8U.51.27.C05.1.454.CMB.1.raw
tcagcgatcgtatacacgaccggtgctcgatttagacgcgatcgaaggtttgggggggggtctcaggaggcagcgctctcgggacgtcctccaccatggcctgggctctgctattcctcacccctcctcactcagggcacgagggtcctgggcccagtctgccctgactcagcctgcctccgtgtctgggtcctccgtggcagtcgatcaccatcctcctgcctactggaaccctagccagtgacggtttggtacgtttaatattatccgtcttcctcggtaaccaacctacccaccgaggtaccaaaccgaccccctaaactccgatagtattactgtatgtctagtcgacgtccgccgtcgagggtttccaagtcgtcttctcgtgtactccgacggtccgacaccgtaccggcccctacctcgaccctacgttccgtacgtccgggacctcccggaggtacccggaggaccggtacgtactgtagtttactaacgtcgtacctacctacctaataacgtaccacgagaccgacgtaactaggttacggtggttccgggacgtaaccggtacgacgtcgtcgtacccgtccgtcgtaccgcgtaccgaaccggtcccgtaccggtccccggtccgttcgtacccgtaccttcccgtaaccccg

SEQ ID NO: 270199 - DNA, 600 bp, Homo sapiens
  misc_feature: GYAE6OF02JPJNH.51.27.C05.1.454.CMB.1.raw
  modified_base (184)..(184): a, c, t, g, unknown or other
  misc_feature (184)..(184): n is a, c, g, or t
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (400)..(400): a, c, t, g, unknown or other
  misc_feature (400)..(400): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
tcagcgatcgtatacacgaccggtgctcgatttagacgcgatcgaagggtttgggggggggtctcgaggaggcagcgctctcgggacgtctccaccatggcctgggctctgctattcctcaccctcctcacgtcacgggcacagggtcctgggcccagtctgccctgactcagcctgcctcgtntctggtcctctggacagtcgatcgacntcctctgcactggaaccngcagtgacgttggngtaatatntcgtctctggtaccaacaccactaggacaaccgacccccaatcagtataagtttactagttagtcctaggtacgtactcggacctcgtacggtttgactcgtctctcgtgacctctaacgccgcaacgccgacctcctacgactacctntcgtggcctcgacgcggtacgacgcgtactagtatacgttcnctctacgtactaagtcttaagacngtacgacaacgttacgtggtaccggtgggacgtacggaacgtacgtagccttaacggcttacggtaacgtaccggacgtaccgtacggtaccgtccccggacgttaccgccgttccgtccgttcccgttacccg

SEQ ID NO: 270200 - DNA, 808 bp, Homo sapiens
  misc_feature: GYAE6OF02G20YP.51.27.C05.1.454.CMB.1.raw
  modified_base (321)..(321): a, c, t, g, unknown or other
  misc_feature (321)..(321): n is a, c, g, or t
tcagcgatcgtatacacgaccggtgctcgatttagacgcgatcgaaggtttgggggggggtctcaggaggcagcgctctcgggacgtctccaccatggcctgggctctgctattcctcaccctcctcactcaggcacagggtcctgggcccagtctgccctgactcagcctgcctccgtgtctgggtctccgtggacagtcgatccacctatcctcctgccacgtggaaccagctagtgtacgttggtagttaataattatgtctctggtaccaacacctaccaggacaaacgcccccaaatcaatgtattatgtatcgtnagtgaacgtccggtaccctcggtaggggtttacgaaacttccgtccttctaccgttcggtcccttaccgaacggtcccggtaaccaaaccgtaccggtaccccgttcccgtacgtaaccctacgtccgtaccggttcgggtacctaccggtaaccgggacccgggaacgggtaaccgggtacggttacgtaacgggtaaatttaaaccgttaccggtaacgtacccgtaaaccttaccggttaaaactaaccggttaaacgaaaccgtaccggaaagtaacccgtaaaccgttaacgggttttaggggttacccggttaccggggtaacccggggtaaccgtaaacccgaaggttcccggtacgtaacccggttacccggtaaacggttaccgaaacccgtaccccggaaacggttccccgtacccggttacccccggttacccggttaccctacccggttacccggttacccccgttaaccccccg

SEQ ID NO: 270201 - DNA, 865 bp, Homo sapiens
  misc_feature: GYAE6OF02FKQSK.51.27.C05.1.454.CMB.1.raw
  modified_base (231)..(231): a, c, t, g, unknown or other
  misc_feature (231)..(231): n is a, c, g, or t
tcagcgatcgtatacacgaccggtgctcgatttagacgcgatcgaaggtttggggggggggtctcaggaggcagcgctctcgggacgtctccaccatggcctgggctctgctattcctcaccctcctcactcaggcacgagggtcctgggcccagtcctgccctgactcagcctgcctcgtgtctggtcctcgtggactgtcgactcactatctcctgctacgtcgaaccngcagtgtacggttgtggttaatattagtcgtctccgtcggtaccaaaccgtaccaacccgaagaccgaaacccgtacccccgaaactctaacgtacgttatttagtgtacgttacgtacgaaggtcggaccttcccgggtaccccttgggttaacggggtttaccgaacgttacccggttccttaccggttccggttcgtaccccttacggtaacccggttccggaaacccgtaaccggtacccggtacccctttacccgtaccggaaacccgttacgttacccgttacggttcccggggaccctaccggtaaccggggaaccgggtaacggacccgggtaagggttccgttaaacggttacgttttaacgtttacccggcgtaacccgttacccttaacgtaaacctttaacgtaaacgtaaccgtaaccgaaacgttaaccgttaaaccgggttaagggtttccgggttaccgggttaacggggaacggggtaaccgacgttaaaccgtcccggttaacggtaccccgttaccgggtacggaacccgtacccggaacgggtaaccggttcccggtacccgttccccggtaaccggttaccctaccggtttcccctaccccggtttacccccg

SEQ ID NO: 270202 - DNA, 833 bp, Homo sapiens
  misc_feature: GYAE6OF02GXZNX.51.27.C05.1.454.CMB.1.raw
  modified_base (147)..(147): a, c, t, g, unknown or other
  misc_feature (147)..(147): n is a, c, g, or t
  modified_base (670)..(670): a, c, t, g, unknown or other
  misc_feature (670)..(670): n is a, c, g, or t
tcagcgatcgtatacacgaccggtgctcgatttagacgcgatcgaagggtttgggggggggtctcaggaggcagcgctctcgggacgtctccacatggcctgggctctgctagttcctcaccctctcacgtcaggcacgagggtccngggcccagtctgccctggactcgagcctgccttcggtcgtcgtgggtcctcgtggactagtcgactcaacctgtcctccgtggacctacgtacgggaaccctgactaggttcgtacggtttgggttacgttaattaaagtttcgtcgttccgtaccgttacggtaaaccccaaacctaccccgaacccgtaacggaaccaaaacccggtacccccctaaaatccgaacttacgggttaacttttacgaggttacgtacggttaccggaaggttcgtaaccggttccggttacccgttacgggttaacggggtttaccgtaacgtcccggtttaccttaccggtcgttaccggtacccttaccggtaccggttaccgaccgtaaacggtcccggtacccttccgtacacccgttactaccgtcggtaccggtccgtaccgcgggtaaccggtacggacggacggtcgtaacttacgtttaacgtaacgtcgaacccttaacgtattaaccgtataaccggaacnccgaaacgtaccgaagttaaacgttcgggtacgttaacggggacggtacggtaaccgtagtcccgttacggaccgttacggaccggtacgaaccggcccgtaaccggtccgtaaccccggtcccttaacggtccttaacccgttccgttaccccgttaacccg

SEQ ID NO: 270203 - DNA, 676 bp, Homo sapiens
  misc_feature: GYAE6OF02IDMAT.51.27.C05.1.454.CMB.1.raw
  modified_base (243)..(243): a, c, t, g, unknown or other
  misc_feature (243)..(243): n is a, c, g, or t
  modified_base (393)..(393): a, c, t, g, unknown or other
  misc_feature (393)..(393): n is a, c, g, or t
  modified_base (505)..(505): a, c, t, g, unknown or other
  misc_feature (505)..(505): n is a, c, g, or t
tcagcgatcgtatacacgaccggtgctcgatttagacgcgatcgaagggtttgggggggggtctcaggaggcagcgctctcgggacgtctccaccatggcctgggctctgacttattcctcaccctcctcactcgagggcacgagggtcctgggcccagttctcgccctgactcgagcctgccctccgtgtctaggtctccgtgacagtcgatacacatctcgtcgacgtacgtaggaaccgngcgagtggtaacgttggtacgttaataatgtcgtctacgtacggtaacaactaccacgtacggaacaaacccgtaccctaatcgaacgttagtaatttactacgtacgtcgtacgtaagtcgtacgtccggtaccgtacgtacgggttanaactcgtacttcgtacgtcgtctacgacgtcgacacgaccgtcctcgacgtaccgtatcgtcgtcgacctacggacggaccgaacggacggacgtagtactagttacgtacncgtacctacgtataactacgtaacgaacgtcgaagaaccgtaagtacgggttcggttacggacgggcggtaaacgggcaacggtcgttacggaccttacgggtgaacccgacggcccgttaacgccgttacccgtcccgtacggtcttaccgttaccgtcccgttaccccg

SEQ ID NO: 270204 - DNA, 252 bp, Homo sapiens
  misc_feature: GYAE6OF01DP7PH.34.57.F02.1.454.CMB.1.raw
tcagtacacgtgatcacgaccggtgctcgatttagctcgatatagttggatctgggacagaattcactctcacaatcagcagtccgcggcctgaggactctgcggcttattactgtcaacagcttagtcggttaccccccaccttcggccaagggacacgactggagattaaacgaactgtggctgcaccatctgtcttcatcttcccgccatctgaatcacgtgtactgagcgggctggcaaggcgcatag

SEQ ID NO: 270205 - DNA, 252 bp, Homo sapiens
  misc_feature: GYAE6OF01BIQ04.34.57.F02.1.454.CMB.1.raw
  modified_base (251)..(252): a, c, t, g, unknown or other
  misc_feature (251)..(252): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtggttacccccaccttcggccaagggacacgactggagattaaacgaactgtggctgcaccatctgtcttcatcttcccgccatctgaatcacgtgtactgagcgggctggcaaggcgcatagnn

SEQ ID NO: 270206 - DNA, 255 bp, Homo sapiens
  misc_feature: GYAE6OF01EEXZN.34.57.F02.1.454.CMB.1.raw
  modified_base (251)..(255): a, c, t, g, unknown or other
  misc_feature (251)..(255): n is a, c, g, or t
tcagtacacgtgatcacgaccggtgctcgatttagctcgatatagttggatttgggacagaattcactctcacaatcagcagtccgcggcctgaggactctgcggcttattactgtcaacagcttagtggttaccccccacttcggccaagggacacgactggagattaaacgaactgtggctgcaccatctgtcttcatcttcccgccatctgaatcacgtgtactgagcgggctggcaaggcgcatagnnnnn

SEQ ID NO: 270207 - DNA, 257 bp, Homo sapiens
  misc_feature: GYAE6OF01A2T6O.34.57.F02.1.454.CMB.1.raw
  modified_base (251)..(257): a, c, t, g, unknown or other
  misc_feature (251)..(257): n is a, c, g, or t
tcagtacacgtgatcacgaccggtgctcgatttagctcgatatagttggatttgggacagaattcactctcacaatcagcagtccgcggcctgaggactctgcggcttattactgtcaacagcttagtggttaccccccaccttcggccaagggacacgactggagattaaacgaactgtggctgcaccatctgtcttcatcttccgccatctgaatcacgtgtactgagcgggctggcaaggcgcatagnnnnnnn

SEQ ID NO: 270208 - DNA, 254 bp, Homo sapiens
  misc_feature: GYAE6OF01BRDM7.34.57.F02.1.454.CMB.1.raw
  modified_base (252)..(254): a, c, t, g, unknown or other
  misc_feature (252)..(254): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtggttaccccccaccttcggccaagggacacgactggagattaaacgaactgtggctgcaccatctgtcttcatcttcccgccatctgaatcacgtgtactgagcgggctggcaaggcgcatagnnn

SEQ ID NO: 270209 - DNA, 250 bp, Homo sapiens
  misc_feature: GYAE6OF01CIK70.34.57.F02.1.454.CMB.1.raw
  modified_base (250)..(250): a, c, t, g, unknown or other
  misc_feature (250)..(250): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtggttaccccccacttcggccaagggacacgactggagattaaacgactgtggctgcaccatctgtcttcatcttcccgccatctgaatcacgtgtactgagcgggctggcaaggcgcatagn

SEQ ID NO: 270210 - DNA, 252 bp, Homo sapiens
  misc_feature: GYAE6OF01B3FU3.34.57.F02.1.454.CMB.1.raw
  modified_base (251)..(252): a, c, t, g, unknown or other
  misc_feature (251)..(252): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtggttaccccccaccttcggccaagggacacgactggagattaaacgaactgtggctgcaccatctgtcttcatcttcccgcatctgaatcacgtgtactgagcgggctggcaaggcgcatagnn

SEQ ID NO: 270211 - DNA, 495 bp, Homo sapiens
  misc_feature: GYAE6OF01D6W2V.34.57.F02.1.454.CMB.1.raw
  modified_base (415)..(415): a, c, t, g, unknown or other
  misc_feature (415)..(415): n is a, c, g, or t
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtgggtcccacaagattcagcggcgttggatctgggacagaattcactctcacaatcagcagtccgcggcctgagactctgcggtcttattactgtcaacngtcttagtccggttaccccccacgttcgccaagggcacgactgagataacgatgtgntgcacntctntctnactctccgc

SEQ ID NO: 270212 - DNA, 522 bp, Homo sapiens
  misc_feature: GYAE6OF01BP5M9.34.57.F02.1.454.CMB.1.raw
  modified_base (416)..(416): a, c, t, g, unknown or other
  misc_feature (416)..(416): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtgggtcccaccaagattcagcggcgttggatctgggacagaattcactctcacaatcagcagtccgcggcctgaggactctgcggcttattactgtcaacngtcttacgtcgttacccccccacgttccggccaagggaccacgactcgggagtaacttaaaccgaactggtggctgccaccatctcgtcttcacttccttcccgcc

SEQ ID NO: 270213 - DNA, 251 bp, Homo sapiens
  misc_feature: GYAE6OF01DOWJ6.34.57.F02.1.454.CMB.1.raw
  modified_base (249)..(251): a, c, t, g, unknown or other
  misc_feature (249)..(251): n is a, c, g, or t
tcagtacacgtgatcacgaccggtgctcgatttagctcgatatagttggatctgggacagaattcactctcacaatcagcagtccgcggcctgaggactctgcgcttattactgtcaacagcttagtggttaccccccacttcggccaagggacacgactggagattaaacgactgtggctgcaccatctgtcttcatcttcccgccatctgaatcacgtgtactgagcgggctggcaaggcgcatagnnn

SEQ ID NO: 270214 - DNA, 504 bp, Homo sapiens
  misc_feature: GYAE6OF01APU5N.34.57.F02.1.454.CMB.1.raw
  modified_base (416)..(416): a, c, t, g, unknown or other
  misc_feature (416)..(416): n is a, c, g, or t
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtgggtcccacaagattcagcggcgttggatctgggacagaattcactctcacaatcagcagtccgcggcctgaggactctgcggtcttattactgtcaacngccttagtcggttaccccccacgttcggccaagggcacgactgganattaaacgactgtgctgcacntctgtcttnactcctcccgac

SEQ ID NO: 270215 - DNA, 504 bp, Homo sapiens
  misc_feature: GYAE6OF01EFYM6.34.57.F02.1.454.CMB.1.raw
  modified_base (325)..(325): a, c, t, g, unknown or other
  misc_feature (325)..(325): n is a, c, g, or t
  modified_base (383)..(383): a, c, t, g, unknown or other
  misc_feature (383)..(383): n is a, c, g, or t
  modified_base (464)..(464): a, c, t, g, unknown or other
  misc_feature (464)..(464): n is a, c, g, or t
  modified_base (480)..(480): a, c, t, g, unknown or other
  misc_feature (480)..(480): n is a, c, g, or t
  modified_base (495)..(495): a, c, t, g, unknown or other
  misc_feature (495)..(495): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtggggtcccnccaagattcagcggcgttggatctgggacagaattcactctcacaatcagcagtccgnggcctgaggactctgcggcttatactgtcaacagcttagtcggttaacccccccactttccggccaagggcacgactgganattaaacgactgtcgntgcacatctgtcttnatctcccgc

SEQ ID NO: 270216 - DNA, 631 bp, Homo sapiens
  misc_feature: GYAE6OF01BYLSE.34.57.F02.1.454.CMB.1.raw
tcagtacacgtgatcacgaccggtgctcgatttagctcgatatagttgggtttggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggcatcaggacattagcaattattagcttggtatcgaaggtaaaaccaggggaccgcccctaagctcctgatcctcttccgcgtcctattttacaaagtcgggtcccacaagattcagcggcgttggatctgggacagaattcactctacacaatcagcagtcccgcggcctgaggtactcgtgcggtacttaattactgtacaaacgtgtcctttaacggtcccggtttaaccccccccacgtttacccggggacccctaaacggggaccctaaccggtaccgtacggggaaacgtaaacgtttaaaaaccggaaacgtttcgggtacgggaccttacgggacccaacccgttaagttcccgttacggttacccttttaccgaaaccttttcccgtttaaccccccggtaccc

SEQ ID NO: 270217 - DNA, 251 bp, Homo sapiens
  misc_feature: GYAE6OF01DFIZM.34.57.F02.1.454.CMB.1.raw
  modified_base (251)..(251): a, c, t, g, unknown or other
  misc_feature (251)..(251): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtcggttaccccccacttcggccaagggacacgactggagattaaacgactgtggctgcaccatctgtcttcatcttcccgccatctgaatcacgtgtactgagcgggctggcaaggcgcatagn

SEQ ID NO: 270218 - DNA, 251 bp, Homo sapiens
  misc_feature: GYAE6OF01DSJXJ.34.57.F02.1.454.CMB.1.raw
  modified_base (251)..(251): a, c, t, g, unknown or other
  misc_feature (251)..(251): n is a, c, g, or t
tcagtacacgtgatcacgaccggtgctcgatttagctcgatatagttgtatctgggacagaattcactctcacaatcagcagtccgcggcctgaggactctgcggcttattactgtcaacagcttagtcggttaccccccacttcggccaagggacacgactggagattaaacgaactgtggctgcaccatctgtcttcatcttcccgcatctgaatcacgtgtactgagcgggctggcaaggcgcatagn

SEQ ID NO: 270219 - DNA, 503 bp, Homo sapiens
  misc_feature: GYAE6OF01DRVY6.34.57.F02.1.454.CMB.1.raw
  modified_base (275)..(275): a, c, t, g, unknown or other
  misc_feature (275)..(275): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattatttagcttggtatcaaggtaaaaccaggggacncccctaagctcctgatctcttccgcgtccattttacaaagtgggtcccacagattcagcggcgttggatctgggacagaatcactctcacaatcagcagtccgcggcctgacgactctgcggtcttatactgtcaacagccttagtcgttaccccccacgtttcgccaagggacacgactggagtataaacgactgtggctgcaccatctgtcttcatccttccgacc

SEQ ID NO: 270220 - DNA, 512 bp, Homo sapiens
  misc_feature: GYAE6OF01DF007.34.57.F02.1.454.CMB.1.raw
  modified_base (414)..(414): a, c, t, g, unknown or other
  misc_feature (414)..(414): n is a, c, g, or t
  modified_base (484)..(484): a, c, t, g, unknown or other
  misc_feature (484)..(484): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattattagcttggtatcaggtaaaaccagggacgcccctaagctcctgatctcttccgcgtccattttacaaagtgggtcccaccaagattcagcggcgttggatctgggacagaattcactctcacaatcagcagtccgcggcctgaggactctgcggctttattactgtcaacngctttagtcggttacccccccactttccggccaagggcacggactgggaataattaaacgactggtcggntgcacatctgtacttcatcttcccgacc

SEQ ID NO: 270221 - DNA, 583 bp, Homo sapiens
  misc_feature: GYAE6OF01DCUG8.34.57.F02.1.454.CMB.1.raw
  modified_base (102)..(102): a, c, t, g, unknown or other
  misc_feature (102)..(102): n is a, c, g, or t
  modified_base (281)..(281): a, c, t, g, unknown or other
  misc_feature (281)..(281): n is a, c, g, or t
  modified_base (337)..(337): a, c, t, g, unknown or other
  misc_feature (337)..(337): n is a, c, g, or t
tcagtacacgtgatcacgaccggtgctcgatttagctcgatatagttgggtttgggggagtcagtcccagtcaggacacagcatggacatgagggtccccgntcagctcctgggctcctgctgctctggctcccaggtgccagatgtgacatccagatcgacccagtctccatccttcctgtctgcatccataggagacagagtcaccatccacttcggccgggccatccgaggacattagctaattatttagcttggtatcaaggtaaaaccaggggacncccctaagctcctgactctcttccgcgtcctattttacaagtcgggtcccaacaanattcagcggtcgttgagtcgtaggacagtaattcactctcaacaatcagcagtcccgcggtcctggacggactcgtgccggtctttattactgttacaacgatcctttacggtcccgttaaccccccctacgttaccggaccgtaacgggaccaccggacgtaaggaagacgttaaaacgaacctcggtacggtactacggccaccgtattccgtcgtttaccttctacttcccgtttccccgacc

SEQ ID NO: 270222 - DNA, 521 bp, Homo sapiens
  misc_feature: GYAE6OF01D4RG0.34.57.F02.1.454.CMB.1.raw
  modified_base (398)..(398): a, c, t, g, unknown or other
  misc_feature (398)..(398): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaaggtaaaaccaggggacgcccctaagctcctgatcctctccgcgtccattttacgaaagtcgggtacccaccaagacttcagcggcgttggatcgtgggacagaattcactctcacatcagcagtccgcggctgagctcngcgtcttatactgtcaactagtcttacgtccgttacccccccacgttccggaccaaggggaccacgacgtggagattaaacgatggtcggctgcaccatctcgtcttacacttcctcccgacc

SEQ ID NO: 270223 - DNA, 254 bp, Homo sapiens
  misc_feature: GYAE6OF01BG7G0.34.57.F02.1.454.CMB.1.raw
  modified_base (252)..(254): a, c, t, g, unknown or other
  misc_feature (252)..(254): n is a, c, g, or t
tcagtacacgtgatcacgaccggtgctcgatttagctcgatatagttgggtttgggacagaattcactctcacaatcagcagtccgcggcctgaggactctgcggcttattactgtcaacagcttagtggttaccccccaccttcggccaagggacacgactggagattaaacgaactgtggctgcaccatctgtcttcatcttcccgccatctgaatcacgtgtactgagcgggctggcaaggcgcatagnnn

SEQ ID NO: 270224 - DNA, 573 bp, Homo sapiens
  misc_feature: GYAE6OF01CKDMD.34.57.F02.1.454.CMB.1.raw
  modified_base (377)..(377): a, c, t, g, unknown or other
  misc_feature (377)..(377): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggcatcaggacattagcaattattagcttggtatacgaggtaaaaccacgggggtaccgcccctaaagcctcctgactctcttccgcgttcctattttaccaaaggtcgggtacccacgaagattcagcggcgttaggatctggacagattcacttcncacaatcagtcagtccgcggctgagactcgtgcggtcttattactgtaccaacgtagtcctttaacggttcccgttaaccccccctacgtttacccgggcccgtaaacgggaccacgacgtacggaagtaacttaaaaccggaactggtacggctacggccaccgtatcgtcgttcttacacttccttcccgtacc

SEQ ID NO: 270225 - DNA, 530 bp, Homo sapiens
  misc_feature: GYAE6OF01B0DLP.34.57.F02.1.454.CMB.1.raw
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggcatcaggacattagctaatttatttagcttaggtatacgaaggtaaaaccgaggggaaccgcccctaagctcctgactctcttccgcgtcctatttacaaagtcgggtaccacaagattcagcgcgttggatcgtaggacagaattcactctacacatcagcagtccgcggcctgacgactcgtggtccgtctttagtactgtacaactagtaccttacggtccgttaccccccacgttccggaccaagggcacggagtggaactaacttaaacgactgtcgntgcactntctgtctnactcctccgtac

SEQ ID NO: 270226 - DNA, 254 bp, Homo sapiens; identical to SEQ ID NO: 270208
  misc_feature: GYAE6OF01BD1PP.34.57.F02.1.454.CMB.1.raw
  modified_base (252)..(254): a, c, t, g, unknown or other
  misc_feature (252)..(254): n is a, c, g, or t

SEQ ID NO: 270227 - DNA, 271 bp, Homo sapiens
  misc_feature: GYAE6OF01BDOTC.34.57.F02.1.454.CMB.1.raw
  modified_base (247)..(247): a, c, t, g, unknown or other
  misc_feature (247)..(247): n is a, c, g, or t
  modified_base (252)..(271): a, c, t, g, unknown or other
  misc_feature (252)..(271): n is a, c, g, or t
tcagtacacgtgatcacgaccggtgctcgatttagctcgatatagttggatttgggacaggaatttcactctcacaatcagcagtccgcggcctagaaggactctgcggcttattactgtcaacagcttagtcggttacccccccacttcggccaagggcacgactggagattaaacgactgtggctgcaccatctgtcttcatccttcccgcatctgaatcacgtgtactgagcggctggcaggcnatagnnnnnnnnnnnnnnnnnnnn

SEQ ID NO: 270228 - DNA, 560 bp, Homo sapiens
  misc_feature: GYAE6OF01CZPGP.34.57.F02.1.454.CMB.1.raw
  modified_base (422)..(422): a, c, t, g, unknown or other
  misc_feature (422)..(422): n is a, c, g, or t
  modified_base (443)..(443): a, c, t, g, unknown or other
  misc_feature (443)..(443): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatcccttcctgtctgcatccataggagacagagtccaccatccacttcggccgggccgatcaggacattagcaatttatttagtcttggtatacgaaggtaaaaccgagggggaccgacccctaagcctcctagatctcctccgtcgttcctattttaacgaaagtcgggtacccaaccaagacttcgagcggcgttggatcgtggacagtaattcactctacacatcagcacgtccgcgctgagactcgngcgtcttattactgtacaacngtcgttacgtcccgttacccccacgttccggaccaacgggacacggacgtaggagtaacgttaaacgacgtggtcggctacgccaccagttcctagttcttctacttccgttcccgc

SEQ ID NO: 270229 - DNA, 519 bp, Homo sapiens
  misc_feature: GYAE6OF01DUAIT.34.57.F02.1.454.CMB.1.raw
  modified_base (273)..(273): a, c, t, g, unknown or other
  misc_feature (273)..(273): n is a, c, g, or t
  modified_base (399)..(399): a, c, t, g, unknown or other
  misc_feature (399)..(399): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (507)..(507): a, c, t, g, unknown or other
  misc_feature (507)..(507): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggccgatcaggacattagcaattattagcttggtatcaaggtaaaccaggggacnccctaagctctgatctctcgctctatttacaagtcgggtacccacgaagacttcgagcggtcgttgacgtcgtggaacagtaacttcacttctacacatcagcacgtccggcgctgacgtactcgngcgtcttaatctgtacactgtacttacggtcccgtacccctacgtcgaaccgtaaggacacgactggaactaactaaacgatcggagtntcgcactntctcgtctacnctccgtccgtac

SEQ ID NO: 270230 - DNA, 544 bp, Homo sapiens
  misc_feature: GYAE6OF01B5DQ8.34.57.F02.1.454.CMB.1.raw
  modified_base (274)..(274): a, c, t, g, unknown or other
  misc_feature (274)..(274): n is a, c, g, or t
  modified_base (413)..(413): a, c, t, g, unknown or other
  misc_feature (413)..(413): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggcatcaggacattagcaattatttagcttggtatcaggacaaaaccaggggacncccctaagctcctgatctcttccgcgtccattttacaaagtcgggtacccacaagattcagcggcgttggatcgtggacagaattcactctcacatcagcagtccgcggcctgacgactctgcgtcttatactgtcaancgtcttacgtccgttacccccccacgttccggaccctaagggaccacgtacgtggaacgtaataaacgaacgttggtaggaccttggacctaacccgacttcctacgttcctttacacttcccttaccccg

SEQ ID NO: 270231 - DNA, 537 bp, Homo sapiens
  misc_feature: GYAE6OF01CL36O.34.57.F02.1.454.CMB.1.raw
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattattagcttggtatcaggtaaaaccaggggacgcccctaagctcctgatctcttccgcgtcctattttacaaagtcgggtcccacaagattcagcggcgttggatcgtggacagaattcactctcacatcagcacgtccgcgcctgaggactcgtgcggtctttattactgtacaactagcctttacgtcccggttaacccccccacgtttaccggaccgaacgggacacggactagggacgattaaaacgattgtcggctagccaccatcctnttccttacnctccttcccgacc

SEQ ID NO: 270232 - DNA, 506 bp, Homo sapiens
  misc_feature: GYAE6OF01BO31V.34.57.F02.1.454.CMB.1.raw
  modified_base (110)..(110): a, c, t, g, unknown or other
  misc_feature (110)..(110): n is a, c, g, or t
  modified_base (178)..(178): a, c, t, g, unknown or other
  misc_feature (178)..(178): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (420)..(420): a, c, t, g, unknown or other
  misc_feature (420)..(420): n is a, c, g, or t
  modified_base (438)..(438): a, c, t, g, unknown or other
  misc_feature (438)..(438): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
tcagtacacgtgatcacgaccggtgctcgatttagctcgatatagttgggtttggggggagtcgagtcccagttctagggacacagtcatggacgatggagggtccccgntccagctcctggggctcctgctgctctggctcccaggtgccagatgtgacatccagatgacccagtcnccatccttcctgtctgcatccagtaggagacagagtcacatcacgttggccgggcatcgaggacattagcaattagttagcttggtatacaggtaaaccaggggaccgccctagctccgtgactctccttccgcgtctattttacaagtcgggtacccacaagacttcagcggcgtggatcgtggacagaattcactctacacancagcagtccgngcngagactngcgnttatctgcacgngcttagtccgttaccccncttccgacaggacacgactggagactaaacgatgtcgntgcaccntctntctacattccgtcccgtac

SEQ ID NO: 270233 - DNA, 549 bp, Homo sapiens
  misc_feature: GYAE6OF01A8IHF.34.57.F02.1.454.CMB.1.raw
  modified_base (421)..(421): a, c, t, g, unknown or other
  misc_feature (421)..(421): n is a, c, g, or t
  modified_base (517)..(517): a, c, t, g, unknown or other
  misc_feature (517)..(517): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattatttagcttggtatcaggtaaaaccaggggacgcccctaagctcctgatctcttccgcgtctatttacaaagtcgggtcccacaagattcagcggcgttggatcgtgggacagtaattcactctcacaatcagcacgtccgcggcctgacggactcgtgcggtctttatactgtacaacngtacctttacgtccgttaacccccccacgttacggcccaaagggaccacggactaggaagtagttaaaaccgacttcggtcggtctcggccaaccnttcgtcgttacttcaacttccgttcccgtacc

SEQ ID NO: 270234 - DNA, 567 bp, Homo sapiens
  misc_feature: GYAE6OF01BSP3I.34.57.F02.1.454.CMB.1.raw
  modified_base (342)..(342): a, c, t, g, unknown or other
  misc_feature (342)..(342): n is a, c, g, or t
  modified_base (545)..(545): a, c, t, g, unknown or other
  misc_feature (545)..(545): n is a, c, g, or t
  modified_base (556)..(556): a, c, t, g, unknown or other
  misc_feature (556)..(556): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttggccgggcgatcaggacattagctaattatttagcttggtatacaggacaaaaccgacggggacaccctaagctcctgactctcttaccgcgtcctaatttacaaacgttcgggtacccaacgtaanacgttacgacggtcggtcgttggactcgtagggactacgaattcactctactacaactcacgacaggtacccgcggtactggacggtactcgtcgcgtcttagtactgtacactagtcgttacgtaccgttaccccctacgttaccggaccgtaagggaccacggacgtaggataacgttaaacgacgtcgtagctcgctacntctcgtcttcnttcccgtaccg

SEQ ID NO: 270235 - DNA, 492 bp, Homo sapiens
  misc_feature: GYAE6OF01A9UUQ.34.57.F02.1.454.CMB.1.raw
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
  modified_base (482)..(483): a, c, t, g, unknown or other
  misc_feature (482)..(483): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattatttagcttggtatcaggtaaaaccaggggacgcccctaagctcctgatctcttccgcgtccattttacaaagtgggtcccacaagatcagcggcgttggatctggacagaattcactctacacatcagcagtccgcggctgagactctgcggnttatactgtacaantcttacgtcgtacccccctacgttcgccaagggacacgactggatataaacgactgngntgcacatctncttnntcctccgac

SEQ ID NO: 270236 - DNA, 544 bp, Homo sapiens
  misc_feature: GYAE6OF01CA27L.34.57.F02.1.454.CMB.1.raw
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggcatcaggacattagcaattatttagcttggtatcaaggtaaaaccaggggacgcccctaagctcctgactctcttccgcgtcattttacaagtgggtacccacaagattcagcggcgttggatcgtgggacagattcactctcacatcagcagtccgcgcctgacgactctgcgtnttatactgtcaacngtcttacggtccgttaccccccacgttcggaccaagggacacggactagggaactacgttaaacgaactggtacggacttcggaccacccgtaattccgttagttcccttactacttcccgttccccggtacc

SEQ ID NO: 270237 - DNA, 552 bp, Homo sapiens
  misc_feature: GYAE6OF01AFLYY.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggcatcaggacattagcaattattagcttggtatcaggtaaaaccaggggacgcccctaagctcctgactctctccgcgtcctattttacaagtcgggtacccacaagattcgagcggcgttgatcgtgggacagattcactctcacatcagcagtccgcggcctggacgactcgtgcggtcttatctgtacaactgtcttacgtccgttaccccccacgttccgggaccgaacgggaccacggacgtgggaactacgttaaaccgacgttcggtcggcctacggccctaccgtattaccgtcgttcttacctacttcccgttcccgtacccg

SEQ ID NO: 270238 - DNA, 636 bp, Homo sapiens
  misc_feature: GYAE6OF01CKK68.34.57.F02.1.454.CMB.1.raw
  modified_base (196)..(196): a, c, t, g, unknown or other
  misc_feature (196)..(196): n is a, c, g, or t
  modified_base (592)..(592): a, c, t, g, unknown or other
  misc_feature (592)..(592): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttctgtctgcatccatagganacagatcaccatcacttgccggcatcaggacattagctaattatttagctttaggtatacaaggtaaaaaccgaggggaccgcccctaaagcctccgtagtactccttccttcccgcgttacctaattttaacgaaaggttcggggtaccccaacgtaaagactttccaggtccggtacggtttgggactcgtaggggaacagtaaacttcaaccttctacaacaatcaagtccacgtccgcggcctgacgggtactctggcggtactttaattacgtgtaccaaacgacggttacctttaacggttacccggttaaccccccccaccgtttaccgggaccctaaaggggacccaacggtactaggggaactaaacttaaaacggactggtacggnttcgacaaccgtatccgttcgtactttcaacttcccttcccgac

SEQ ID NO: 270239 - DNA, 535 bp, Homo sapiens
  misc_feature: GYAE6OF01BCD9A.34.57.F02.1.454.CMB.1.raw
  modified_base (390)..(390): a, c, t, g, unknown or other
  misc_feature (390)..(390): n is a, c, g, or t
  modified_base (442)..(442): a, c, t, g, unknown or other
  misc_feature (442)..(442): n is a, c, g, or t
  modified_base (506)..(506): a, c, t, g, unknown or other
  misc_feature (506)..(506): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggccatcaggacattagcaattatttagcttggtatcaggtaaaaccaggggacgcccctaagctcctgactctcttccgcgtcctatttacaagtcgggtcccacaagattcagcgcgttgatctggacagattcactctcacaatcagcacgtccgcggctgacgactcnggccgtacttattactgtacaacgtcgtctttacgtcccggttaaccccccncgttccggaccgaaggccaacgacgtaggataacttaaacggactgtcggatcggccaccgtancctcgtccttacacttccctcccgtaccc

SEQ ID NO: 270240 - DNA, 531 bp, Homo sapiens
  misc_feature: GYAE6OF01CG9WO.34.57.F02.1.454.CMB.1.raw
  modified_base (507)..(507): a, c, t, g, unknown or other
  misc_feature (507)..(507): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaaggtaaaaccaggggacgcccctaagctcctgatctcttccgcgtccattttacaaagtcgggtcccacaagattcagcggcgttggatcgtgggacagtaattcactctcacaatcagcagtccgcggcctgaggactctgcggtctttatactgtacaactagtccttacgtccgttaaccccccctacgttccggaccgaacgggacacggactaggacgacttaaacgatggcgtcagccaccgntcgtgttctcacttccgtcccgac

SEQ ID NO: 270241 - DNA, 565 bp, Homo sapiens
  misc_feature: GYAE6OF01A14RQ.34.57.F02.1.454.CMB.1.raw
  modified_base (423)..(423): a, c, t, g, unknown or other
  misc_feature (423)..(423): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttggccgggcgatcgaggacattagcaattatttagcttggtatcgaaggtaaaaccaggggacgcccctaagctctgatcctctccgcgtctatttacaaagtcgggtacccacaagacttcgagcggcgttggatcgtgggactagaattcactctacacatcagcacgtccgcgcgtgagactcgtgcgtcttatctcgtacaacgngtcttacgtccgttaccccccacgttccggaccgtaagggaccacggtacgtagggaacgtaacttaaaccggaacgttggtcggactcggacctacccgtattccgttacgttccttactaccttcccgttccccgtaccg

SEQ ID NO: 270242 - DNA, 273 bp, Homo sapiens
  misc_feature: GYAE6OF01CMXBS.34.57.F02.1.454.CMB.1.raw
  modified_base (252)..(273): a, c, t, g, unknown or other
  misc_feature (252)..(273): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtcgttaccccccacttcggccaagggacacgactggagattaaacgactgtggctgcacctatctgtcttcatcttcccgcatctgaatcacgtgtactgagcgggctggcaaggcgctagtagnnnnnnnnnnnnnnnnnnnnnn

SEQ ID NO: 270243 - DNA, 589 bp, Homo sapiens
  misc_feature: GYAE6OF01CA9R2.34.57.F02.1.454.CMB.1.raw
  modified_base (420)..(420): a, c, t, g, unknown or other
  misc_feature (420)..(420): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggccgatcaggacattagcaattatttagcttggtatcaaggtaaaaccaggggacgccctaagctcctgatctctccgcgtccattttacaagtgggtacccacaagattcagcggcgttggatcgtgggacagtaattcactctcaacaatcagcagtccgcggcctgacggactcgtgcggtcttagttactgtccaanagtcttacggtccgttacccccccacgttccggaccaacgggtacacggactagggaacgtaacgtttaaaaccgaaacgttcggtacgggtacctacggacctaacccgtaattacccgttacggttaccttttacccgaacctttccccgtttcccccggtaacccc

SEQ ID NO: 270244 - DNA, 594 bp, Homo sapiens
  misc_feature: GYAE6OF01CODU9.34.57.F02.1.454.CMB.1.raw
tcagtacacgtgatcacgaccggtgctcgatttagctcgatatagttgggtttgggggagtcagtcccagtcaggacacagcatgggacatgagggtccccgctcagctcctgggctcctgctgctctggctcccaggtgccagatgtgacatccagatgacccagtctccatccttcctgtctgcatccataggagacagagtcaccatcacttgccgggcgatcaggacattagcaattatttagcttggtatacaggtaaaaccaggggacacccctaagctcctgactctcttccgcgtcctattttacaaagtcgggtcccacagattcagcggcgttggatcgtgggacagtaattcactctcacaatcagcacgtccgcggcctggagtacctctgcggtctttattacgtgtaccaacgtagtaccgttacgttcccggtttaaccccccccacgtttccccgggaccgaacgggtaccaacggtaccgtagggaacgtaaacttaaaccgaaacgtggtacggtaccttcggaccaacctacgttcttcgttacttaccgtaactttcccgttcccccgtacccg

SEQ ID NO: 270245 - DNA, 613 bp, Homo sapiens
  misc_feature: GYAE6OF01CM39D.34.57.F02.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (357)..(357): a, c, t, g, unknown or other
  misc_feature (357)..(357): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtcctccatccttctgtctgcatccatagganacagacgtcaccatcacgttcggccgggcatcgaggactattagctaatttattagtcttaggtatacgaaggtaaaaccgaggggaccnccctaagctcctgactctctccgcgtcctatttacgaaggtcggacccacagattcagcggtgtgatcgnggacagtaattcactctcaacatcagcacggtccgacgctaggacgtacgtctgggccgtatttacttcgtacgtacctaacgtcgttaccgtttacgggttaccccccgttaaccccccgtacgttacccgggaccgaacgggtaccacggtacgtagggaactaaacgttaaaccggacgtaggtacggtcgttacgccgtaaccctaggtttcctacggtttccttacgtaacttccccgtttcccggaaccc

SEQ ID NO: 270246 - DNA, 271 bp, Homo sapiens
  misc_feature: GYAE6OF01BCOVP.34.57.F02.1.454.CMB.1.raw
  modified_base (246)..(246): a, c, t, g, unknown or other
  misc_feature (246)..(246): n is a, c, g, or t
  modified_base (252)..(271): a, c, t, g, unknown or other
  misc_feature (252)..(271): n is a, c, g, or t
tcagtacacgtgatcacgaccggtgctcgatttagctcgatatagttgggttggacagaattcactctcacaatcagcagtccgcggcctgaggactctgcggcttattactgtcaacagcttagtcggttacccccccaccttcggccaagggacacgactggagattaaacgaactgtggctgcaccatctgtcttcatcttcccgccatctgaatcacgtgtactgagcgggctggcaaggcncatagnnnnnnnnnnnnnnnnnnnn

SEQ ID NO: 270247 - DNA, 576 bp, Homo sapiens
  misc_feature: GYAE6OF01CGATE.34.57.F02.1.454.CMB.1.raw
  modified_base (268)..(268): a, c, t, g, unknown or other
  misc_feature (268)..(268): n is a, c, g, or t
tcagtacacgtgatcacgaccggtgctcgatttagctcgatatagttgggtttgggggagtcagtcccagtcaggacacagcatggacatgagggtccccgctcagctcctggggatcctgctgctctggctcccaggtgccagatgtgacatccagatgacccagtctccatccttcctgtctgcatccataggagacagagtcaccatcactgccggccatcaggacattagctaattatttagcttggtatcgaaggtaaaaccnggggaccgaccctaagctcctgactctcttccgctctattttacaaggtcgggtacccacaagtacttacgacgcggtcgttggacgtcgtgggacaggtaacttcactctcaacaactcacgcacgtccgcggctcggaggtctcgtcggcgttacttacgttactgtacaactgtacttacggtccgttaaccccccacgttccgggaccgaacggacaccggactacgggacgtaacgttaaacggacgttcggtacgtcgtacgccactacttcgttcgttccttacacttcccgttcccgtac

SEQ ID NO: 270248 - DNA, 815 bp, Homo sapiens
  misc_feature: GYAE6OF01BHXNY.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcgaggactagttagactaatttagtttagtcttaggttaatacgtaaacgggttaaaaccgacgggggtaaccgaccccgtaacgccttaccgtcggtaacttccttccgtttcccggtaccgtttacctaagtttttaaccgaaaacgggttccggggttaccccaaccgtaaagtacgtttaccgaacggtccgggtacggtttacgggaacgttccggtacggggtaaacctaaggtaaacttttacccgaccttccgtaacctaaacgtaacttacccgaacggtacccgtaaccggtcccggtacccgggtacccgttaacgggaaccggtacccgttacggtcggtacccgggtttacttttaaccgttaacgttaccgttaaccgtaaaccgtacggttacccgttttaacggtacccccggtttaacccccccctacccggtttccggaacccggtaaccggtaccgaaccggtaccgtaacgggtaagtaaaccgtttaaaccggaaacgttcggacggtaccttacggacccaacgtacttaccgttgttacccttacgtcccttcccgtcccgtaacc

SEQ ID NO: 270249 - DNA, 551 bp, Homo sapiens
  misc_feature: GYAE6OF01CTZRI.34.57.F02.1.454.CMB.1.raw
  modified_base (197)..(197): a, c, t, g, unknown or other
  misc_feature (197)..(197): n is a, c, g, or t
  modified_base (430)..(430): a, c, t, g, unknown or other
  misc_feature (430)..(430): n is a, c, g, or t
  modified_base (484)..(484): a, c, t, g, unknown or other
  misc_feature (484)..(484): n is a, c, g, or t
  modified_base (532)..(532): a, c, t, g, unknown or other
  misc_feature (532)..(532): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccatagganacagagtcaccatccacttgccgggcgatcgaggacattagcaattatttagcttggtatcaggtaaaaccaggggaccgcccctaagcctcctgactctcttccgcgtccattttacaaagtcgggtacccaccaagattcgagcggcgttggatcgtagggacagtaattcactctacacaatcagcagtccgcggcctgaggactcgtgcgtactttattactgtcaacngtcttacggtccgttaccccccacgttccggccaagggaccaacgcgtaggaanaacgttaaacgatggtacggctcggcctacctattcgtcgttaccttnaccgttccttccccggacc

SEQ ID NO: 270250 - DNA, 265 bp, Homo sapiens
  misc_feature: GYAE6OF01BWVTO.34.57.F02.1.454.CMB.1.raw
  modified_base (253)..(254): a, c, t, g, unknown or other
  misc_feature (253)..(254): n is a, c, g, or t
  modified_base (256)..(265): a, c, t, g, unknown or other
  misc_feature (256)..(265): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtcggttacccccccacttcggccaagggacacgactggagattaaacgaactgtggctgcaccatctgtcttcatcttcccgccatctgaatcacgtgtactgagcggctggcaaggcgcattagnngnnnnnnnnnn

SEQ ID NO: 270251 - DNA, 556 bp, Homo sapiens
  misc_feature: GYAE6OF01EMF35.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggcgatcgaggacatagctaattatttagcttggtatcgaaggtaaaaccgaggggaccgcccctaagcctcctgtactctcttccgcgtcctatttacaagtcgggtcccacagattcagcggcgttgatcgtggacagtaacttcactctacacaactcgagctacgtccgcggtccgtagacggtactcgtggcggtctttaattactgtacaactcgtacttacggtcccgttaccccctcgttccgaccgtaacggaccacgtacgtagaacgtaacttaaacgaacttggtcgtctacgccactatcgttctcttacacttcctcccgtacc

SEQ ID NO: 270252 - DNA, 253 bp, Homo sapiens
  misc_feature: GYAE6OF01CW0BM.34.57.F02.1.454.CMB.1.raw
  modified_base (244)..(244): a, c, t, g, unknown or other
  misc_feature (244)..(244): n is a, c, g, or t
  modified_base (250)..(253): a, c, t, g, unknown or other
  misc_feature (250)..(253): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtcggttaccccccacttcggccaagggacacgactggagattaaacgactgtggctgcaccatctgtcttcatcttcccgccatctgaatcacgtgtactgagcggctggcaggcgnataggnnnn

SEQ ID NO: 270253 - DNA, 614 bp, Homo sapiens
  misc_feature: GYAE6OF01EQ7S3.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccagtaggagacagagtcaaccatcacttggcccgggccatcgaggactattagctaattatttagcttggtatcgaaggtaaaaccaggggaccaccccgtaagcctctgactctcttccgctctatttacaaagtcgggtaccacgagtattcgagcggtcgttggatcgtaggacagtaacttcactctacacatcagccacgtccgcggtacctggacgtactcgtgtacggtactttacgttacgtcgtacaacgtcgtaccgtttacggtacccggtttaaccccccctacgttcccggaaccgtaacgggacctaaccggtacgtacgggaacgtaaacgttaaaaccggaacgttcggtacggtcacggtaccaacctatccgttacttccttacctaccttcccgttccccgtaccg

SEQ ID NO: 270254 - DNA, 575 bp, Homo sapiens
  misc_feature: GYAE6OF01DT5X4.34.57.F02.1.454.CMB.1.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
  modified_base (331)..(331): a, c, t, g, unknown or other
  misc_feature (331)..(331): n is a, c, g, or t
  modified_base (385)..(385): a, c, t, g, unknown or other
  misc_feature (385)..(385): n is a, c, g, or t
  modified_base (436)..(436): a, c, t, g, unknown or other
  misc_feature (436)..(436): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccatagganacagagtcaccatcacttcgccggcatcaggacattagctaattattagcttggtatcgaaggtaaaaccaggggaccncccctaagctcctgactctctccgcgtctatttacaaagtcgggtacccaacganattcaggcggtcgttggatcgtagggacagtaattcactctacactaatcgacncacgtccgcggacctggacggactcgtgcggtcttacttactcgtacaacngtacctttacggtcccgttaacccccctacgttccgggaccaacgggaccacgaccgtagggaacgtaagttaaaccgagtggtcggtacgtgccaacctgttccttcgttacccttctaccttcccgttccccgtacc

SEQ ID NO: 270255 - DNA, 552 bp, Homo sapiens
  misc_feature: GYAE6OF01E3QS5.34.57.F02.1.454.CMB.1.raw
  modified_base (281)..(281): a, c, t, g, unknown or other
  misc_feature (281)..(281): n is a, c, g, or t
  modified_base (346)..(346): a, c, t, g, unknown or other
  misc_feature (346)..(346): n is a, c, g, or t
  modified_base (403)..(403): a, c, t, g, unknown or other
  misc_feature (403)..(403): n is a, c, g, or t
  modified_base (533)..(533): a, c, t, g, unknown or other
  misc_feature (533)..(533): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagacgtcaccatcacgttcggccgggcgatcgaggactattagctaattatttagcttgatcgaaggtaaaccgaggggacncccctagctctgatctctcgcgtcatttacaagtcggtaccacagattcgagcgtcgtggatcgngggacagtaacttcactctacaacatcacgcacgtccgcgcgtgacggctctgcgtnttactactgtacacacgtactacgtcccgttaaccccccacgttaccggaccgaacggaccacgtacgtaggaagtaacgtaaaaccgacgttggcggtcacgtccgactacgtccgttattacccttanacctttcccgtccccgtac

SEQ ID NO: 270256 - DNA, 511 bp, Homo sapiens
  misc_feature: GYAE6OF01ESKXM.34.57.F02.1.454.CMB.1.raw
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
  modified_base (385)..(385): a, c, t, g, unknown or other
  misc_feature (385)..(385): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccatagganacagagtcaccatcacttgccggcatcaggacattagcaattattagcttggtatcaaggtaaaaccaggggacnccctaagctctgatctcttccgctctatttacaagtcgggtccacaagacttcgagcggtcgtggatcgtggacagaattcactctcacaatcagcagtcgcgctgacgctcngcgtcttatactgtacaactagctttacgtccggtacccccctacgttccggaccgaacggacacgagtcggaataagttaaacgactggtcgctcgctacgatctgtcttatactccgtcccgac

SEQ ID NO: 270257 - DNA, 533 bp, Homo sapiens
  misc_feature: GYAE6OF01E43WS.34.57.F02.1.454.CMB.1.raw
  modified_base (363)..(363): a, c, t, g, unknown or other
  misc_feature (363)..(363): n is a, c, g, or t
  modified_base (418)..(418): a, c, t, g, unknown or other
  misc_feature (418)..(418): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagatagagtcaccatcacttgccggcgatcaggacattagcaattatttagcttggtatcgaggtaaaaccaggggacgcccctaagctcctgactctcttccgcgtccattttacaagtcgggtcccacaagattcagcggcgttggatctggacagaattcactcncacaatcagcagtccgcggtcctagacggactctgcgtcttattctcgtacaacngtccttagtcccgttacccccccacgttccggccaaacgggccacgactcggagtaactaaacgacgtggtcggtctgccacctatctcgttcttaccacttccgttcccgtacc

SEQ ID NO: 270258 - DNA, 774 bp, Homo sapiens
  misc_feature: GYAE6OF01DZNSY.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgactatccagatcgaccagtctcctactcccttctgtctcgcactcagtaggacgacagacgtcactatctacgtcggccggcagtcgaggactattagacttaatttagttagtcgttaggtaactaacggtaaacgggtaaaaccggtcggggtaaccctacccgttaacgtccttccgttacgtactcccgtttcgttacccgtaccgttaccttaaacgttttaacggtaacggtaccgggttaacccaacgtaacgtacttacgcggtacggttacgttagggacgtacggtacggaactaacggtaacttccctaccgttacaccgaaacgttacgaccgacggtaccgaccggttaccgggaccgtaccggtacggtaaccggtcttaccggtcggtaccgtttaccgttttaacgttaccgttacggtacctaacggttacggttacccgtttaacccgggttaccccgtttaaccccccgacggttaccccggaaccggtaaccggtacgtaccggaacgttacggtaaacgttaacgttaaaccggaacgttcggtaccggtctacgtacctaccgttatccgttacttactaccctttcctccggtccttacccg

SEQ ID NO: 270259 - DNA, 924 bp, Homo sapiens
  misc_feature: GYAE6OF01BRELO.34.57.F02.1.454.CMB.1.raw
  modified_base (241)..(241): a, c, t, g, unknown or other
  misc_feature (241)..(241): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatcgacccagtctccatccttcctgtctgcatccataggagacagagtcactatcacgttcggccggcagtcaggactattagntaattatttagcttggtattcgaaggtaaaaccaggggaccacccgtaagcctccgtagacttctaccgtttcccgacgttaccctaagtttttaacgaaaacgttaccgggggttaccccaaccgtaaacggtaacgtttccgaaacggtccgggtaccgggttttacggaagtttaccggacggggttaaccaaggttaaacttttaccgtaaaccgttacccgttaacaaaccctaaacgttaccgaacggacccgtaaacgggtttccccgggaccccgggtaccgtttaacgggaaccgggtaaccctttccggttacggtaccggggtacccttttaaacggtttaaccgttacggttaacccgtaaacgttaacggtaaccccgtttttaaccggggttaaccccccgggtttaaccccccccccgttaaccccgggttttaacccgggaccccgggttaaaaacccgggaccgttaaaccccgggtaaacgtttaaccggggaaaacgttaaaccggtttaaaaaaaccccgggttaaaacggttccgggttaacgggtacccccggttaacgggtaacccccgtaaacccttaaccggttacccgttttaaccggtttacccgttttaaccttaaccccgttttcccccgttaaccccccggggtttaaacccc

SEQ ID NO: 270260 - DNA, 558 bp, Homo sapiens
  misc_feature: GYAE6OF01BQ9RJ.34.57.F02.1.454.CMB.1.raw
  modified_base (544)..(544): a, c, t, g, unknown or other
  misc_feature (544)..(544): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggcgatcaggacattagactaatttatttagcgtttggtaatacgaaggtaaaaccgaggggaccgacccctaagcctcctgattcctccttccgcgtacctattttaaccgaaaggttcggggtacccaaccgaagtacttcgaggcggtcgttggatcgtgggacaggtaactcgacttcgcacatcagcacgtccgcgctgacgactcgtgcgtcttatctgtacaacgtgtacttacgtccgttaccccctacgttccgacgtacggacacgacgtagagtaacgtaacgagtgtcggtcacgcactctcttcgtcttacncttccgtccgtacg

SEQ ID NO: 270261 - DNA, 938 bp, Homo sapiens
  misc_feature: GYAE6OF01CF5Q8.34.57.F02.1.454.CMB.1.raw
tcagtacacgtgatcacgaccggtgctcgatttagctcgatatagttgggtttgggggagtcagtcccagtcaggacacagcatggacatggagggtcccccgctcagctccgtggggctcctgctgctctggctcccaggtgccagatgtgacatccagatcgacccagtcctccacttcccttcctgtctgcactccagtaaggagacgagagtccacctatccgtacgttcggccgggacatcgaaggactaattacgactaagtttagttagtcgttagtactaaccgtaaacgggtaaaaccggacggggtacccctacccgtaacgtccgtcctacgtacttcccgttccgtttacccgtaccggtttaccttaaaacgtttaaccggtaaacggggttcccgggtaacccccaacgtaaacggtactttacccgggacggttaccggggtacgtttagggtaaccggttacgggtaacggggtaacgttaaacggttaacccgtttacccgaaccttttaccgaaccgtaaaacgtaaacccgttaccggaaccgggttacccgaccggggtacccccggggtccgggtaacccggttacgggtaaccgggtaacccgttccgggtccgggtttaacccgggtttaaccgttttaacgtttaaaccgttacccggttaaccctaaaaccgggttccgttttaaaccccgtttaaccccgggttttaaccccccccgggttaacccccccgttacccgggttaaccccggggtaaacccggtaaaccggggtaacccgtaaaccggtaacggtacgggtaaaacgttaaacgttaaaaccggtacggtacgggtacggtacgtaccgtaccgttaccttacggttaccgttaccgtttactacccggtttacctccccgttcccgtaacccg

SEQ ID NO: 270262 - DNA, 660 bp, Homo sapiens
  misc_feature: GYAE6OF01CK329.34.57.F02.1.454.CMB.1.raw
tcagtacacgtgatcacgaccggtgctcgatttagctcgatatagttgggtttgggggagtcagtcccagtcaggacacagcatggacatgagggtctccgctcagctcctggggctcctgctgctctggcctcccaggtgccagatgtgacatccagatcgaccctagtcctccattccttcctgtctgcatccagtaggagacagagtcaccatccacgttcggccgggccatcgaggacattagactaaatttatttagctttaggtaactacgaaacggtaaaaccgacggggaccgaccccgtaagcctacctgtactcctcctccgtcgtaccttatttaacgaaaggttcgggtacccaacaagtacttcacggcggtcgttaggactcggtaggactagtacttcactacctcgaactaatacacgcgtaacggtccggccggacctgggacgaccttcgtcggtcgttactttacttaccgtacgttaccaacgttacgtaccgttaacgtaccccggtttacccccccgaccgtttacccggaccgtaaacgggaccctacggaacgtacggtaacgtaaacgttaaacgacgttcgaggtactcgacctacctacttcgtacgttccttacgtccttcccgttaccccg

SEQ ID NO: 270263 - DNA, 260 bp, Homo sapiens
  misc_feature: GYAE6OF01CVXTF.34.57.F02.1.454.CMB.1.raw
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
  modified_base (257)..(260): a, c, t, g, unknown or other
  misc_feature (257)..(260): n is a, c, g, or t
tcagtacacgtgatcacgaccggtgctcgatttagctcgatatagttgggtttgggacagaattcactctcacaatcagcagtccgcggcctgaggactctgcggcttattactgtcaacagcttagtcggttacccccccacttcggccaagggacacgactggagaattaaacgaactgtggctgcaccatctgtcttcattccttcccgccatcctgaatcacgtntactgagcgggctggcaaggcncatagnnnn

SEQ ID NO: 270264 - DNA, 667 bp, Homo sapiens
  misc_feature: GYAE6OF01DYJVK.34.57.F02.1.454.CMB.1.raw
  modified_base (102)..(102): a, c, t, g, unknown or other
  misc_feature (102)..(102): n is a, c, g, or t
  modified_base (284)..(284): a, c, t, g, unknown or other
  misc_feature (284)..(284): n is a, c, g, or t
  modified_base (341)..(341): a, c, t, g, unknown or other
  misc_feature (341)..(341): n is a, c, g, or t
tcagtacacgtgatcacgaccggtgctcgatttagctcgatatagttgggtttgggggagtcagtcccagtcaggacacagcatggacatgagggtccccgntcagctcctggggctcctgctgctctggctcccaggtgccagatgtgacatccagatgacccagtctccatcccttcctgtctgcatccataggagacagagtccaccatcacttcggccgggccgatccaggacattagactaattatttagtcttggtatcaaggtaaaccaggggaccnccctaagctcctgactctcttccgcgtcctattttacaagtcggtaccacaagatcngcggtcgttggatcgtgggacagtaactcactctacaacaactcgagaccacgtccgaccgggtcctaggacggtacctcgtacggcgggttacctttacgttactagtacctaaactggttaccgtttaacggttaccccggttaccccccccgttaacccggtttacccggggacccgtaaaccgggggaacccgtacggaccgtagggtaaacgtaacgttaaaaccggaacgtttacggtacgggtaccttacggccctaaaccgtacgttacccgttcggtttacctttacccgtaccgttcccgtttacccccggtaccc

SEQ ID NO: 270265 - DNA, 713 bp, Homo sapiens
  misc_feature: GYAE6OF01ELSX6.34.57.F02.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagactgacccagtcctccatccttcctgtctgcatccatagganacagatcacntcactcgccggcatcgagactatagataattattagtcttggtatacgaacggtaaaccgaacgggaccgaccccgtaacgactaccgtgtactcgtaccttccgtccgttacctaacgtttaacgtaaacggtacgggtacccgtaacgaacgtaactaccgaggtcggtcggttcggaaaaaacgtcgtacggtaacgtacgtaacttaccgtactactactaacgtaacgtacgacgtaccgtaccggtccggtaccggtccgtacggtacggtaaccgtcgtacgtaccggttaccgtttaacgttaccgttacgtaccgtaacgtacgttaccgtttaccggttaaccccgtttacccccgtacccgttaccgggtaacccgaacgggtaaccgaacgtacggtaacggtaaacgtaaacgtaaaccgtaacgtacgtcggtacgtacggtcctaccgtactacgttacgttacttacctccttcccgttcccgtaccg

SEQ ID NO: 270266 - DNA, 571 bp, Homo sapiens
  misc_feature: GYAE6OF01AHJEQ.34.57.F02.1.454.CMB.1.raw
  modified_base (277)..(277): a, c, t, g, unknown or other
  misc_feature (277)..(277): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttcggccgggccgatcaggactattagcaattattagcttggtatcaaggtaaaccaggggacncccctaagcctcctgactctctccgctctatttacgaaggtcgggtacccactaagacttcgacgtcggtcgttggattcgtagggacagaattcactctcactatacagcacgtccgcggcctgacgtactcgtggcgtacttattacgtcgtacaactcgtacttacggtcccgttaacccccctacgttccggaccgtaacggaccacgacgtacggaagtacgtaaacgtacgtcggcggtctacgcctaacctgttccttcgttacttactacttcccgtcccgtaccg

SEQ ID NO: 270267 - DNA, 840 bp, Homo sapiens
  misc_feature: GYAE6OF01CQ2WD.34.57.F02.1.454.CMB.1.raw
  modified_base (102)..(102): a, c, t, g, unknown or other
  misc_feature (102)..(102): n is a, c, g, or t
tcagtacacgtgatcacgaccggtgctcgatttagctcgatatagttgggtttgggggagtcagtcccagtcaggacacagcatggacatgagggtccccgntcagctcctggggctcctgctgctctggctccccaggtgccagatgtgacatccagatgacccagtcctccatcccttcctgtctgcatccataggagacagacgtccaaccatctacgttcggcccgggacctagtccgaaggtaccaattaacgactaaattttattagcgtttggtaatacgtaaacggtaaaaccggacggggtacccgtacccgtaagtcctccgttacgacttccttccgtccgtaccgttacttaacttttaaccgaacgggttaccgggtaccccctaacgtaaaagtaccgtttaccggacggtaccgggttacggttaggtaacgttacccggtaggggtaaacgtaacggttaaacctttcccgtaacctttaccgtaaacctaaaccgtaaacttaccgaaccgaccgtaccggtaccccggggaccggtaccccggtagggtaaccggtacccgtaccggttcggtcgtttaccgtttaacgtttaaccgtcgttaaccgtaacgtacggttaacccgtttaccgggtttacccccgttaacccccccttacggttaccccgggtaaccgaaacccggtaccgtaaaccgtacggtaagggtaaaccgtaaacggttaaaccggtacgttacgggtaccggtcgtaccgaccctaaccgttaccgttacttaccgtttaccttacccttaccgttccccgttaccccgtaacccg

SEQ ID NO: 270268 - DNA, 596 bp, Homo sapiens
  misc_feature: GYAE6OF01BZPSP.34.57.F02.1.454.CMB.1.raw
  modified_base (197)..(197): a, c, t, g, unknown or other
  misc_feature (197)..(197): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccatagganacagagtcaccatcacttgccggcatcaggacattagcaatttatttagcttggtatcaaggtaaaaccgaggggaccgcccctaagctcctgatctccttccgcgtcctattttaacgaaggtcggggtacccaaccgaagtacttcgaggcggtcgttggatcgtggaacagtaattcactctcaacatcagcacgtccgcggccgtagacggtctcgtcggcgtctttacttctgtaccaacgtacgtccttacggttccccggtttaacccccccgtaccgttacccggtacccgaaacgggacctaaccggtacgtaggaacgtaacgttaaacgaacgttcggtcggtctcggaccacctatcgttcgttactctaccttccgtcccgtaccg

SEQ ID NO: 270269 - DNA, 950 bp, Homo sapiens
  misc_feature: GYAE6OF01DR2HH.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatcgacccagtcctcctactcccttcctgtcctgctactccagtaggagacaggacgtccacccattcctacgttcggacccggggccgtataccgaggactattacgactaaatttacgtttagtcgtttaggtactacgtaaaacggggttaaaaccccggaacgggggaccccgtaccccccgttaaaggtcccgttaacccgttaggtaaccgtttccttcccggtttacccccggcccggtttaaccccgtttaacgttttttaaaaccggaaaaccggggtttcccggggggtaacccccctaaacccgtaaaggtaaccgtttaccggaaaccggggttccgggggtttaccgggtttaggggtaaccgtttaccggggtaacgggaaccggtaaagttaaaccgtttccgtaaaccgtttccctaactaaacccgtaattacccggaaccggtaccgttaacccgggtccccgggtaccgggtacccgttaagggtacccggtaccgttaccggtcggtacccgggtttactttaacgtttacccgtacgtacccgtaaccgtaacggttaccgtttacccgggtttacccccggttaaccccccccgtaccggttacccgggtaaccccggaaacggggtacccgtaaccggtacgggtacgggtaaaaccggttaaacgtaaaccggttaaccggtcggttaccgggacgttaccggtacctaaccgtcgtttaccgttcccggtttacttaccccgttaccttccccgttccccgtaacccg

SEQ ID NO: 270270 - DNA, 495 bp, Homo sapiens
  misc_feature: GYAE6OF01BTBLS.34.57.F02.1.454.CMB.1.raw
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
  modified_base (431)..(431): a, c, t, g, unknown or other
  misc_feature (431)..(431): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggccgatcaggacattagcaattatttagcttggtatcaggtaaaaccaggggacgcccctaagctcctgatctcttccgcgtccattttacaagtgggtcccaccaagattcagcggcgttgatctgggacagaattcactctcacatcancacgtccgcggctgaggacncgtgcggcttatactgtcactgccttagtcgttaccccccncttcggccaaggaccacgactggatattaaacgatggngctgcnccatctntctnatctcccgc

SEQ ID NO: 270271 - DNA, 764 bp, Homo sapiens
  misc_feature: GYAE6OF01A8FBL.34.57.F02.1.454.CMB.1.raw
  modified_base (139)..(139): a, c, t, g, unknown or other
  misc_feature (139)..(139): n is a, c, g, or t
  modified_base (191)..(191): a, c, t, g, unknown or other
  misc_feature (191)..(191): n is a, c, g, or t
tcagtacacgtgatcacgaccggtgctcgatttagctcgatatagttgggtttgggggagtcagtcccagtcaggacacagcatggacatgagggtcccgctcagctccgtggggctcctgctgctctggctccaggtnccagatgtgacatccagatgacccagtctccatcctctgtctgcatcatagngacaggatcacatccacttcggccgggtcatcgaggactagttagactaagtttagttacgtcgttaggtactaccgaacggttaaaaccgacgggggtacccaccccgtaaggtcctaccgtacggtacttaccgtccgttcccggtaccgttacccttaattttaaccggtaaggttaccggggtacccaaccgtaacgtacgttcgacggtccgggtcgttaggtacggtacgtacgggaacgagttaacgtcctaacttcgtaaccaccgtaactaccgtaacggaccgtaccggttccggccggtaccgtacggtaacgggtaccttcggtcgtaccgggttactttaacgttacgtagtaaccgaagtttacgtaccgtttaaccggtaccccggtttaaccccccgaccgtttaccgggacccgtaacggggtaccctaacgggtacttacgggtaaacttaacggttaaaaccggtaccgttaacggcgggtaccgtacggtacccctacgttaaccgttcggtaacgttcccgttaaccttcgttcccccgttcccggtaaccc

SEQ ID NO: 270272 - DNA, 823 bp, Homo sapiens
  misc_feature: GYAE6OF01AVLPT.34.57.F02.1.454.CMB.1.raw
  modified_base (102)..(102): a, c, t, g, unknown or other
  misc_feature (102)..(102): n is a, c, g, or t
tcagtacacgtgatcacgaccggtgctcgatttagctcgatatagttgggtttgggggagtcagtcccagtcaggacacagcatggacatgagggtccccgntcagctcctggggctcctgctgctctggctcccaggtgccagatgtgacatccagatcgacccagtcctccatccttctgtctgcatccataggagacagacgtccacctatcgacgttcggccgggcagtcgaggactattagctaatttatttacgcttagggtactacgaacggttaaaaaccgacgggggaccgtaccccctaaaggccttcctaggtacttccttaccgttccgccgttaccctaacgtttttaacgaaacggttcggggtaccccaaccgtaaacggtacttccgaacggtccgggtgtttacgggacgttccggtacggggaactaacgtaactttcccaacttcccgtaccaacgtaacttccgaacgtcgtaccggtaccggtccggtcccgtaggtaccggtaccttcggacgggttaccggttacctttaagttaccgttacggttacctaaacccggtcggtttaacccgtttaaccgggtttaccccgggttaacccccccccttaccggtttaccccgggtaaccggtaaaccgggtaccctaaccgggtaaccggtacgggtaaacgttaaaccggttaaaaccgggaaccggtttacggttaccgggtaccgtaccggtaaccctaaccccgtagtttacccgtttaccgttacctttacccgtaccctttccccggttaccccgttaaccccgg

SEQ ID NO: 270273 - DNA, 298 bp, Homo sapiens
  misc_feature: GYAE6OF01EC30H.34.57.F02.1.454.CMB.1.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
  modified_base (263)..(298): a, c, t, g, unknown or other
  misc_feature (263)..(298): n is a, c, g, or t
tcagtacacgtgatcacgaccggtgctcgatttagctcgatatagttgggtttgggacagaattcactctcacaatcagcagtccgcggcctgaggactctgcggcttattactgtcaacagcttagtcggttacccccccacttcggccaagggacacgactggagattaaacgactgtggctgcaccatctgtcttcatcctccgcatcgtgaatcacgtntaactgacggcgggntgggacaacggcgtacataggnatnnnnnnnnnnnnnnnnnnnnnnnnnnnnnnnnnnnn

SEQ ID NO: 270274 - DNA, 873 bp, Homo sapiens
  misc_feature: GYAE6OF01EQUYR.34.57.F02.1.454.CMB.1.raw
  modified_base (866)..(866): a, c, t, g, unknown or other
  misc_feature (866)..(866): n is a, c, g, or t
tcagtacacgtgatcacgaccggtgctcgatttagctcgatataggttggggtttgggggagtcagtcccagtcaggacacagcatggacatggacgggtcccccgctcagcctccgtggggcctcctgctgctcgtcggcctcccgaggtcgccaggtatggtacgacctactacccgaagtacgtacggacccctacgttcctaccctactttcccttccgtgtcctacgacctacgttaccgaaggtaacggaactaacgtacgtaccgtacccaacctacttaccggtaaccggttccggggaccccgggtacctacggtaaccggtacggtaacttaacgttaacgtaactttaaagttttacgtttaacggtcggtttaaggtaaccgtaaaccggtaaaaccggggtaaaaccgggtccggggtaccccctacccgttacgtcccgtaccgttacgttaccttccgttccgttacccgtaccgttaacgttaaacgttttacgggaaccgggttacccgggtaacctaactagttacggacggtacggtccgggttagtacggtacgtacgggtacgtaaactacgtactacccgaccttaccgtaatacgtaacgaccgtaacggcccggttaccggccggtaaccggtacggtaggtaacccgttcgtaccgtcgggttacctttacgttaacgttactaccgtaaccgtacgtaccgtttacccgttaccccggtacccccgtaaccccgacccgttacgaaccggaacgtacacccggtagaacggtacgtaaacctaccgagggttagcctaccggactacccagttcttacgtcttcccgattcccggtcccncggtacc

SEQ ID NO: 270275 - DNA, 756 bp, Homo sapiens
  misc_feature: GYAE6OF01BZIRB.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatcgacccagtcctccacttccttcctgtctgctactccagtacggagacagactcaccatctacgtcggaccggcatcgaggactagtagactaattattagtcttaggtactacgaacggtaaaccgacggggacctacccctaacgtcctcgtcgtacttcctacgttcccgtaccgttcctaattttacgaacggtcgggtacccaacgtaacgtacttaccgacggtcgggtcgttacgggtactcggtacgggtaacctaagttaacgttacctaacccttaccgtactaaccgtaacgttaccgaacggtcctaaccggtccggaccggtccttaggaccggtacgtccgtcggtaccgttacgtttaactacgttacgacctaaacggttcgtaacccggtttaccggttaccccccgttaaccccccgtacggtaccccgggtaaccgtaacccggggtaactacccggtaggtacggtaaaccgttaaaccgtaaacggtaccggttcgtaacgggtaccttacggaacccgtaccgtaaccgttcgttaccgttacccttaccgttaccttccccgtcccgttaaccg

SEQ ID NO: 270276 - DNA, 705 bp, Homo sapiens
  misc_feature: GYAE6OF01BXWAE.34.57.F02.1.454.CMB.1.raw
  modified_base (523)..(523): a, c, t, g, unknown or other
  misc_feature (523)..(523): n is a, c, g, or t
  modified_base (572)..(572): a, c, t, g, unknown or other
  misc_feature (572)..(572): n is a, c, g, or t
  modified_base (667)..(667): a, c, t, g, unknown or other
  misc_feature (667)..(667): n is a, c, g, or t
tcagtacacgtgatcacgaccggtgctcgatttagctcgatatagttggggtttgggggagtcagtcccagtcaggacacagcatggacatggacgggtccccgctcagcctccgtggggctcctgctgctcgtggcctcccgaggtcgccagatgtagacatccagactcgacctagtcctcctacttcccttcctgtctcgacctactaccgaagtacggacgacgaggactaccaacctactacgtaccgttcgggacccggacgtatcgaaggtaaccttaagttaagtaactttaatttagttaccggtgttaggtacgtaacggaaaacgggtaaaccggaccgggaaccccgtaccctaacgtcccgttacgtcttacctcccgttcccgtccggttaccgttaccttaacgtttaacggtaacgggtacccggtacccaaacgtacgtacgttacggacggtcggtacggttacggacgtacggtacggaactataacgtcctactcacagtacngacgcgttcgccgcgtcgacgtacgctcgtcgtacgtactttacacgtnaactacgtacgtaccgttaccgaccccgttacccgtcgaccggacgtaacgcgtaacgacggtacgacgttaacgtaacgagtcggactccgacnctactacgttcttacgttcccacgtcctcccgttcgac

SEQ ID NO: 270277 - DNA, 772 bp, Homo sapiens
  misc_feature: GYAE6OF01DLP8W.34.57.F02.1.454.CMB.1.raw
  modified_base (101)..(101): a, c, t, g, unknown or other
  misc_feature (101)..(101): n is a, c, g, or t
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
tcagtacacgtgatcacgaccggtgctcgatttagctcgatatagttgggtttgggggagtcagtcccagtcaggacacagcatggacatgaggtccccgntcagctcctgggctcctgctgctctggctcccaggtgccagattgtgacatccagatcgaccagtctcattccttcctgtcgtgcatccatagganacagatcaccatcacgttcggaccggcatcaggactattagctaattattagcttggtatccgaaggtaaaccgagggacctcccctaagctccngactctcctccgcgttcctagttttaacgaaacggtcgggtaccctaacgtaagtacgttccgaggtccgggtcggtttaggtacgttcggttaacgggaacctaagtaaacgtttaccacccgttacgtactaaccgtaacgttacccgaaggtacccgtaccgggttacccgggtacccggttacccgttacggttaacgggttacctttaccgttcggggtacccgtttaccgttttaactttaaccggtcgttaacccgtaaaccgtacgtttacccgttttaaccggttccccgggttttaacccccccccttacgggtttacccgggaaccggtaaaccgggtaacccaacgggttactacggggtaaacctaaacgttaaaaccgtaggttcggtacgtaccggtcgtacccgtaaccctacgtttcccgttacggttacctttcccgtaacctttcccgttccccgtaaccg

SEQ ID NO: 270278 - DNA, 661 bp, Homo sapiens
  misc_feature: GYAE6OF01A036Y.34.57.F02.1.454.CMB.1.raw
  modified_base (633)..(633): a, c, t, g, unknown or other
  misc_feature (633)..(633): n is a, c, g, or t
tcagtacacgtgatcacgaccggtgctcgatttagctcgatatagttgggtttgggggagtcagtcccagtcaggacacagcatggacatggacgggtcccccgctcagctccgtggggcctcctgctgctctggctcccgaggtcgccagatgtgacatccgagactcgacccagtctcccattcccgttcctgtctcgctatccagtaggacgacagactaccacctatcctacgttcggccgggtccatacgagtactagttacgacttaatttagttcgtgttaggtaactacggaacggtaaaccgcggggtacccctaccctaaggtcctaccgtagaccttcgtccgtaccgtcgtaccttaagttaacgacgggttaccggacccaacgtatactcgtaggccgtaggtagactcggtaggactagtactccactactacataactcgtacgacgtaccggtccgccggtacgtaggaaccggtactcgtacggtaccgttatttaccgtactagtaccaacgtcgtacccgttacggtaccccgtacccccgtgtacccgggaacgtaccggtacacgtacggtagaacgtaacgtaacgagtcgtacgctacgaccctacgtntaccgtcttctacctcttcccgtctacg

SEQ ID NO: 270279 - DNA, 702 bp, Homo sapiens
  misc_feature: GYAE6OF01B6TPQ.34.57.F02.1.454.CMB.1.raw
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
tcagtacacgtgatcacgaccggtgctcgatttagctcgatatagttgggtttggggagtcagtcccagtcaggacacagcatggacatgagggtccccgctcagctcctgggctcctgctgctctcggctcccaggtgccagatcgtgacatccagatgacccagtctcatccttacngtctagcatccatagganacagagtccaccatccacttacgccgggtccatccaggacctattagctaattgttaacgcgttgtaatcaaggtaaacctacgggactacccctaagctccgtagatcctctaccggtcgtcccgtattttacgaaacggtcgggtaccctaacgtaacgtacttacaacggtcggtacggttaggacttcgtacgggaacacgtatacgacctctacgaactactcgacgtcaacggttccgcgtaccgtaggtacggaccgtcgtcggacgtcctttaaattaccgtataccgtaaagaccgtcctttaacgggtaccccgtttaacccccccgtacggtttaacccggaccggtaaaccgggaccttaaccggacgttacgggtaaacggtaacttaaaaccgggtaaacgttcggtaaacggggtcccttacggtaacccgttaacctaacccgttcggttccgtttacccgttagtaccttacccgtttcccgaacccg

SEQ ID NO: 270280 - DNA, 907 bp, Homo sapiens
  misc_feature: GYAE6OF01CJWC0.34.57.F02.1.454.CMB.1.raw
  modified_base (103)..(103): a, c, t, g, unknown or other
  misc_feature (103)..(103): n is a, c, g, or t
  modified_base (163)..(163): a, c, t, g, unknown or other
  misc_feature (163)..(163): n is a, c, g, or t
tcagtacacgtgatcacgaccggtgctcgatttagctcgatatagttgggtttgggggagtcagtcccagtcaggacacagcatggacatggacgggtccccntcagctccgtgggcctccgtgctgcctcgtcggcctcccgaggtcgaccaagtatggtanactatcccaagacttccgaaccctagttccctacctaactttccccctttaccgtcggtcctacgtactaccgtaaccgtaggttaaccggagtaacgaacgtacgtaccaaccgtactccgtaccgttcgggacccggtacgtactacggacgtaaactagttcgtaattaagtttaacgtttaacgtacgttacggttaaacgtaacgtaaaccggttaaaaccggaccgggtaacccctacccgaaccgttcctaccgttacttaccgtccgtttacccgttacccggtacctttaaccttaacggttttaaaccggtaaaccggggttccggtaaccccctaagtaaacgttacttaccggtaccggtcggttcggttacggacggttacggtaaccggttaagtaaccgtaaccgttacgtaccctacgtaagtaaccgtaaccgtacgtaccgtaccgtaccggtcccgggtcggtaacccgtagtaaccggtacgttcccgtgtacccgttagtttaacgtccgtaaccgtactaacgtttccggttacccgttaacccggttaccccccgttaccccgtaacccggtcccggtaaccggtaaaccgggtacccgtacgggttaccgtaaaacgtcggtaaaacgttaccgggttactaacgggtccggtaaccttacccgggtctaaaccggttcttaaccgttacgtccgtttaccaccgttccctacccgtaac

SEQ ID NO: 270281 - DNA, 922 bp, Homo sapiens
  misc_feature: GYAE6OF01BVDO3.34.57.F02.1.454.CMB.1.raw
  modified_base (104)..(104): a, c, t, g, unknown or other
  misc_feature (104)..(104): n is a, c, g, or t
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
  modified_base (840)..(840): a, c, t, g, unknown or other
  misc_feature (840)..(840): n is a, c, g, or t
tcagtacacgtgatcacgaccggtgctcgatttagctcgatatagttggggtttgggggagtcagtcccagtcaggacacagcatggacatggagggtccccgntcagctccgtgggctcctgctgctctggctcccaggtgccagatgtancatccagatcgaccagtctcctatccttctagtctcgcatccagtagganacgagacgtccaaccatacctacgttcggcccgggacattacggaggaactagttactaacttaattttacgtttacgtcgtttaggttaacttaccgtaaacggtaaaaccgggacggggtacccctaccccgtaaggtccccgttaacgtccgtacttaccgttcccgttccgggtaccctttaccttaacgttttaaccgaaacgggttcccggggtaaacccctaacctaagtacttccggacggtcccgggtaggtttacgggacgttacggtacggggtactaacggtacgtttaccaacgtttaaccaccttaaacgaacgttaccggtaaccgtaccggtaaccccgggttcccggggtaaccggttacccgggtaacgggtaaaccggtaaccgttccggttaccggggtacgttttaacccgtttaacgtttacccggtaacgttaaccccgtaaacggtaaccgtttccccggttttaaccccggttaccccccggttaaccccccccggttaaccggtttacccggggaaaccccgtaaacggggtaacccgtaaaccgggttacgtaacgggtaaaaccggttaaaacgggttaaccgtaaaccggggttacgtaaacccgggtntaacccggttcccaaaccggtacgtttacccgttttcttaccccggtacccttaacccggtttcccgtcccccgttaaccgg

SEQ ID NO: 270282 - DNA, 920 bp, Homo sapiens
  misc_feature: GYAE6OF01DKABJ.34.57.F02.1.454.CMB.1.raw
  modified_base (108)..(108): a, c, t, g, unknown or other
  misc_feature (108)..(108): n is a, c, g, or t
tcagtacacgtgatcacgaccggtgctcgatttagctcgatataggttggggtttgggggagtcagtcccagtcaggacacagcagtggacagtggacgggtccccgntccagccgtccgtggggtccttcccgtggctcgccgtcgtcggccctacccgtagggtcgaccagtacgtcgtacgacctacaccgagtacgtaccgaccgtactccctacctacgtttccctttccgtcgtcctacgtacctacgtaccgaaagtacggaacgacgtaacggtactaaccacctacgttaccgtaccgggtccggaacccggtagtaccgtaacggacgtaacgttacgtaactaagtttaatttacggttacgttcggttaagtaccgaacggtaaaccgggaaccgtaccgggaccctaccgtaactccgtacgtaccttacgttcccttccggttacgtaaccgtttacgtttaaaccgttaaccgggtaccggttacccgttaacccggaaacttacccggttagggtacggtaaccgggttacgttacgggtttacggaaccgtttacgggaaaccgggttaacttaaccgtttaaccgttaaccgaccgttaacgttaaaccgactaagggttacccggacgttccggtaacccggggtcccgtacgggttaccgaacgggttcgtacccggttggttaccccggtatttaaccggttaacgtcctaaccgtaccgtttaacccggtacgggtttacccttaacccccggggtttccccctaacccggtaccggtaacgggacggtaaacgccgtaaagtacggtaacgacgtttaacgaccgtcgcggtaccacggtactaccctcggtattttcccgggtacttacccgaaccgtttcccctgtccctaaggg

SEQ ID NO: 270283 - DNA, 694 bp, Homo sapiens
  misc_feature: GYAE6OF01C8Y53.34.57.F02.1.454.CMB.1.raw
  modified_base (105)..(105): a, c, t, g, unknown or other
  misc_feature (105)..(105): n is a, c, g, or t
  modified_base (182)..(182): a, c, t, g, unknown or other
  misc_feature (182)..(182): n is a, c, g, or t
  modified_base (231)..(231): a, c, t, g, unknown or other
  misc_feature (231)..(231): n is a, c, g, or t
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
  modified_base (540)..(540): a, c, t, g, unknown or other
  misc_feature (540)..(540): n is a, c, g, or t
tcagtacacgtgatcacgaccggtgctcgatttagctcgatataggttggggtttgggggatcagtcccagtcaggacacagcatggacatggacgggtccccgntcagctccgtcgggctcctgctgctcgtcggcctcccgaggtcgccagatggtcactatccaagactacgaaccctntcctacctcttcccgttctcgttctcgacctacgtacaggtaggacganacggctaccacgactcgtaccgtggcccggntactcgaagtactagttanactttaagttntacgtactaggtaactacggtaaacggaaaccgcgggtacctacccctagtaccttctcgtattcctcgttaccgtccttaacttacgtttaaccggaacggtccggtacccaagtacgtactcgacggttcggtacgtgaccgtaggtaacgaacgtagtacccttcaccgttactaaccgacttaacgcgtacggaccgtccggtcgacgtcgtaagccgtntacgtcgacgttntacgtacgtanactgtaacccgtccgtaccccgtacccaccggtaacgaccgtaaggaccaccgggttagacgttaaacctaacgttaaacgacggtcgtcggtacctcgaccttaacgttgtcccgtaaccgtttctaacccttacggtcccgtaaaccctacg

SEQ ID NO: 270284 - DNA, 822 bp, Homo sapiens
  misc_feature: GYAE6OF01B8XWF.34.57.F02.1.454.CMB.1.raw
  modified_base (101)..(101): a, c, t, g, unknown or other
  misc_feature (101)..(101): n is a, c, g, or t
  modified_base (215)..(215): a, c, t, g, unknown or other
  misc_feature (215)..(215): n is a, c, g, or t
  modified_base (776)..(776): a, c, t, g, unknown or other
  misc_feature (776)..(776): n is a, c, g, or t
tcagtacacgtgatcacgaccggtgctcgatttagctcgatatagttgggtttgggggagtcagtcccagtcaggacacagcatggacatgagggtccccntcagcctccgtggggcctcctgctgctctggctcccgaggtgccaggatgtgacagtccaggatcgacccagtcctaccactccctttcctgtctgcctatccaagtacggganacgagtacgtaccacctatccaacgttcgggcccgggacctactccgaaggtactagttacgacttaaatttattttacggcttagggtaactacaacggtaaaaccggtacgggggacccacccctaagtccttccgtagtaacttcctcccttccggtaccgtttacccgttaactttttaaacggaaacgggttccccggggtaacccctaaccgaaaacggttacttaccggtacggggtaccgggttcggttagggtacttaccggggaagggtaacctaaacggttactttacctacctaccgttacaacgtaactccgacgtaccgtaccggttccggacccggtcgtacggtacggtaacttccggtcggtaccgggttactttaacgttaccgttcgtaacctaacgtaccggtttaccgtttacccggttacccggttacccccccgtaccggtttccccgggtaaccggtaaaccgggtactaacccggtacggtaacgggtaaacgtaaacgttaaaccgtaaccggttacggtacggtgacgtacccnccgtaattccttcttcgttaccttacccttcccggttccctaaccg

SEQ ID NO: 270285 - DNA, 804 bp, Homo sapiens
  misc_feature: GYAE6OF01E36CD.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatcgaccctagtcctccactcccttcctgtctgctatccgagtaggagacagacgtaccaccatcctacgttcggcccggcgactacgaaggactagttagactaattatttacgtcgttaggtactacgtaacggtaaaccgacgggggaccctaccccgtaacgtcctaccgtagtacttccgtccgtttccccggtacgtttacccttaaacgtttttaaccggaaaccgggttaccggggttacccccaacgtaacgtacgttaccgacggtcgggtacggttacggacgttacggtacgggtaactacgtaactttaccgacttaccgtacctaactaacgtccacggaccgtaccggtcccggtaccggtcccgtagggtaaccggtaccgtcgtacggtaccggttactttaacgtttaccgtacgtaaccgtaacgtaccggttacccgtttacccggttacccccggttaacccccccgtacccggttacccgggtaacccggaaaccgggtacccgtaaccggtacgttaacgggtaaacgtaaaccgttaaaccggaccgttacgggtaccgtacgtaccgaccgtaccgtacgttaccgttcgttaccttaccgtaccttccccgtccccgtaac

SEQ ID NO: 270286 - DNA, 590 bp, Homo sapiens
  misc_feature: GYAE6OF01A5I50.34.57.F02.1.454.CMB.1.raw
  modified_base (280)..(280): a, c, t, g, unknown or other
  misc_feature (280)..(280): n is a, c, g, or t
  modified_base (566)..(566): a, c, t, g, unknown or other
  misc_feature (566)..(566): n is a, c, g, or t
  modified_base (578)..(578): a, c, t, g, unknown or other
  misc_feature (578)..(578): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccagtaggagacagacgtccaccatcacgttggccgggccatcgaggactattagcaatttattagcttaggtactacaacggtaaaaccgnggggaaccaccccgtaagcctcctgactctcttccgcgtcctattttaacgaaggtcgggtacccaacgaagtattcgagtcggcgttaggacgtctgggacagtaacttcactctacacaatcagctacgtccgcggcctaggacggactcgtcgcgttctttaacgttctcggtactaaacgcgttccttaacggttcccggttaacccccctacgttacccgggaccgaacgggacctacgacgtcgggaactaagtaaacgactggtcggctacgccaactntcgtctacttcnctccgttccacg

SEQ ID NO: 270287 - DNA, 839 bp, Homo sapiens
  misc_feature: GYAE6OF01DOLZR.34.57.F02.1.454.CMB.1.raw
tcagtacacgtgatcacgaccggtgctcgatttagctcgatatagttgggtttgggggagtcagtcccagtcaggacacagcatggacagtggacgggtccccgctccagcctccgtgggcctccgtgctgcctcgtcggcctcccgaggtcgaccgagtagtgtcgactactaccagtacgtacgaccctcgtacctcctacttccttcgtcgtctcgacctacgtccgaagtacggacacgacgtacgtaccactacgttccgtaaccggttccggggacccggtaccgtacgtacggtaacggttaacttacgttaacggtaactttaagttttacgtttaacggttcgttaacggttacgtaaccggtaaaacgggtaaaccgggaccgggaccccgtaaccgtaacgtcccgttaccgtactaccgttcccgtacccgttccggtacctttaacttaacggtttaaaccggttacccgggtaccggtaacccaacggtaacctacggtaccggtacggtccgggttaagtcggtaccggtacgggtaacgtacgtaacttacgtaccgtactacctaaccgataccgtacgacgtaccgtccggtaccgtcgggacgtacggtaccgtcggtcgtacggtaccttacgtttaacgtcctacgtaccgtaacgttacgttacccgtttacccggtaccccgtttaacccccgtaccggtaccggtaaccggaccggtaacgtaccggtaggtaaccgtaaagttaaccggtacgtacgtacggctacgacccgtcttacgtcttaacgttctacttacgttcccctcgtctaccg

SEQ ID NO: 270288 - DNA, 739 bp, Homo sapiens
  misc_feature: GYAE6OF01DMYZA.34.57.F02.1.454.CMB.1.raw
  modified_base (142)..(142): a, c, t, g, unknown or other
  misc_feature (142)..(142): n is a, c, g, or t
  modified_base (186)..(186): a, c, t, g, unknown or other
  misc_feature (186)..(186): n is a, c, g, or t
  modified_base (191)..(191): a, c, t, g, unknown or other
  misc_feature (191)..(191): n is a, c, g, or t
  modified_base (204)..(204): a, c, t, g, unknown or other
  misc_feature (204)..(204): n is a, c, g, or t
  modified_base (206)..(206): a, c, t, g, unknown or other
  misc_feature (206)..(206): n is a, c, g, or t
  modified_base (270)..(270): a, c, t, g, unknown or other
  misc_feature (270)..(270): n is a, c, g, or t
tcagtacacgtgatcacgaccggtgctcgatttagctcgatatagttgggttgggggagtcagtcccagtcaggacacagcatggacatgagggtccccgctcagctccgtgggcctcctgctgctcgtcgctcccgaggtnccagatcgtgacatccaagatcgacccagtctccacttccttcngtctncactccagaggananagactccacatctacgtcgccggctatcgagtactatagactaattgttagtcgttaggttaanacggtaaacggtaaaccggacggggtaccaccccgtaagtcctccgtgtacctcttccgttaccgcgtttactacgttttaacggaacggttccggtacccaacgtaacgtactacggacggtcggcgtttaggacgttacggtagggaactacgttaactcgtacctacgtaactaacctaacgtcgaacgtaccgtaccggtccgaccgggtacttaggaccgtacgttcgtacggtccgttaactttacgtacgtcgtaacctaacgtacggttacccttaccggttaccccgttacccccgtacgttaccgggaacccgtaacgggtaccgtaccggttacgggtacggttaaaaccgtaacgttaaccgtacggttacggtacggtacccgttactacccgtaaccgttacgttccgttttacccgtacttacccggttacccttcccggttccccttaaacgg

SEQ ID NO: 270289 - DNA, 801 bp, Homo sapiens
  misc_feature: GYAE6OF01BQO78.34.57.F02.1.454.CMB.1.raw
  modified_base (782)..(782): a, c, t, g, unknown or other
  misc_feature (782)..(782): n is a, c, g, or t
tcagtacacgtgatcacgaccggtgctcgatttagctcgatatagttgggtttgggggagtcagtcccagtcaggacacagcatggacatgagggtccccgctcagctccgtggggctcctgctgctctggctcccgaggtgccagatgtgacatccagatcgacccagtctccactccttcctgtctcgcatccagtaggacgacagacgtaccactactcgactcggccgggccgtatcgacggactaattacgactaattagtttagtcgtttaggtactacgtaaacgggtaaaaccgacggggaacccgtaccccgtaacgtccgtacctacgtacttccttaccgtccgtaccgttaccttaacgtttaacgaacggttccgggtaccctaacgtaagtaccgttcgacggtcggtacggttaggacgttcggtaacgggaacgtaacgtaactttccggaaaccttacctaacctaacgtaacgtaccgtaacggtacccggtaccgggttaaccggcccgggtaaccgtacggtaccggtaaccgttcgggtcgggttaccgggttcttttaaacgttaccgtacgtaacccgtaaacggttacgttaaccggtttacccggtaacccccggtttaacccccccgttaccgggttaacccgggaaccgtaaaccgggaaccgtaaccggtacggtaacggtaaacgtaaacgttaaaccggtaccgtggtccggtacgtcgacctaccgtactttcctaccggttccttaaccncgtttccccgtaccgtacc

SEQ ID NO: 270290 - DNA, 741 bp, Homo sapiens
  misc_feature: GYAE6OF01CVCJA.34.57.F02.1.454.CMB.1.raw
  modified_base (104)..(104): a, c, t, g, unknown or other
  misc_feature (104)..(104): n is a, c, g, or t
  modified_base (158)..(158): a, c, t, g, unknown or other
  misc_feature (158)..(158): n is a, c, g, or t
  modified_base (184)..(184): a, c, t, g, unknown or other
  misc_feature (184)..(184): n is a, c, g, or t
  modified_base (233)..(233): a, c, t, g, unknown or other
  misc_feature (233)..(233): n is a, c, g, or t
  modified_base (342)..(342): a, c, t, g, unknown or other
  misc_feature (342)..(342): n is a, c, g, or t
  modified_base (450)..(450): a, c, t, g, unknown or other
  misc_feature (450)..(450): n is a, c, g, or t
  modified_base (683)..(683): a, c, t, g, unknown or other
  misc_feature (683)..(683): n is a, c, g, or t
  modified_base (692)..(692): a, c, t, g, unknown or other
  misc_feature (692)..(692): n is a, c, g, or t
tcagtacacgtgatcacgaccggtgctcgatttagctcgatatagttggggtttgggggagtcagtcccagtcaggacgacagcatggacatgacgggtccccntcagctccgtggggctccgtgctgctcgtggcctcccgaggtcgccagagtcgngacatccagactcgacccagtctccncgttcctcctgtctgcactacaagtaggacgacgtaaggtacacaaccnctctacgtcggccgggtacagcgaaggtactattacgattaattagtagtacgttagtaagtacgaaacgggtaaaccggacggggaacctaccgtaacgtccttacgngtacctccttcgtcctacgtactaagtttaacgacgggtcggtaccataagtcttcgaggtccggtagtgactgtacggactagtacttacacgtatacaactaacgngacgccgtacggtcccgggatcgggttacgaacgtcgtacggtacggtacgttacttttaactcgtaacgttaacctaaggtacgtttaccgttaacccccgggttccccggtaaacccccttacgggtacccgggaaacgtaaaccgggaccccggtaagtaacccggttagaaaacggtttaaaacggaaaacccgtagggttccggacgggtaacctcgggtaaaccccncgggttttntaacggtccctttaaacttccgtaaccccgtttcccggtccctaaacgg

SEQ ID NO: 270291 - DNA, 251 bp, Homo sapiens
  misc_feature: GYAE6OF02IAV89.34.57.F02.1.454.CMB.1.raw
  modified_base (250)..(251): a, c, t, g, unknown or other
  misc_feature (250)..(251): n is a, c, g, or t
tcagtacacgtgatcacgaccggtgctcgatttagctcgatatagttgggtttgggacagaattcactctcacaatcagcagtccgcggcctgaggactctgcggcttattactgtcaacagcttagtggttacccccaccttcggccaagggacacgactggagattaaacgactgtggctgcaccatctgtcttcatcttcccgccatctgaatcacgtgtactgagcgggctggcaaggcgcatagnn

SEQ ID NO: 270292 - DNA, 254 bp, Homo sapiens
  misc_feature: GYAE6OF02INAKD.34.57.F02.1.454.CMB.1.raw
  modified_base (251)..(254): a, c, t, g, unknown or other
  misc_feature (251)..(254): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtggttaccccccaccttcggccaagggacacgactggagattaaacgaactgtggctgcaccatctgtcttcatcttccgccatctgaatcacgtgtactgagcgggctggcaaggcgcatagnnnn

SEQ ID NO: 270293 - DNA, 253 bp, Homo sapiens
  misc_feature: GYAE6OF02H4D1G.34.57.F02.1.454.CMB.1.raw
  modified_base (252)..(253): a, c, t, g, unknown or other
  misc_feature (252)..(253): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtggttaccccccaccttcggccaagggacacgactggagattaaacgaactgtggctgcaccatctgtcttcatcttcccgccatctgaatcacgtgtactgagcgggctggcaaggcgcatagnn

SEQ ID NO: 270294 - DNA, 572 bp, Homo sapiens
  misc_feature: GYAE6OF02JSRSU.34.57.F02.1.454.CMB.1.raw
tcagtacacgtgatcacgaccggtgctcgatttagctcgatatagttgggtttggggagtcagtcccagtcaggacacagcatggacatgagggtccccgctcagctcctgggctcctgctgctctggctcccaggtgccagatgtgacatccagatgacccagtctccatccttcctgtctgcatccataggagacagagtcaccatcacttgccggccatcaggacattagcaattattagcttggtatcaggtaaaaccaggggacgcccctaagctcctgatctcttccgcgtccatttacaaagtgggtcccacaagattcagcggcgttggatctggacagaattcactctcacaatcagcagtccgcggcctgaggactcgtgcggtcttattactgtcaacagtccttagtccggttaccccccacgtttccggacctaacgggccaaccggacctagggaacgtaacgtttaaaccggaacttcggtacgggtacctacggtacccgaaccgtaagttcccgttcgttaccgtttaccgaaccgttccgtttacccccgaccg

SEQ ID NO: 270295 - DNA, 493 bp, Homo sapiens
  misc_feature: GYAE6OF02JZC3I.34.57.F02.1.454.CMB.1.raw
  modified_base (264)..(264): a, c, t, g, unknown or other
  misc_feature (264)..(264): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgcgacatccagatgacccagtctccatccttctgtctgcatccataggagacagagtcaccatcacttgccgggcatcaggacattagcaattattagcttggtatcaggtaaaaccnggggacgccctaagctcctgatctcttccgcgtccattttacaaagtgggtcccacaagattcagcggcgttggatctgggacagaattcactctcacatcaagcagtccgcggcctgacggactctgcggcttattactgtccaacngcttagcgttaccccccnttcggcaacgggcacgctgganattaacgactggngctgcacatctcgcttcattcctcccgc

SEQ ID NO: 270296 - DNA, 254 bp, Homo sapiens; identical to SEQ ID NO: 270208
  misc_feature: GYAE6OF02JDJA5.34.57.F02.1.454.CMB.1.raw
  modified_base (252)..(254): a, c, t, g, unknown or other
  misc_feature (252)..(254): n is a, c, g, or t

SEQ ID NO: 270297 - DNA, 256 bp, Homo sapiens
  misc_feature: GYAE6OF02GFN2F.34.57.F02.1.454.CMB.1.raw
  modified_base (252)..(256): a, c, t, g, unknown or other
  misc_feature (252)..(256): n is a, c, g, or t
tcagtacacgtgatcacgaccggtgctcgatttagctcgatatagttgggtttgggacagaattcactctcacaatcagcagtccgcggcctgaggactctgcggcttattactgtcaacagcttagtggttaccccccaccttcggccaagggacacgactggagattaaacgaactgtggctgcaccatctgtcttcatcttcccgccatctgaatcacgtgtactgagcgggctggcaaggcgcatagnnnnn

SEQ ID NO: 270298 - DNA, 260 bp, Homo sapiens
  misc_feature: GYAE6OF02F4REO.34.57.F02.1.454.CMB.1.raw
  modified_base (252)..(260): a, c, t, g, unknown or other
  misc_feature (252)..(260): n is a, c, g, or t
tcagtacacgtgatcacgaccggtgctcgatttagctcgatatagttgggtttgggacagaattcactctcacaatcagcagtccgcggcctgaggactctgcggcttattactgtcaacagcttagtggttaccccccaccttcggccaagggacacgactggagattaaacgaactgtggctgcaccatctgtcttcatcttcccgccatctgaatcacgtgtactgagcgggctggcaaggcgcatagnnnnnnnnn

SEQ ID NO: 270299 - DNA, 521 bp, Homo sapiens
  misc_feature: GYAE6OF02HE25S.34.57.F02.1.454.CMB.1.raw
  modified_base (414)..(414): a, c, t, g, unknown or other
  misc_feature (414)..(414): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtcgggtccacaagattcagcgcgttggatctggacagaattcactctcacaatcagcagtccgcggcctgagactctgcggtacttattactgtacaangtcttaacgttccgttaaccccccacgtttccggaccaaacgggaccacggtacngganaacttaacgactgtaggctgacacatctgtccttcattcctcccgtac

SEQ ID NO: 270300 - DNA, 279 bp, Homo sapiens
  misc_feature: GYAE6OF02FY6I1.34.57.F02.1.454.CMB.1.raw
  modified_base (258)..(258): a, c, t, g, unknown or other
  misc_feature (258)..(258): n is a, c, g, or t
  modified_base (260)..(279): a, c, t, g, unknown or other
  misc_feature (260)..(279): n is a, c, g, or t
tcagtacacgtgatcacgaccggtgctcgatttagctcgatatagttggagtctgggacagaattcactctcacaatcagcacgtccgcggcctgaggactctgcggcttattactgtcaacagcttagtcggttaccccccacttcggccaagggtacacgactggagattaaacgaactgtggctgcaccatctgtcttcatcttcccgccatctgaatcacgtgtactgagcgggctggcaaggcgcataacgangnnnnnnnnnnnnnnnnnnnn

SEQ ID NO: 270301 - DNA, 899 bp, Homo sapiens
  misc_feature: GYAE6OF02G3005.34.57.F02.1.454.CMB.1.raw
tcagtacacgtgatcacgaccggtgctcgatttagctcgatatagttgggttgggggagtccagtcccagttcaggactacagcatggacgatgaggtccccgctcagactcctcgggctccgtgtcgtgctctggcgttccctaggttgcctagttaagtgtcgactagtccaggatgacccgagtctccgaattccggttcctcgttcgttcggccggggaccttaccgaattacggacgtacgtacgtaggttcctaccctaagtacccaaccttttcgggccccggggacccggtacttaccgtaaggggaacctaagtttaacggacctaaaggttttaaccgttttaaccggtaaccgtttcgggttaaccttaaccgggaaaaggggttaaaaacccccgtaaggggggaaccgtaccccggttaaacgggtcccttacccgtacggtaacttaccgttacccgtttaccggtaccgggttacctaacgtttttaaccgaaaacggtttcggggttacccctaacccgaaaggtacgtttccgaacggtacgggtaccggtttaggtacttacgttacgggaactacggtaacttacgaaccttactaactaacgtaactaaccgaacggtacctaacgtttaccggacgtccgtaaggacggtacctacgtcggacggtactttaactacgttcgtacctaactagtacctttaggtacccggtttaaccccccacgtttacccggtaccgtaaacgggtaccttaccggaacgttacgggggaattaacgtttaaaccggtaacggttccggtaacggtaccgttacggggacccgtaaccggtacgttccggttacgttccgttacctaccgtttcctacccggtaccc

SEQ ID NO: 270302 - DNA, 253 bp, Homo sapiens; identical to SEQ ID NO: 270293
  misc_feature: GYAE6OF02FKN0A.34.57.F02.1.454.CMB.1.raw
  modified_base (252)..(253): a, c, t, g, unknown or other
  misc_feature (252)..(253): n is a, c, g, or t

SEQ ID NO: 270303 - DNA, 519 bp, Homo sapiens
  misc_feature: GYAE6OF02GTMGV.34.57.F02.1.454.CMB.1.raw
  modified_base (406)..(406): a, c, t, g, unknown or other
  misc_feature (406)..(406): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccagggacgccctaagctcctgatctcttccgctccatttacaagtgggtccacaagattcagcggcgttgatctggacagaattcactctcacaatcagcagtccgcgcctgagactctgcggtcttattactgtcaacngcttagtccggttaccccccacgtttccggacctaagggaccacgactagggactattaaacgactggtacggtctggctaccatcctcgttccttcgattccctcccgtacc

SEQ ID NO: 270304 - DNA, 254 bp, Homo sapiens; identical to SEQ ID NO: 270208
  misc_feature: GYAE6OF02HFMS8.34.57.F02.1.454.CMB.1.raw
  modified_base (252)..(254): a, c, t, g, unknown or other
  misc_feature (252)..(254): n is a, c, g, or t

SEQ ID NO: 270305 - DNA, 255 bp, Homo sapiens
  misc_feature: GYAE6OF02F0HLP.34.57.F02.1.454.CMB.1.raw
  modified_base (253)..(255): a, c, t, g, unknown or other
  misc_feature (253)..(255): n is a, c, g, or t
tcagtacacgtgatcacgaccggtgctcgatttagctcgatatagttggatttgggacagaattcactctcacaatcagcagtccgcggcctgaggactctgcggcttattactgtcaacagcttagtggttacccccccaccttcggccaagggacacgactggagattaaacgaactgtggctgcaccatctgtcttcatcttcccgccatctgaatcacgtgtactgagcgggctggcaaggcgcatagnnn

SEQ ID NO: 270306 - DNA, 536 bp, Homo sapiens
  misc_feature: GYAE6OF02GN1Z1.34.57.F02.1.454.CMB.1.raw
  modified_base (412)..(412): a, c, t, g, unknown or other
  misc_feature (412)..(412): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttctgtctgcatccataggagacagagtcaccatcacttgccgggccgatcaggacattagcaattatttagcttggtatcaggtaaaaccaggggacgccctaagctcctgatctcttccgcgtccatttacaagtgggtcccacaagattcagcggcgttggatctgggacagaattcactctcacaatcagcagtccgcggcctgagactcgtgcggtcttattactgtcaacngtcttacgtcgttaccccccacttccggaccaacgggcaccgacgtggacgtaagttaacgaacgtggtaggcttacggacctaacccattcctcgttcctttaccacttccgttccccgtacc

SEQ ID NO: 270307 - DNA, 495 bp, Homo sapiens
  misc_feature: GYAE6OF02F4J83.34.57.F02.1.454.CMB.1.raw
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (409)..(410): a, c, t, g, unknown or other
  misc_feature (409)..(410): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggccgatcaggacattagcaattatttagcttggtatcaggtaaaaccaggggacgcccctaagctcctgatctcttccgcgtccattttacaaagtcgggtccacagattcagcggcgttggatctgggacagaattcactctcacaatcagcagtccgcggcctgagactntgcgnttatctgtcaacnncttagtcggtaccccccacgttcggccaacgggacacgactgggacattaacgatggtgctgcacatctgtctcactctccctac

SEQ ID NO: 270308 - DNA, 492 bp, Homo sapiens
  misc_feature: GYAE6OF02F04X2.34.57.F02.1.454.CMB.1.raw
  modified_base (413)..(413): a, c, t, g, unknown or other
  misc_feature (413)..(413): n is a, c, g, or t
  modified_base (453)..(453): a, c, t, g, unknown or other
  misc_feature (453)..(453): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaccaggggacgcccctaagctcctgatctcttccgcgtccatttacaaagtgggtccacaagattcagcggcgttggatctgggacagaattcactctcacaatcagcagtccgcggcctgacggactctgcggtcttatactgtcaacngcttagtcgttaccccccacttcgccaaggcacgactganataacgactggtgctgcacatctgtctcatcctccgtcc

SEQ ID NO: 270309 - DNA, 499 bp, Homo sapiens
  misc_feature: GYAE6OF02FXB0X.34.57.F02.1.454.CMB.1.raw
  modified_base (418)..(418): a, c, t, g, unknown or other
  misc_feature (418)..(418): n is a, c, g, or t
  modified_base (460)..(460): a, c, t, g, unknown or other
  misc_feature (460)..(460): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattatttagcttggtatcaggtaaaaccaggggacgcccctaagctcctgatctcttccgcgtccattttacaaagtggggtcccaccaagattcagcggcgtttggatctgggacagaattcactctcacaatcagcagtccgcggcctgaggactctgcggtcttattactgtcaacngcttagcgttaccccccacttcggccaagggcacgactgganattaacgactgtggctgcacatctgtcttcatctcccgc

SEQ ID NO: 270310 - DNA, 799 bp, Homo sapiens
  misc_feature: GYAE6OF02HUB9E.34.57.F02.1.454.CMB.1.raw
  modified_base (99)..(99): a, c, t, g, unknown or other
  misc_feature (99)..(99): n is a, c, g, or t
  modified_base (193)..(193): a, c, t, g, unknown or other
  misc_feature (193)..(193): n is a, c, g, or t
tcagtacacgtgatcacgaccggtgctcgatttagctcgatatagttgggtttggggagtcagtcccagtcaggacacagcatggacatgaggtcccgntcagctcctgggctcctgctgctctggctcccaggtgccagatgtgacatccagatgacccagtctccatccttcctgtctgcatccatagganacagagttccacctatcacgttggccgggtccatcgaaggacctagttagactaagttatttacgcttaggtactacgtaacggtaaaaaccgcggggtaacctaccccgtaaagtccgtaccgttaggaacttccgttccgttaccgtaccgttacctaacgtttttaaccgaaaacgggttcggggtacccctaacgtaacgtaacgtttccgaacggtccggtacggtttacggacgttccggttacgggaacctaaggtaactttaccgtaaccttcgtaaccgtaacgtaacgttacccggtaacggtaccgtaacgggtaccccggtacgggtacccgttacgggtaaaccgggtaccctttacggtacgggttaccggttaacctttaaacgtttaccggtacgttaaccctaaacggtccggttaccgttttaacggttccccggttaaccccccctaacggtttcccgggtaaccgtaaacggggtacccttaacggtaccgttagggtaaccgtaacgtttaaaccgcgttacgggtcgtaccgtcgtacctaacggtcttacgtagtacccgttagtacttccgttacccggtac

SEQ ID NO: 270311 - DNA, 494 bp, Homo sapiens
  misc_feature: GYAE6OF02F5XVP.34.57.F02.1.454.CMB.1.raw
  modified_base (413)..(413): a, c, t, g, unknown or other
  misc_feature (413)..(413): n is a, c, g, or t
  modified_base (455)..(455): a, c, t, g, unknown or other
  misc_feature (455)..(455): n is a, c, g, or t
  modified_base (461)..(461): a, c, t, g, unknown or other
  misc_feature (461)..(461): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtggggtcccacaagattcagcggcgttggatctgggacagaattcactctcacaatcagcagtccgcggctgaggactctgcgcttatactgtcaacngcttagtcggttaccccccacttcgccaagggcacgactganattaangaactgtggctgcacatctgtcttcatctcccg

SEQ ID NO: 270312 - DNA, 517 bp, Homo sapiens
  misc_feature: GYAE6OF02HD79V.34.57.F02.1.454.CMB.1.raw
  modified_base (274)..(274): a, c, t, g, unknown or other
  misc_feature (274)..(274): n is a, c, g, or t
  modified_base (485)..(485): a, c, t, g, unknown or other
  misc_feature (485)..(485): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattatttagcttggtatcaggtaaaaccaggggacncccctaagctcctgatctcttccgcgtccattttacaaagtgggtcccacaagattcagcggcgttggatctgggacagaattcactctcacaatcagcagtccgcggcctgacggactcgtgcggctttattactgtcaacagtccttagtccggttacccccccacgtttccgggaccaagggaccacgactggactattaacgatggnggctgccaccatctgtcttcacttcctcccgc

SEQ ID NO: 270313 - DNA, 496 bp, Homo sapiens
  misc_feature: GYAE6OF02JB7RC.34.57.F02.1.454.CMB.1.raw
  modified_base (414)..(414): a, c, t, g, unknown or other
  misc_feature (414)..(414): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtgggtcccacagattcagcgcgttggatctgggacagaattcactctcacaatcagcagtccgcggcctgacggactctgcggcttattactgtcaacngcttagtcgttaccccccacttcggccaagggcacgactggagattaacgactgtggctgcacatctgtctcatccttccgc

SEQ ID NO: 270314 - DNA, 524 bp, Homo sapiens
  misc_feature: GYAE6OF02IIXPO.34.57.F02.1.454.CMB.1.raw
  modified_base (276)..(276): a, c, t, g, unknown or other
  misc_feature (276)..(276): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagatcaccatcacgttgccgggccatcaggacattagcaattatttagcttggtatcgaaggtaaaaccaggggacncccctaagctcctgatctcttccgcgtccattttacaagtgggtccaacaagattcagcgcttggatcgtgggacagaattcactctnacaatcancagtccgcggctgaggactcgngcggnttacttacngtccaangactttagtccggttaaccccccncgttccggccaacggacacgactggaactataacgatgtaggcttacgaccacctgtactcggttactgaacttccttcccgacc

SEQ ID NO: 270315 - DNA, 513 bp, Homo sapiens
  misc_feature: GYAE6OF02HMQ5H.34.57.F02.1.454.CMB.1.raw
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (470)..(470): a, c, t, g, unknown or other
  misc_feature (470)..(470): n is a, c, g, or t
  modified_base (494)..(494): a, c, t, g, unknown or other
  misc_feature (494)..(494): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtggggtcccaccaagattcagcggcgttggatctgggacagaattcactctcacaatcagcagtccgcggcctgaggactcngcggcttattacngtcaacngcttagtcggttacccccccacgtttccggcccaagggccacggactaggganattaacgactggtggctggcaccntctgtcttcattctcccgc

SEQ ID NO: 270316 - DNA, 505 bp, Homo sapiens
  misc_feature: GYAE6OF02GMOX8.34.57.F02.1.454.CMB.1.raw
  modified_base (416)..(416): a, c, t, g, unknown or other
  misc_feature (416)..(416): n is a, c, g, or t
  modified_base (463)..(463): a, c, t, g, unknown or other
  misc_feature (463)..(463): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtggggtcccacaagattcagcggcgttggatctgggacagaattcactctcacaatcagcagtccgcggcctgaggactctgcggcttattactgtcaacngcttagtcggttaccccccacgttccggccaagggccacgactgganattaacgactgtggctgcaccatctgtccttcattcctccgc

SEQ ID NO: 270317 - DNA, 563 bp, Homo sapiens
  misc_feature: GYAE6OF02HA1YV.34.57.F02.1.454.CMB.1.raw
  modified_base (272)..(272): a, c, t, g, unknown or other
  misc_feature (272)..(272): n is a, c, g, or t
  modified_base (394)..(394): a, c, t, g, unknown or other
  misc_feature (394)..(394): n is a, c, g, or t
tcagtacacgtgatcacgaccggtgctcgatttagctcgatatagttgggtttggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattattagcttggtatcaggtaaaaccaggggacnccctaagctcctgatctcttccgcgtccattttacaaagtgggtaccacaagattcagcgcgttggatcgtggacagaattcactctcacaatcagcagtccgcgcctgagactctgacggnttaattactgtacaactgactttaggtccgttacccccccacgtttccggaccctaaggggacctaacgacttacgggaacgaagtttaaacgaaccgtggtacggaccttggaccctaacccgtagttcctacggttacctttacctaacgttccttccccggtaacc

SEQ ID NO: 270318 - DNA, 526 bp, Homo sapiens
  misc_feature: GYAE6OF02GXAII.34.57.F02.1.454.CMB.1.raw
  modified_base (273)..(273): a, c, t, g, unknown or other
  misc_feature (273)..(273): n is a, c, g, or t
tcagtacacgtgatcacgaccggtgctcgatttagctcgatatagttgggtttgggggagtcagtcccagtcaggacacagcatggacatgagggtccccgctcagctcctgggctcctgctgctctggctcccaggtgccagatgtgacatccagatgacccagtctccatccttcctgtctgcatccataggagacagagtcaccatcacttgccgggccatcaggacattagcaattattagcttggtatcaaggtaaaaccaggggacnccctaagctcctgatctcttcgcgtctatttacaagtcgggtcccacaagatcagcgcgttgatcgtggacagaatcactctacacaatcagcaggtccgcggcctgacgactcgtgcgtctttatacgtgtacacatcgttagtcccggttaccccccacgttccggaccaagggaccacggactgggaactaacgttaaccggactggtcgacctagccgaactctctcgttccttcacttcctcccgacc

SEQ ID NO: 270319 - DNA, 553 bp, Homo sapiens
  misc_feature: GYAE6OF02HQL65.34.57.F02.1.454.CMB.1.raw
  modified_base (412)..(412): a, c, t, g, unknown or other
  misc_feature (412)..(412): n is a, c, g, or t
tcagtacacgtgatcacgaccggtgctcgatttagctcgatatagttgggtttgggggagtcagtcccagtcaggacacagcatggacatgagggtccccgctcagctcctgggctcctgctgctctggctcccaggtgccagatgtgacatccagatgacccagtctccatccttcctgtctgcatccataggagacagagtcaccatcacttgccggcatcaggacattagcaattatttagcttggtatcaggtaaaaccagggacgcccctaagctcctgatctcttccgcgtccatttacaaagttgggtacccacaagattcagcggcgttggatctggacagattcactctcacaatcagcagtccgcggcctgacggtactctgcggtctttatactgtcaacngtaccttagtccggttacccccccacgttccggaccgaacgggaccaacgactacgggaagaacgttaaaccgacttacggtaggtcctagcctaacccgtagttcctaggttccttaccgacttcccttaccccgtaccg

SEQ ID NO: 270320 - DNA, 577 bp, Homo sapiens
  misc_feature: GYAE6OF02IU91O.34.57.F02.1.454.CMB.1.raw
  modified_base (276)..(276): a, c, t, g, unknown or other
  misc_feature (276)..(276): n is a, c, g, or t
  modified_base (412)..(412): a, c, t, g, unknown or other
  misc_feature (412)..(412): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtccaccatcacttgccgggccgatcaggacattagcaattatttagcttggtatcaggtaaaaccaggggacnccctaagctctgatctcttccgcgtccattttacaaagtgggtcccaccaagatcagcggcgttggatctgggacagaattcactctcacaatcagcagtccgcggcctgacggactctgccggtctttattacgngttacaactagtctttacggtaccggttaccccccctacgtttccgggaccgtaagggaccacggaacgtgggaacgtaacgtttaaaccgaacgttcggtacggaccttacggacctaaccgacttaccgttcgtttaccttacaacttccctttccccggacc

SEQ ID NO: 270321 - DNA, 506 bp, Homo sapiens
  misc_feature: GYAE6OF02GP320.34.57.F02.1.454.CMB.1.raw
  modified_base (419)..(419): a, c, t, g, unknown or other
  misc_feature (419)..(419): n is a, c, g, or t
  modified_base (441)..(441): a, c, t, g, unknown or other
  misc_feature (441)..(441): n is a, c, g, or t
  modified_base (465)..(465): a, c, t, g, unknown or other
  misc_feature (465)..(465): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtcgggtcccaccaagattcagcggcgttggatcgtgggacagaattcactctcacaatcagcagtcccgcggcctgaggactctgcggcttattactgtcaacngtcttagtccggttaccccccncttcggccaagggcacgactgganataacgactgtggctgcaccatctgtcttcattcctcccgc

SEQ ID NO: 270322 - DNA, 555 bp, Homo sapiens
  misc_feature: GYAE6OF02JB12Q.34.57.F02.1.454.CMB.1.raw
  modified_base (443)..(443): a, c, t, g, unknown or other
  misc_feature (443)..(443): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattattagcttggtatcaggtaaaaccaggggacgccctaagctcctgatctcttccgcgtccattttacaagtcggggtcccacaagattcagcggcgttggatcgtgggacagaattcactctcacaatcagcagtcccgcggcctgacggtactctgcggtcttattacctgtacaactcgtcttacgtccgttaccccccncgtttaccggcctaagggaccaacgtacctagggaactaacgtttaacgaacttgggtcggaccttgaccgtaacctagtccttagttccttctaacttccttccccgtacc

SEQ ID NO: 270323 - DNA, 528 bp, Homo sapiens
  misc_feature: GYAE6OF02HF6WH.34.57.F02.1.454.CMB.1.raw
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggcatcaggacatagcaattatttagcttggtatcaggtaaaccagggacgccctaagctcctgatctcttccgcgtccattttacaaagtgggtccacaagnttcagcggcgttgatctaggacagaatcactctcacaatcancagtccgcggcctgagactctgcgtcttattacngtcaacagtcttagtccggttaccccccacgtttccggaccaagggaccaacggacgtggaacgtaacgttaacgaactggtcggccttggccaaccgtagtccttgtccttcactttcctccccggtacc

SEQ ID NO: 270324 - DNA, 254 bp, Homo sapiens
  misc_feature: GYAE6OF02IVF5J.34.57.F02.1.454.CMB.1.raw
  modified_base (252)..(254): a, c, t, g, unknown or other
  misc_feature (252)..(254): n is a, c, g, or t
tcagtacacgtgatcacgaccggtgctcgatttagctcgatatagttgggtttgggacagaattcactctcacaatcagcagtccgcggcctgaggactctgcggcttattactgtcaacagcttagtggttacccccccaccttcggccaagggacacgactggagattaaacgaactgtggctgcaccatctgtcttcatcttcccgcatctgaatcacgtgtactgagcgggctggcaaggcgcatagnnn

SEQ ID NO: 270325 - DNA, 556 bp, Homo sapiens
  misc_feature: GYAE6OF02GMU0A.34.57.F02.1.454.CMB.1.raw
  modified_base (436)..(436): a, c, t, g, unknown or other
  misc_feature (436)..(436): n is a, c, g, or t
tcagtacacgtgatcacgaccggtgctcgatttagctcgatatagttgggtttgggggagtcgagtcccgagtcaggacacagcatggacatgagggtccccgctcagctcctggggctcctgctgctctggctcccaggtgccagatgtgacatccagactgacccagtctccactcccttcctggtctgcatccataggagacagagtcaccatcacttcgccgggccatcaggacattagcaattatttagcttggtaatcacggtaaaaccaggggaacgccccctaaagcctcctagtatctcttccgcgtccattttacaaagtggggtccccacaagacttcagcggcgttggactcgtgggacagaattcactctcacatcagcagtccgcggacctggagactcgtgcgtcttaattctgtccaacngtactttagtccggttaaccccccacgttccggaccaacgggactaccggacgtgggacgaacgttaacgactggtcggcttcgccaccagtcctgttccttccacttcctcccgtaccc

SEQ ID NO: 270326 - DNA, 784 bp, Homo sapiens
  misc_feature: GYAE6OF02ISX9Q.34.57.F02.1.454.CMB.1.raw
  modified_base (147)..(147): a, c, t, g, unknown or other
  misc_feature (147)..(147): n is a, c, g, or t
  modified_base (216)..(216): a, c, t, g, unknown or other
  misc_feature (216)..(216): n is a, c, g, or t
  modified_base (729)..(729): a, c, t, g, unknown or other
  misc_feature (729)..(729): n is a, c, g, or t
tcagtacacgtgatcacgaccggtgctcgatttagctcgatataggttggggttgggggagtcagtcccagtcaggacacagcatggacatgagggtccccgctcagctcctggggctcctgctgctgtggctccaggtgccaagtntgtgactatccgagatcgacccagtcctaccacttcccttccgtgtctcgactattccgaagtaggganaacaggtactccaacctactaccgttacgtccgggcccggaacgtactacggaacgtactaagttacgaacttaactttaagtttaagttcgtttaggtactaacggtaaacggtaaaccggaacgggaccgtaaccgtaacgtccctactagtacttccttaccgtccgttacgtacctttaacgttaacgaaacgggttccggttaccaacgtaaacggttacgttacgacggtccggtaggtttacgtagttcgggtacgaacgtaagttactacgtacctcgtaacgaacttaacgcgtacgtaccgtaagtcccgtccgtaaacttgggaacgttcctcgacgggtacctttaacgttagttaccgttacgacccaaaacgtttcgtaccgtttaccggttacccccgtaaacccctcgggttaacgaccggaaccgttaactccggtaaacgtgggaaacgtttaaccaacggtacgtaccggggtactactaccgggtaaaacccnccggtttagttaccgttcgggtaccttaccgtaacggtttccccccgtaacgtcc

SEQ ID NO: 270327 - DNA, 537 bp, Homo sapiens
  misc_feature: GYAE6OF02HLU5M.34.57.F02.1.454.CMB.1.raw
  modified_base (272)..(272): a, c, t, g, unknown or other
  misc_feature (272)..(272): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggcgatcaggacattagcaattattagcttggtatcaggtaaaaccaggggacncccctaagctcctgatctcttccgcgtccatttacaagtcgggtcccaccaagattcagcggcgttggatcgtgggacagaattcactctcacaatcagcagtccgcgctgagctngcgtnttatctgtacaacgtgcttagtccggttaccccccacgttccggacccaaggggccaaccggacttcggaagtaacttaacgaacttggtcgggcttaggccaaccgtattccgttacgttcttaccgacttccttccccgacc

SEQ ID NO: 270328 - DNA, 490 bp, Homo sapiens
  misc_feature: GYAE6OF02GCFRI.34.57.F02.1.454.CMB.1.raw
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattattagcttggtatcaggtaaaaccaggggacgcccctaagctcctgatctcttccgcgtccattttacaaagtggggtccaccaagattcagcggcgttggatctgggacagaattcactctcacaatcagcagtccgcggctgagactctgcggcttatactgtcaactgcttagtcgttacccccacttcggccaaggacacgactgganattaacgactgngctgcacatctgtctcatctccgc

SEQ ID NO: 270329 - DNA, 532 bp, Homo sapiens
  misc_feature: GYAE6OF02HAGO4.34.57.F02.1.454.CMB.1.raw
  modified_base (366)..(366): a, c, t, g, unknown or other
  misc_feature (366)..(366): n is a, c, g, or t
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattatttagcttggtatcaggtaaaaccaggggacgcccctaagctcctgatctcttccgcgtcctattttacaaaggttcgggtacccacaagattcagcggcgtggatcgtggacagaatcactcncacatcagcacgtccgcgcctgagctcngcgcttattactgcaacngtacttacgtccggttaccccctacgttcggccgaacgggacacggactaggaatacgttaacgacgttggtggtctacgccacctatcgttcgttccgttactacttccttacccgtcc

SEQ ID NO: 270330 - DNA, 556 bp, Homo sapiens
  misc_feature: GYAE6OF02HG4Y1.34.57.F02.1.454.CMB.1.raw
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattatttagcttggtatcaggtaaaccaggggacgcccctaagctcctgatctcttccgcgtccatttacaagtgggtcccacaagattcagcggcgttggatcgtgggacagaattcactctacacaatcagcagtccgcggcctgaggactcgtgcggtacttattactgtacaacngtcttagtccggttaccccccncttccgggaccaagggtaccacggactagggaactaacgttaacgaacgttcggtggtaccttcggacctaaccagttaccgttcggttccttaccgtacttcccttccccgtaccg

SEQ ID NO: 270331 - DNA, 500 bp, Homo sapiens
  misc_feature: GYAE6OF02FN0AR.34.57.F02.1.454.CMB.1.raw
  modified_base (413)..(413): a, c, t, g, unknown or other
  misc_feature (413)..(413): n is a, c, g, or t
  modified_base (432)..(432): a, c, t, g, unknown or other
  misc_feature (432)..(432): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattatttagcttggtatcaggtaaaaccaggggacgcccctaagctcctgatctcttccgcgtccattttacaaagtgggtcccacaagattcagcggcgttggatctgggacagaattcactctcacaatcagcagtccgcggcctgaggactctgcggcttatactgtcaacngcttagtcgttaccccccncgttccgccaagggccacgactggagattaacgactgtggctgcacatctgtcttcattccttccgcc

SEQ ID NO: 270332 - DNA, 504 bp, Homo sapiens
  misc_feature: GYAE6OF02GPUZ8.34.57.F02.1.454.CMB.1.raw
  modified_base (464)..(464): a, c, t, g, unknown or other
  misc_feature (464)..(464): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtgggtcccaccaagattcagcggcgttggatctgggacagaattcactctcacaatcagcagtccgcggcctgaggactctgcgcttatactgtcaacagcttagtcggttaccccccacgtttcggacctaagggaccacgactgganattaacgactgtgctgcacatctgtcttcactctccgtcc

SEQ ID NO: 270333 - DNA, 515 bp, Homo sapiens
  misc_feature: GYAE6OF02GHOGL.34.57.F02.1.454.CMB.1.raw
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (491)..(491): a, c, t, g, unknown or other
  misc_feature (491)..(491): n is a, c, g, or t
tcagtacacgtgatcacgaccggtgctcgatttagctcgatatagttgggtttgggggaggtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaaggtaaaaccgaggggaccgcccctaagctcctgactctcttccgcgtcctattttacaaagtgggtcccacaagattcagcggcgttggatctgggacagattcactctcacaatcagcagtccgcgctgacgactctgcggtnttattcngtacaacngtcttacggtccgttaccccccacgttcggccaagggccacgctagggacaattaacgactgtgctgacacngtctgtaccttcacttcctcccgc

SEQ ID NO: 270334 - DNA, 580 bp, Homo sapiens
  misc_feature: GYAE6OF02I1N6J.34.57.F02.1.454.CMB.1.raw
  modified_base (270)..(270): a, c, t, g, unknown or other
  misc_feature (270)..(270): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
  modified_base (387)..(387): a, c, t, g, unknown or other
  misc_feature (387)..(387): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggcatcaggacatagcaattattagcttgtatcaaggtaaaccaggggaccnccctaagctctgatctcttccgcgtcctatttacaagtgggtcccacagatcagcgngttgatcgnggacagaatcactctacacaatcagcagtccgcggtcctgacggtactcgnggccggtcttagttactcgtactaacgtcgtccgttaagtcccgttaaccccccgtacgtttccggaacccgtaaacgggaccctaacggacgttagggaacgtaaacgttaaaccggaacttgggtacggccttacgaccctaaccgtacgttccgtacgttccgttacacgtttcccgttccccgtaaccg

SEQ ID NO: 270335 - DNA, 536 bp, Homo sapiens
  misc_feature: GYAE6OF02GHBAI.34.57.F02.1.454.CMB.1.raw
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (447)..(447): a, c, t, g, unknown or other
  misc_feature (447)..(447): n is a, c, g, or t
  modified_base (520)..(520): a, c, t, g, unknown or other
  misc_feature (520)..(520): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggcatcaggacattagcaattattagcttggtatcaggtaaaaccaggggaccgacccctaagcctcctgactctcttccgcgtccattttacaaaggtcgggtacccacaagattcagcggcgttggatcgtggacagaattcactctcacaatcagcacgtccgcggtcctggacgactcgnggcggtnttatactgtacaactgtccttagtccggttaccccccncgttcggaccaagggccacgacgtggaacgtaacttaacgactggtaggcttcgacctaccatctcgtccttnacttccctcccgtacc

SEQ ID NO: 270336 - DNA, 535 bp, Homo sapiens
  misc_feature: GYAE6OF02GIMOS.34.57.F02.1.454.CMB.1.raw
  modified_base (397)..(397): a, c, t, g, unknown or other
  misc_feature (397)..(397): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggccgatcaggacattagcaattatttagcttggtatcaggtaaaaccagggacgcccctaagctcctgatctcttccgcgtccattttacaagtgggtcccacaagattcagcggcgttggatcgtgggacagtaattcactctcacaatcagcagtccgcggctgagactctgcgtnttatactgtcaacagtcttaacgtccggttaacccccctacgttccggaccaacggggacaccggactaggatacgttaacgactggtggacctggaccacctattcctcgttccttacactttcccttaccccgacc

SEQ ID NO: 270337 - DNA, 574 bp, Homo sapiens
  misc_feature: GYAE6OF02HCGBS.34.57.F02.1.454.CMB.1.raw
  modified_base (197)..(197): a, c, t, g, unknown or other
  misc_feature (197)..(197): n is a, c, g, or t
  modified_base (439)..(439): a, c, t, g, unknown or other
  misc_feature (439)..(439): n is a, c, g, or t
  modified_base (505)..(505): a, c, t, g, unknown or other
  misc_feature (505)..(505): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccatagganacagagtcaaccatcacttggccgggccgatcaggacattagctaaattatttagctttggtatacgtaaggtaaaaccaggggacctccccgtaaagcctcctgactctcttccgcgtcctattttacaaaggtcgggtaccacaagattcagtcggcgttggatcgtgggacagtacttcactctcactaatcagcacgtccgcgcctgacgactcgtgcgtcttaagttctgtacaacngtacttacgtccgttaaccccccctacgtccggtaaccgaagggtaacctacggacgtacgggaanaacgttaacgactacggtagccgtacgcctaaccgattccgtgttaccttcgacttcccgtaccctacg

SEQ ID NO: 270338 - DNA, 536 bp, Homo sapiens
  misc_feature: GYAE6OF02ILGUL.34.57.F02.1.454.CMB.1.raw
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (338)..(338): a, c, t, g, unknown or other
  misc_feature (338)..(338): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattattagcttggtatcaggtaaaccagggacgccctaagctcctgatctctccgcgtccatttacaagtcgggtccacaagntcagcggngttggntcngggactagattcactctacacaatcagctacgtccgcggctgacgctcgcgcggtcttacttactcgtacaactagtcttagtcccgttaccccccacgttccggaccgaagggaccacgacgtggaacgtaacttaacgaacgtggtggcctggtaccaccgtactcgttacgttccttaccacttccctacccgcc

SEQ ID NO: 270339 - DNA, 551 bp, Homo sapiens
  misc_feature: GYAE6OF02HBW89.34.57.F02.1.454.CMB.1.raw
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (332)..(332): a, c, t, g, unknown or other
  misc_feature (332)..(332): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggcgatcaggacattagcaattattagcttggtatcaggtaaaacngggacnccctaagctccngtactctctccgctactattaacagtcggtaccacgatatcagcgtgtgntcgtgacagtatcactctacanactcagcagccgcgtcgngaacgtntcgngcgtacttatctcacagtctagttacgtacccgttaccccctagttcccgaacgacggtaacaccggtacgtacggtaacgtaacttaaccgtaacgtggcggtacctacggtaacccaaccgtacgtccttaggttaacccttcgtaccttccccgttccgtaaccc

SEQ ID NO: 270340 - DNA, 766 bp, Homo sapiens
  misc_feature: GYAE6OF02JQNNE.34.57.F02.1.454.CMB.1.raw
  modified_base (249)..(249): a, c, t, g, unknown or other
  misc_feature (249)..(249): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcacatcacttgccggccatcgaggactattagctaattattagtnttggtatcgaaggtaaaaccgacgggaccgacccctaagcctcgtagacttcctccgttccgcgttacctaacttttaacgaaacggttcgggtacccaacgtaagacttacgacggtcggtacgtttacggtactcggtacgggtaactaggtaaactttccaaccgttacctacgtaaccgtaaataccgacgtaccgtaaccggtcccggaccggtacccgtagggtaacggtaccgttccggtacggtaccggttacctttaaacgtttaccgttacggttaaccctaaacgttacgttaccggttttaacccgggttacccccggtttaacccccccgttaacggttaccccggggtaaccgtaaccggggtaaccctaccggtaaccgttaacggggtaaccgttaaacgttaaccgtaacggttcgggttaccggtaaccttacgggaaccctacttacgttccgttacggttcctttaccgtaccgtttacccgttacccgttaacccg

SEQ ID NO: 270341 - DNA, 780 bp, Homo sapiens
  misc_feature: GYAE6OF02FUWBS.34.57.F02.1.454.CMB.1.raw
  modified_base (268)..(268): a, c, t, g, unknown or other
  misc_feature (268)..(268): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggcgatcaggacattagcaattattagcttggtaatcaaggtaaaaccnggggaccgcccctaagctcctagacttctcttcccgcgttacctattttaacgaaagttcggggtcccaacaagtacttacgaggccgggtacgttggacttcgtagggactaaggtaactttaccgacttccgtacctaaccgtaaacttccaacggtacctaacgggttcccccggtaccggggtaccccgttagggaaccgggtaaccgtttcccgtacgggtacccggggttacctttttaaacgtaacccgtttagggttaacccaaacgtacggtttacccgtttaaacggtttcccccgggtttaaaccccccccctaccggttttacccggggaacccgtaaaccgggggtaccctaacggggtaacccgttaggggaaccgttaaacgtttaaaccgggaacccgttagggttaccgggtaccgttaccggaacccgttaacccgaacgtttccgttaccggtttacctttaccctaacgtttccccgttacccccgtacccg

SEQ ID NO: 270342 - DNA, 688 bp, Homo sapiens
  misc_feature: GYAE6OF02HLE1P.34.57.F02.1.454.CMB.1.raw
  modified_base (244)..(244): a, c, t, g, unknown or other
  misc_feature (244)..(244): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccatacggagacagatcaccatcacttgccggcatcaggacattagcaattattancttggtactcaacggtaaaaccgaggggaccacccgtaagctcctgactctcttccgcgtcctaattttaccaagtcgggtaccaacaagacttcgaacgcggtacgtttgggacttcgacggaacaggtaaactttcaacttcctacacaacttccaagctacggtccgcggtactgaacggacttcgaggtccggtactttaactacgttacgttaccgaacgtactacccggtttacggttacccggtttaaccccccccaccggtttaccgggaaccccgaaagggggttaccaaccggtaacggttaaacgggaacgttaaacgttaaacccgggtaacgtttccgggtaaggggtaccctacggtaacccgaaacccttaacggtttctaaccgggttctttaaccccggtaacttttccccccgttaccgtaacccg

SEQ ID NO: 270343 - DNA, 614 bp, Homo sapiens
  misc_feature: GYAE6OF02HCOBE.34.57.F02.1.454.CMB.1.raw
  modified_base (196)..(196): a, c, t, g, unknown or other
  misc_feature (196)..(196): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttctgtctgcatccatagganacagagtcaccatcacttggccgggccatcaggacattagcaattatttagcttggtatacgaggtaaaaccaggggaccgaccctaagctcctgactctctccgcgtcctatttacaaagtcgggtacccacagtattcgagcggtcgttggatcgtgggacagattcactctcacaatcagcagtccgcgcctgagactctaggcgtacttacttactcgtacaaacgtagtacctttaacggtcccggtttaacccccccctacgtttacccgggacccgtaaacggggtaaccctaaccggtaacgtacgggaacgtaaacgtttaaaccggaactttgggtacggtaccgttacggaccctaaccgtagttccgttacgttccctttaccgactttccccgttaccccgtacc

SEQ ID NO: 270344 - DNA, 518 bp, Homo sapiens
  misc_feature: GYAE6OF02H5NF3.34.57.F02.1.454.CMB.1.raw
  modified_base (264)..(264): a, c, t, g, unknown or other
  misc_feature (264)..(264): n is a, c, g, or t
  modified_base (502)..(502): a, c, t, g, unknown or other
  misc_feature (502)..(502): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttctgtctgcatccataggagacagagtcaccatcacttgccgggcatcaggacattagcaattatttagcttggatcaggtaaaaccngggacgcccctaagctcctgatctcttccgcgtccattttacaagtgggtcccacaagattcagcggcgttggatctgggacagattcactctcacaatcagcagtccgcggcctgaggactctggcgtcttatactgtcaacagcttacgtcggttaaccccccacgttccgggaccaacgggtacacgactagggatattaaacgacgtagtggctggacaccattctcgtccttnacttcccttccgtacc

SEQ ID NO: 270345 - DNA, 497 bp, Homo sapiens
  misc_feature: GYAE6OF02JEBMA.34.57.F02.1.454.CMB.1.raw
  modified_base (482)..(482): a, c, t, g, unknown or other
  misc_feature (482)..(482): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttctgtctgcatccataggagacagagtcacatcacttgccggccgatcaggacattagcaattatttagcttggtatcgagtaaaaccaggggacgccctaagctcctgatctctccgcgtccatttacaaagtcgggtccacagattcagcggcgtgatctggacagtatcactctcacatcagcagtccgcgcctgacgctcgtgcgtcttatactgtcaatacgcttacggtccgttacccccacgtttccgaccgaacgggacacgactggataactaacgactgtgcctagccacatactntctacattcctcctc

SEQ ID NO: 270346 - DNA, 498 bp, Homo sapiens
  misc_feature: GYAE6OF02FNBIP.34.57.F02.1.454.CMB.1.raw
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
  modified_base (469)..(469): a, c, t, g, unknown or other
  misc_feature (469)..(469): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccatttacaaagtggggtcccaccaagattcagcggcgttggatctgggacagaattcactctacacaatcagcagtccgngcctgaggctctgcggcttatactgtcaanagcttagtcgttaccccccacttccggccaagggacacgactgagataacgactgngctgcaccatctgtctcactcttcccgcc

SEQ ID NO: 270347 - DNA, 564 bp, Homo sapiens
  misc_feature: GYAE6OF02F7PX3.34.57.F02.1.454.CMB.1.raw
  modified_base (277)..(277): a, c, t, g, unknown or other
  misc_feature (277)..(277): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggccatcaggacattagcaattatttagcttggtatacaaggtaaaaccgaggggaccncccctaagcctcctgatctctccgcgtcctatttacaagtcgggtacccacgaagtacttcagcggtcgttggatcgtgggacagtaattcactctacacaatcagcacgtccgcggcctaggacgctcgtgcgtactttattactcgtaccaactacgtcctttacgtcccgttacccccctaccgttaccggaccgaacgggacgaccgtacgtaggaacgtaacgttaacgacgtggtcggactcgacctacctatcgtcgttccttactcttcctccctaccg

SEQ ID NO: 270348 - DNA, 534 bp, Homo sapiens
  misc_feature: GYAE6OF02FG36Z.34.57.F02.1.454.CMB.1.raw
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcacatcacttgccgggcatcaggacattagcaattatttagcttggtatcaaggtaaaaccaggggaccgccctaaggctcctgactctctccgcgtctatttacaagtcgggtcccacaagacttcagcggcgttggatcgtgggacagaacttcgactctcacatacagcacgtccgnggcctggacgactcgcgcggtacttacgtactntaccaactcgtctttacgtcccgtaccccctcgtaccggactaacgggacacgtacgtcgaagtacttaacgctggtcggactgcactatcctgttccttcacttccctaccgtacc

SEQ ID NO: 270349 - DNA, 574 bp, Homo sapiens
  misc_feature: GYAE6OF02GLHF4.34.57.F02.1.454.CMB.1.raw
  modified_base (276)..(276): a, c, t, g, unknown or other
  misc_feature (276)..(276): n is a, c, g, or t
  modified_base (400)..(400): a, c, t, g, unknown or other
  misc_feature (400)..(400): n is a, c, g, or t
  modified_base (555)..(555): a, c, t, g, unknown or other
  misc_feature (555)..(555): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggcgatcaggacattagcaattatttagcttggtatcgaacgtaaaaccaggggaccncccctaagcctcctgatctctccgctccatttacaagtcgggtacccacaagattcagcggcgttggactcgtgggacagaacttcactctacacaatcagcacgtccgcgctgacgactcgtnacggtcttatacttgtaccaatcgtcgtttaagtccggttaacccccctacgtttaccggacctaacggggacaccggtactacgggtagaaaccgtttaacgaacgttggtaaccgggtctaggtacccaccaattccgttcgttccgtttacncgttacccttacccgtaac

SEQ ID NO: 270350 - DNA, 283 bp, Homo sapiens
  misc_feature: GYAE6OF02FPGT9.34.57.F02.1.454.CMB.1.raw
  modified_base (253)..(257): a, c, t, g, unknown or other
  misc_feature (253)..(257): n is a, c, g, or t
  modified_base (259)..(283): a, c, t, g, unknown or other
  misc_feature (259)..(283): n is a, c, g, or t
tcagtacacgtgatcacgaccggtgctcgatttagctcgatatagttgggatctgggacagaattcactctcacaatcagcagtcctcggcctgaggactctgcggcttattactgtcaacagcttagtggttacccccccacttcggccaagggacacggactggagattaaacgaactgtggctgcacatctgtcttcatcttcccgcatctgaatcacgtatactgagcgggctggcaaggcgcatagcnnnnncnnnnnnnnnnnnnnnnnnnnnnnnn

SEQ ID NO: 270351 - DNA, 637 bp, Homo sapiens
  misc_feature: GYAE6OF02IFGSC.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttcggccgggcatcgaggacattagactaatttatttagtcttaggtactacgaaggtaaaaccgagggggaccaccccctaagccttccgtagtacttcctccttcccgcgttacctaacttttaacgaaacggtcggggtacccaaccgtaaagtacttacgaggtccggtacggtttggaacgtcgtagggtacaagtaacttaccacttctcaactatcgaacgctacggtcccgacggccgtaggtacggtactccgtggtccggtactttaacgttacctagtaccaacgtagtccgttacggttaccccgttaaccccctcgttaccggccgaacgggaccacgtacgtacggaagtaacgtaacgtacgtgtcggctacgccacctatcgttgttaccttcactttccctcgtacc

SEQ ID NO: 270352 - DNA, 689 bp, Homo sapiens
  misc_feature: GYAE6OF02J0JUB.34.57.F02.1.454.CMB.1.raw
  modified_base (140)..(140): a, c, t, g, unknown or other
  misc_feature (140)..(140): n is a, c, g, or t
  modified_base (290)..(290): a, c, t, g, unknown or other
  misc_feature (290)..(290): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtnccagatgtgacatccaggatgacccagtctccatccttcctgtctgcatccataggagacagatcaccatcacttggccggcgatcaggacatagcattatttagcttggtatcaggtaaaccgaggggaccgacccctaaggtctaccncgtatctccgttccgcgtccattttacaacgtcgggtcccacgaatacttcgacgtgggtcgtttaggacgtcgttacgggacaggtaattctaacttccgtacctactaacttacaggcctacggtaccgtcccgggactacgggtacggtaacgtccggttacgtccgggtcttttacttaacggttctacccgaaacgtaccggtatttaccgggttacccggtttaccccccccgaacgtttcccgggaaccggtaacgggtaccaaccggtacgtacgggtaacgtaaccgttaaacggaacttgggtaaccgtccggtacgtaccccgtaacgtacccgttacgtttcccggttacgttttacccgtagtttaccccgtttaacccccggtcc

SEQ ID NO: 270353 - DNA, 262 bp, Homo sapiens
  misc_feature: GYAE6OF02HDVDG.34.57.F02.1.454.CMB.1.raw
  modified_base (247)..(247): a, c, t, g, unknown or other
  misc_feature (247)..(247): n is a, c, g, or t
  modified_base (254)..(262): a, c, t, g, unknown or other
  misc_feature (254)..(262): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtcggttacccccccacttcggccaagggacacgactggagattaaacgaactgtggctgcaccatctgtcttcatcttcccgccatctgaatcacgtgtactgagcgggctggcaaggcncaatagnnnnnnnnn

SEQ ID NO: 270354 - DNA, 676 bp, Homo sapiens
  misc_feature: GYAE6OF02H4KH8.34.57.F02.1.454.CMB.1.raw
  modified_base (199)..(199): a, c, t, g, unknown or other
  misc_feature (199)..(199): n is a, c, g, or t
  modified_base (435)..(435): a, c, t, g, unknown or other
  misc_feature (435)..(435): n is a, c, g, or t
tcagtacacgtgatcacgaccggtgctcgatttagctcgatatagttgggtttggggagtcagtcccagtcaggacacagcatggactatgagggtccccgctcagctcctggggctcctgctgctctggctcccaggtcgccagatgtgacatccagatgacccagtctccatccttcctgtctgcatccataggganactagactcacctatcaacttcggccgggtcatcgaggactagttacgctaatttattagtcttacggtataccgaaaggtaaaaccgtacgggggaccaaccccgtaagcccttaccgtgtactcctcgttccgtcctacctattttacgaacggtcgggtacccaacgaagtacttcgacgtcggtacgtttaggactacgtacgggtacaagtacttcacgttcacaataacncgtagctacggtccgtcgcctaggacgtacgtgtcgtacggttacttaccgtttcacgttaaccacgtacgtaccgttaccggtacccgggtttaccccaccggtttaccggaaccgtaacgggtaaccaccggtacggttaacggtaacgtaaccgtaaacggtacgttcggtaacggtccttagacccgttaacctcgttaccgttcgttcccttacgtacgttcccttacccgtaacc

SEQ ID NO: 270355 - DNA, 575 bp, Homo sapiens
  misc_feature: GYAE6OF02GDNNL.34.57.F02.1.454.CMB.1.raw
  modified_base (432)..(432): a, c, t, g, unknown or other
  misc_feature (432)..(432): n is a, c, g, or t
tcagtacacgtgatcacgaccggtgctcgatttagctcgatatagttgggtttgggggagtcagtcccagtcaggacacagcatggacatgagggtccccgctcagctcctgggctcctgctgctctggctcccaggtgccagatgtgacatccagatgacccagtctccatccttcctgtctgcatccataggagacagagtcaccatcacttgccggcgatcaggacattagctaattatttagcttggtatcaaggtaaaaccaggggacgcccctaagcctctagatctcttccgcgtctatttacaagtcgggtacccacaagatcagcggtcgttggatcgtagggacagtaattcactctacactaatcagcacggtcccgacggtcctaggacgtactctcggcggtacttatactgtacaacngtacttacgtccggttacccccctacgttaccggaccgtaacgggaccacgtacgtacggaacgtaacgttaacgacgtcggtacggctacgtaccaccgtagttcgttacgttaccttactactttcccgttacccgtaccg

SEQ ID NO: 270356 - DNA, 718 bp, Homo sapiens
  misc_feature: GYAE6OF02IJIGE.34.57.F02.1.454.CMB.1.raw
tcagtacacgtgatcacgaccggtgctcgatttagctcgatatagttggggtttgggggagtcagtcccagtcaggacacagcatggacatgagggtccccgctcagctcctggggctcctgctgctctggctcccaggtgccagatgtgacatccagatcgacccagtctccatccttcctgtctgcatccaagtaggagacagacgtcaccatcacgttcggccgggcatcgaggactattagctaatttattagtcgttaggtatacgaaggtaaaccgacggggaccacccctaagcttaccgtagtacttacgtccgttccgtaccgttaccttaagttttaacgaaaacggttcggggtaacccctaacgtaaacggttactcgaacggtccggtacggttaggtacgttcgtagggtaacaagttaacttaccgtactactaccgaactaacgtactaacggccgtaaccggtccgggccggtacctagggtaacggtaccgtcggtcggtacgggttactttaacgtttaccgttacgtaccaaacgtcgttaccgtttacggttaccccggttaccccccgtaccgttaaccggaccggtaacgggaccgaacgtacgtaaggtaacgtaacgttaacgtaacgtggtacgacgtcgacccgtactacgttcgttacgttccgttacctacgtttcccgtccgtaaccg

SEQ ID NO: 270357 - DNA, 755 bp, Homo sapiens
  misc_feature: GYAE6OF02HC883.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaaccatcacgttggcccgggaccatcgaggactaattacgactaatttaatttagacctttaggtaatacgtaaacggtaaaacccgacggggaccgaccccctaaagtccctaccgtagtactccgttaccttcccgcgttcccttaagttttaaccgaaacggttccggggtacccctaaccgtaacgtacttcgaacggtccgggtcggtttaggacgttcggtagggacctaaggtaactttccaaccttccgtactaaccaattccgacgtcgtaccggtccggcccggtcgtacggacgtaccgtcgtcggtccgttactttaacgtaccttgtaacctaacgtacgttaccggttaccgttaccccggttaaccccccctaccggttacccggaacccggtaacgggacctaaccgggtacgttacgggaaacgtaaccgttaaaccggacgtacgggttacggtaccgtaccgacccgttaacccgtcgtttaccgtttcgttacccgtttacttaacccgttcccgttaccccgttaaccg

SEQ ID NO: 270358 - DNA, 531 bp, Homo sapiens
  misc_feature: GYAE6OF02FH0D2.34.57.F02.1.454.CMB.1.raw
  modified_base (424)..(424): a, c, t, g, unknown or other
  misc_feature (424)..(424): n is a, c, g, or t
  modified_base (445)..(445): a, c, t, g, unknown or other
  misc_feature (445)..(445): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttggccgggccatccgaggacattagcaattatttagcttggtatcaaggtaaaaccgaggggacgcccctaagctcctgatcctcttccgcgtccattttacaagtcgggtcccacaagattcagcgcgttggatcgtgggacagaattcactctacacaatcagcagtccgcggcctggacggactctgcggtcttattcttgtacaangtcttacgtccgttacccccncgttccggccaagggaccacgactggactaagttaacgactggtacgctgacctacagtctcgttcttacgcttcctcccgtaacc

SEQ ID NO: 270359 - DNA, 874 bp, Homo sapiens
  misc_feature: GYAE6OF02FZ9XR.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatcgacccagtctccatccttcctgtctgcatccataggagacagtagtcaccatcacgttgccgggccatcgagactattagactaatttatttagtcttggtaactacgaagggttaaaaacccagggggaccgtaccccgtaagtcccttccgtgacttccgttccttccggccgttaccttaattttaaccgaaacgggttccgggggttaccccaaccgtaaagtactttaccgaaggtacccgggttcggtttacgggtacgtttccggtacggggtaaactaacggtaaactttacccgtaacccttacccgttaaccaaaccgtaaacctacccgtaacggtacccgtaaccgggttccccgggtacccggggtcccgttacgggaaccgggttacccgttccggtaccggggtaccgggtttacctttttaaccggtttaccgtttacggttaacccgtaaaccgtaaccggtttacccggttttaacccgggtttaccccccgggtttaaaccccccccttcccggtttaccccggggaacccggttaaacggggaccccgtaaaccggtaaccggtacgggtaaacgttaaccgtttaaaccgtacggttacgggtacgggtaccttaccgggtaaccctaacccgttatttcccgttaccggtttccctttaccgtaccgttttcccccgttaccccggtaaccc

SEQ ID NO: 270360 - DNA, 525 bp, Homo sapiens
  misc_feature: GYAE6OF02FS048.34.57.F02.1.454.CMB.1.raw
  modified_base (206)..(206): a, c, t, g, unknown or other
  misc_feature (206)..(206): n is a, c, g, or t
  modified_base (357)..(357): a, c, t, g, unknown or other
  misc_feature (357)..(357): n is a, c, g, or t
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
tcagtacacgtgatcacgaccggtgctcgatttagctcgatatagttggggtttgggggagtcagtcccagtcagggaccacagcaatggacatgagggtcccccgctctagctcctggggctcctgctgctctggctcccaggtgccagatgtgacatccagatgacccagtcctccatcccttcctgtctgcatccaatagganacagatcaccatcacttggccggcatcaggacattagcaacttatttagcttggtatcaggtaaaaccaggggacgcccctaagctcctgatctcttccgcgtcctatttaacaaagttcgggtcccacaagattcagcgcgttggatcgnggacagaatcactctcacaatcagcagtccgcgctgagactctgcgtnttatctgtcaanacgtcttacgtccgttaccccccacgttccgaccgaagggtacacgtacgtggagtacgttaaacgactgtcgctcgcaccatcgtctacttcacttcctcccctacc

SEQ ID NO: 270361 - DNA, 896 bp, Homo sapiens
  misc_feature: GYAE6OF02G828N.34.57.F02.1.454.CMB.1.raw
  modified_base (103)..(103): a, c, t, g, unknown or other
  misc_feature (103)..(103): n is a, c, g, or t
tcagtacacgtgatcacgaccggtgctcgatttagctcgatatagttggggtttgggggagtcagtcccagtcaggacacagcatggacatgagggtccccgntcagctcctgggctcctgctgctctggctcccaggtcgccagatgtgacatccagatcgacccagtcctccattcccttcctgtctgccatccataggacacagagtccaccatcacttcgccgggccatcaggacattagctaagttatttagactttaggtactacgaagggtaaaaaccgacggggaaccgacccctaaaggtccttaccgtgtaattccttccgtttcccggcgttacctaacgtttttaaccgaaaacgggttccgggggttacccctaaccgtaaacggtacttttaccgaacggtccgggtaccggtttagggaactttccggtttaggggaacctaacggtaaaacgtttcccgtaacccttaccgttacccaaaccgttaaacgtttaccgaacgggtacctaaaccgggttccccgggtccggggtaccccgtttacgggaaacgggtaacccgttccgtacgggtaccggggttaccttttaaacgtttaccgttaccggttaaccgtaaaccgtacggtaccttttaaccgggttaccccgggtttaacccccccccgttaacccggttttaccccgggaacccggtaaaccggggtaacccgtaacccgggtaaccgttaacggggttaaccggttaaaacggtttaaacccgggtaaaccggtttacgggttacgggttaccgttacggtacccgtaacccgttaacgttaccgttaccggttaccctttacccggttaaccctttccccggttcccccggttaacccg

SEQ ID NO: 270362 - DNA, 767 bp, Homo sapiens
  misc_feature: GYAE6OF02HT566.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctccgtggggctcctgctgctctggctcccaggtgccagatgtgacatccagatgacccagtctccatcccttctgtctgcatccataggagacagagtccaccatctacgttcggcccgggtcatcgaacggactattagactaatttatttagtcgttaggtacttacgaaacggtaaaaccggacggggaacccgtacccctaacgtccttacccgtagtacgttccttccgttcccgtaccgttacccttaaacgttttaaccgtaaacgggttcccggggtaacccctaacccgtaaacgtacgtttaccgacggtccggggttacggtttacggtacgttcgtacgggaactaaggtaactttaccgtaccttaccgtacaacgtaacgtacgtaccgacgtaccggtccccggtaccgggtacccgttacggaacggtaaccgttccggtcgggtaccggttaccttttaacgtttaccgttacgttaccgaacgtacgtaccgtttaccggttaccccgttaccccccgtaccgttacccggaccgtaacggacgtaccgtacgtaggtaacgtaaccgttaacgacgttaggtcgtaccgtcgacccgtacctagttcgttaccgttcttacctacccgttcctacccgtac

SEQ ID NO: 270363 - DNA, 549 bp, Homo sapiens
  misc_feature: GYAE6OF02G6AB0.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttctgtctgcatccataggagacagagtccaccatcacttcggccgggccatcgaggacattagctaattatttagctttggtattcaaggtaaaaccaggggaccacccctaagctacctgacttcctccttccgcgtcctattttaacgaaggtcgggtcccacaagtctacgagcggtcgttggatcgtggacagaattcactctcacaatcagcacgtccgcggcctggacgctcgtgcgtcttatctctcactgtcttacgtccgttaccccccacgttccgccgtaacggccacgacgtaggacgtaacgttaacgacgtggtgccgtacgaccactattctacgttccttacacttccctccgtacc

SEQ ID NO: 270364 - DNA, 750 bp, Homo sapiens
  misc_feature: GYAE6OF02IVUAF.34.57.F02.1.454.CMB.1.raw
  modified_base (167)..(167): a, c, t, g, unknown or other
  misc_feature (167)..(167): n is a, c, g, or t
  modified_base (205)..(205): a, c, t, g, unknown or other
  misc_feature (205)..(205): n is a, c, g, or t
tcagtacacgtgatcacgaccggtgctcgatttagctcgatatagttgggtttgggggagtcagtcccagtcaggacacagcatggacatgagggtccccgctcagctccgtgggctcctgctgctctggctcccaggtcgccagatgtgacatccagatcgacccngtcctccacttccttcctgtctcgctatccagtagganacagatccacatcacgttcggccgggccatcgaggactattacgactaatttattacgtagtttaggtaactacgaaacggttaaaaacccggaggggtaccctaccccgtaaggtccttaccgtaggtaacttccttaccgttccgtacgttaccttaacttttaaacgaaacgggttccgggtaaccccaacgtaaaggtaccttacgaccggtcgggttacggtacggtaacttccgggttaaggaacgtaacggtaacctttacctaaccgttccgtaaactaaccgtaaacgtcgaacgtacccgtaaccggtccgggtaaccgtccgtacggtaacgtccgtaccgttacggtacgttactttaacggtcctacggtacctaaacgtcgtaccgttaccgtaccccgttaaccccgccgttaccggaacgtaccgaactaccggacgtacggtaaagtaaccgttaagacgttggtacgacgttacgacctacttacgttaccgtacgttaccttcgtaccgttcccttaccccggtac

SEQ ID NO: 270365 - DNA, 942 bp, Homo sapiens
  misc_feature: GYAE6OF02FYMSC.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtcctccatccttcctgtctgcatccataggagacagagtcaccatcacttggccgggccatcgaggactattagactaattatttagctttaggtaacttacgaaacgggttaaaaaccgacggggggtaacccgtaccccgtaaacggtccgtacccgttacggtaactttccgttcccgtttaccccggtaccggtttaccctttaacgttttttaaaccggtaaaaacggggtttcccggggggtaccccctaaacccggtaaaacggtaaccgtttacgtacgggtacccggggttaccggtttacggggtaacgtttaccggttacgggggtaactaacggttaaaacgtttcccgtaacctttaccgttaaccaaccgtaaacttacccgtaacggtacccgtacgggttaccccggtcccggggtacccggtttacgggaaaccgggttacccgttaccggttacgggtacccgggttttacctttttaaacgtttaacccggtttacggttaacccgtaaacgtaaccgggttttcccgttttaaacccgggtttacccccggtttaaaccccccccggttacccgttttacccggggaacccggtaaacggggaacccgtaaccggtaccgttaagggaaaccgttaaacgttaacccgggtaaccgttcggggtacggtaccgttaccggacccgttaacccgttagttacccgtttcgtttaacccgttccgttaacccgtttaccccgttacccccgttacccg

SEQ ID NO: 270366 - DNA, 663 bp, Homo sapiens
  misc_feature: GYAE6OF02H32U9.34.57.F02.1.454.CMB.1.raw
  modified_base (278)..(278): a, c, t, g, unknown or other
  misc_feature (278)..(278): n is a, c, g, or t
  modified_base (531)..(531): a, c, t, g, unknown or other
  misc_feature (531)..(531): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtccaccatcacttcggcccgggcatcgaggactattagctaattatttagcttaggtatacgaaggtaaaaccgngggggacctacccctaaggccttcctagtacttcctccgttccgtcgtaccctaattttaaccgaaaaggttccggggtacccaaccgaagtacttccgagcggtcgtttggacttcgtagggacagtaacttacacttcgtaccaacaacttcgaacgcgacggtcccggcggaccgtggaggtacctcgtggaccggttcttaacttacgtcgtactaacgacgtacttacgttacccggttacccccccncgtttaccggacccgaaggggtaccaccggtacgtacgggaacgtaacgttaaaccgtacgttagggtcggtacgtcgtaccacccgtattccgttcgttcctttacctaccttcccgttacccgtaacccg

SEQ ID NO: 270367 - DNA, 558 bp, Homo sapiens
  misc_feature: GYAE6OF02IV2E0.34.57.F02.1.454.CMB.1.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (533)..(533): a, c, t, g, unknown or other
  misc_feature (533)..(533): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccatagganacagagtcaccatcacttgccggccgatcaggacattagcaattatttagctttggtatacgaaggtaaaaacccaggggaccncccctaagctcctgatctcttccgcgtcctattttacaaagtcgggtacccacgaagtattcaggtcggtcgttgggaactcgtagggaacagtaacttcactctacacaatcagcacgtccgcggcctgacggactcgtcggccggtacttacgttactacgtacaaactgtacttacggtcccgttacccccctacgttccgaccgtaacggacacgactgaatgtaaacgactgtcgactcgactaccntctgttcctctacttccgtccgtac

SEQ ID NO: 270368 - DNA, 791 bp, Homo sapiens
  misc_feature: GYAE6OF02GCGQB.34.57.F02.1.454.CMB.1.raw
  modified_base (199)..(199): a, c, t, g, unknown or other
  misc_feature (199)..(199): n is a, c, g, or t
  modified_base (498)..(498): a, c, t, g, unknown or other
  misc_feature (498)..(498): n is a, c, g, or t
tcagtacacgtgatcacgaccggtgctcgatttagctcgatatagttgggtttgggggagtcagtcccagtcaggacacagcatggacatgagggtccccgctcagctcctggggctccgtgctgctctggctcccaggtgccagatgtgacatccagatcgacccagtctccatccttcctgtctgcatccatagganacagagtccaaccagtctacgttcggccggaccgatccgaggactagttacgacttaatttacgttagtcttagggtaataccgtaaacgggtaaaacccgacgggggtaccccaccccgttaaacgtcccttaccgttacgaacctttcccgttcccgttacccggtccgttacccgtttaaacttttaaccggaaaccggttaccggggttacccccaaaccgtaagtacgttaccaggtccgggtacgtttgggaacttcgtagggactagtaacttacgacttccactaacaacncgtacgactacggtaccggccggtacgtacggacggtacctcggtaacggcggttactttaacgttacgttacggtaccttaacggactttaccggtttaccgttacccccggtaaccccccttaccgttacccggggaaccctaaacggggtaccgtaacggtaaccggttaacggaagttaaaccgttaaccgtaaccggtacgggttccggtacgaccgttaaccgtaacccgttaggtcccgtttacgttacccgttccgttaaccggtttccccttacccggtaaccc

SEQ ID NO: 270369 - DNA, 713 bp, Homo sapiens
  misc_feature: GYAE6OF02JDCCW.34.57.F02.1.454.CMB.1.raw
  modified_base (202)..(202): a, c, t, g, unknown or other
  misc_feature (202)..(202): n is a, c, g, or t
tcagtacacgtgatcacgaccggtgctcgatttagctcgatatagttggggtttgggggagtcagtcccagtcaggacacagcatggacatgagggtccccgctcagctcctggggctcctgctgctctggctcccaggtcgccagatgtgacatccagatgacccagtctccatcccttcctgtctgcactccgatagganacagtacgtcaccatcacttcggccggccatcaggactattagactaatttattagtacgttggtactacgaacggtaaaccgacggggaccctacccgtaagtcctacctgtacttccttccgttccgtacgttaccgtattttaacgaacgggttccggggtaccccaaccgtaacgtacttacgacggtccgggtcgttaggtacgtcgtacgggaacaacggtaacttctactcctactactaactcgaacgtccgacggttcccggccggtacgtacgggacgtaccgttcggtacggtccgttacttaacgtttacctacgtaccgaacgtacgtaccggttttaaccggttcccccggttaaccccccgttaccgggttccgggaacccggtaaccggtaccgacggaacgtacggtaacgttaacgtaaccgtagtcggtccggacttaccgaccttaccgtacgtccttcgttacccttacgcccgttttacctccccgtac

SEQ ID NO: 270370 - DNA, 776 bp, Homo sapiens
  misc_feature: GYAE6OF02IS6NS.34.57.F02.1.454.CMB.1.raw
  modified_base (196)..(196): a, c, t, g, unknown or other
  misc_feature (196)..(196): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttctgtctgcatccatagganacagacgtcacatcacttcgaccgggccatcgaggactattagctaattagttagccttggtatacgtaacggtaaaaccgacggggacctccccgtaaaggcctaccgttggtacttccttaccgttccggaccgttacctaagtttttaaccgaaacggttccggggttaccccaaccgtaaagtaacgttccgaacggtccgggtacggtttagggtacgtccggttagggacaaacggtaacttaccgaaccttcgtacctaacctaaagtccgaaggtcccgtaacggtcccggacccgggtacccgtaggtaaccgggtacttccggtaccggtaccggttaccttttacgtttaaccgttacggttaccctaaaccggtaccggttaccctttaacgggtttacccccggtttaacccccccgtaccgtttacccgggggaaccctaaccggggaaccgtacccgggtaacgttaacgggaacttaaacggttaaccgtaacgttaggtcggtacctgggaacctaccgtattaccgttcgttacctaccgtaccgttacccttaccccaacg

SEQ ID NO: 270371 - DNA, 566 bp, Homo sapiens
  misc_feature: GYAE6OF02GLWMC.34.57.F02.1.454.CMB.1.raw
  modified_base (276)..(276): a, c, t, g, unknown or other
  misc_feature (276)..(276): n is a, c, g, or t
  modified_base (329)..(329): a, c, t, g, unknown or other
  misc_feature (329)..(329): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattatttagcttggtatcaaggtaaaaccaggggaccncccctaagctcctgatcctcttccgcgtctatttacaaggtcgggtcccacanatcagcggtgtgatcgtggacagtaatcactctacacaatcagcacgtccggcggtccgtggacgtactcgtcggcggtctttaagttaccgtgtaccaacgacgtaccgttacggttacccgttacccccctaccgttccggaccgtaacgggaccaccggtacgtacggaacgtaacgttaacgacgtggtcgtacgtcgacctactacgtctcgttctctacttcctcccgtac

SEQ ID NO: 270372 - DNA, 620 bp, Homo sapiens
  misc_feature: GYAE6OF02JG9I0.34.57.F02.1.454.CMB.1.raw
  modified_base (268)..(268): a, c, t, g, unknown or other
  misc_feature (268)..(268): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttcgccggcatcaggacattagctaattatttagcttggtatcaaggtaaaaccnggggacaccctaagctctgactctctccgcgtctatttacgaagtcgggtaccacaagtattacacgcggtcgtttggacttacggtgggaactaagtaacttcaacttctacgacaacgtcagccgtacggtcccgcggtccgtaggacggtactcgtcggtccggtactttaacgtacgttcgactaacgtgtacctttaacggttcccgttaacccccctacgttaccggaccggtaacgggtaccaccggtaacgtacggtaacgtaacgttaaccgacgttacgggtacggacctacggaccctacgtagttccgtacgttccttacgtaccttcccgtaccctacg

SEQ ID NO: 270373 - DNA, 722 bp, Homo sapiens
  misc_feature: GYAE6OF02GOHAK.34.57.F02.1.454.CMB.1.raw
  modified_base (202)..(202): a, c, t, g, unknown or other
  misc_feature (202)..(202): n is a, c, g, or t
  modified_base (405)..(405): a, c, t, g, unknown or other
  misc_feature (405)..(405): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatcgacccagtctccatccttcctgtctgacatccagtaggacanaggatcaccagttccacgttcggccgggacatacgaggtacctattacgactaaatttatttagcttaggttactacgtaaagggttaaaaccgacggggtacctacccgtaacgcttaccgtagtacgttcctacttcccggtacttacctaagttttaaccgaaacggttccgggtaccccaaacgtaaagtacgttacgnggtacggtccgtttacggagttccggtagggtaacctaagtaacttacgtaccttcgtactaactaagttccaagtacgtacgtccggaccgtccgtagtacggaccgttctcgggtacgttcttaacgttaacgttcgtaaccgtaactcgtaccgtttaccggttccccggttaaccccccgtacgtttaccgggacccgtaagggtacccaacggtacggtacgaaccgttaacgttaaccgtacggttcggtacgggtctaacgggtccctaacgtcgtacggttcgtactaccttacggtcctaccccgtta

SEQ ID NO: 270374 - DNA, 699 bp, Homo sapiens
  misc_feature: GYAE6OF02IID46.34.57.F02.1.454.CMB.1.raw
tcagtacacgtgatcacgaccggtgctcgatttagctcgatatagttggggtttgggggagtcagtcccagtcaggacacagcatggacatgagggtccccgctcagctcctggggctcctgctgctctggctcccaggtgccagatgtgacatccagatgacccagtctccactccttctgtctgcactcagtaggacagagtactccacctactcctacgtcggccggtaccgtatacgacggtactattagactaatttacgtttagtcgttaggtaactacgtaaacggtaaaccggacggggtaccctacccgtagtaccgtcctaggtactcctccgttccgaccgtttacctaagttttaacgtaacgggttccggtaacccaacgtaagtactcgacggtcggacgtttaggacgttcggaggactaggtactccgacttctacactaactcgacgcgtacggtccgccggtcgtacggacgtccgttcggtacggtaccgttaccgttacgtttacgactacgtaactacgtaccgtttacccggtccccgttaacccccgtcgttaccggaccggtaccggtaaccgacggtaacggttacggaacgttaaacgtacggtactacgggtcacggtaccgtacctacgttacttcgttacgttaccttaccaccgtttaccgtccctacg

SEQ ID NO: 270375 - DNA, 731 bp, Homo sapiens
  misc_feature: GYAE6OF02IDVM1.34.57.F02.1.454.CMB.1.raw
  modified_base (197)..(197): a, c, t, g, unknown or other
  misc_feature (197)..(197): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccatagganacagagtcaccatcacttcggccgggccatcgaggacattagactaatttagtttagcttggtatacgaacggtaaaaccgcggggaccgacccccgtaagccctcctagtacttcctccgttccgcgttaccttaatttttaaccgaaaggttccggggtacccctaaccgaagtacttaccgaaggtccgggtacggtttcgggacgttcgttacgggaactaacggtaactttaccgacttacctaccgaactaacttacgaacggtacctaccggttccccggacggtcccgttaggaacgggtaccttcgtacgggtaccggttactttaacgtttacgtacggttacaaacgtacgtacctttacggttaccccgttaaccccccgtcgtttacccgggaccgtaacgggaacctaccggtaacgtacggtaagtaacgttaaaccgtaacttacgggtcggtacctacggaccctaactacgttcgttacgttcctttaccgtaccgtttacccgtaccccgtaccg

SEQ ID NO: 270376 - DNA, 626 bp, Homo sapiens
  misc_feature: GYAE6OF02FID02.34.57.F02.1.454.CMB.1.raw
  modified_base (271)..(271): a, c, t, g, unknown or other
  misc_feature (271)..(271): n is a, c, g, or t
tcagtacacgtgatcacgaccggtgctcgatttagctcgatatagttggggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagctaattattagcttggttatcaaggtaaaaccnggggaccgcccctaagctcctgactctccttccgcgtcctatttacaaaggtcgggtaccacagattcagcggtcgtggatcgtgggacagaacttcactctacactactcagcacgtcccggcggtccgtggacgggtacctcgtcggccggttactttaacgttccttaggttaccaaaccgttagtaccgtttaacgttaccccggttaacccccccgtaccggtttacccgaccggaaacgggtaccaaccgtacgtacggaacgtaacgttaaaccgacgtaggtacggcgtacggacctaccgtagttcgttacggttcctttactaccgttcccgtaccccgtacccg

SEQ ID NO: 270377 - DNA, 640 bp, Homo sapiens
  misc_feature: GYAE6OF02HC4I1.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttctgtctgcatccataggagacagagtccaccatcacttcggccgggccgatcgaggacattagctaattatttacgcttggtatacaaggtaaaaccgaggggaccgtacccctaagcctcctagactcctcttccgaccgtccgtacttttaacgaacggttcgggtacccaacgaagtacttcgacggcggtcgttggactcgtgggaacagtaacttacaccgttctaccaactaatccagccgtacgtcccggcggaccgtggacggtacttcgcggtacggtctttaactttacgttagtaccaactaggtcctttacggttaccccggttacccccctaccgtttacccggaccgtaacggggaccaaccggtacgtaaggacgttaactaacgtacgtaggtacggcttacggccaacgtcgttcttcgtcttacctactcccgttaccctacccg

SEQ ID NO: 270378 - DNA, 810 bp, Homo sapiens
  misc_feature: GYAE6OF02IGRU9.34.57.F02.1.454.CMB.1.raw
  modified_base (102)..(102): a, c, t, g, unknown or other
  misc_feature (102)..(102): n is a, c, g, or t
  modified_base (204)..(204): a, c, t, g, unknown or other
  misc_feature (204)..(204): n is a, c, g, or t
tcagtacacgtgatcacgaccggtgctcgatttagctcgatatagttgggtttgggggagtcagtcccagtcaggacacagcatggacatgagggtccccgntcagctcctaaaggggctcctgctgctctggctcccaggtgccagatgtgacatccagatgacccagtctccattccttcctgtctgctatccaatacgganacagacgtcaccatccaacttcggccgggccatacgaggtacatttagactaatttattaagcttaggtatacgaaaggtaaaaccgaggggtacaccccgtaaaggcctaccgtagacttaccgtccgttccgtacgttacctaacttttaacgaaaacggttcgggtacccctaaacgtaaaggtacttacgaggtccggttacgtttagggaacgtttcgtaaggggtacctaaaggtaactttaccgtaacttaccttacaacgtaacgttccgaacggtccgtaacggttcccggaccggtaccgttacggaacggtaccgttacggttacggtaccggttaacgttttaacgtttaaccgtcgttaaccgtaaaccgtaacgttaaccgtttaaccgggttaccccgttttaaccccccccgtaacggtttacccgggaacccgtaaacggggaaccctaaaccgggtaccgtaacgggtaaacgtaaaccgttaaaaccgggtacgttacgggtacggtacctttcgggaacccctaaccgtaacgttccgtttacgttaccgttaaccgttaacgtttccccgttaccccgtaacccg

SEQ ID NO: 270379 - DNA, 560 bp, Homo sapiens
  misc_feature: GYAE6OF02I2FYP.34.57.F02.1.454.CMB.1.raw
  modified_base (275)..(275): a, c, t, g, unknown or other
  misc_feature (275)..(275): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattatttagcttggtatcaaggtaaaaccaggggacncccctaagctcctgatctcttccgcgtccattttacaaagtgggtcccaccaagattcagcggcgttggatcgtgggacagaattcacttctacacaatcagcagtccgcgctggacgactcgtgcggtcttattactgtcaacgtatcgttacgtccggttaccccccacgttccggaccgaacgggaccaccggacgtaggaacgtaacgttaaacgacgttacggtggtacctaggaccaaccgtattctcgttaccttcgactttcccgttcccgtaaccg

SEQ ID NO: 270380 - DNA, 271 bp, Homo sapiens
  misc_feature: GYAE6OF02GEPHX.34.57.F02.1.454.CMB.1.raw
  modified_base (253)..(271): a, c, t, g, unknown or other
  misc_feature (253)..(271): n is a, c, g, or t
tcagtacacgtgatcacgaccggtgctcgatttagctcgatatagttggatttgggacagaattcactctcacaatcagcagtccgcggcctgaggactctgcggcttattactgtcaacagcttagtcggttacccccccacttcggccaaagggacacgactggagattaaacgactgtggctgcaccatctgtcttcatcttcccgcatctgaatcacgtgtactgagcgggctgggcaaggcgcatagnnnnnnnnnnnnnnnnnnn

SEQ ID NO: 270381 - DNA, 560 bp, Homo sapiens
  misc_feature: GYAE6OF02F057F.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccggcatcaggacattagcaattattagcttggtatcaaggtaaaaccgaggggaccgccctaagctcctgatctcttccgcgtctatttacgaagtgggtcccacaagattcagcggcgttggatcgtggacagaattcactctcacatcagcagtccgcggcctgacggactcgtcgcggtacttattacgtagtacaacgtagtccgtttacgtccggttaacccccctacgttaccggaccaacgggaccacggtacgtaggaacgtaattaaaccgactaggtcggtaccttggaccctaaccgtattcgtcgttccttaccacttcccgtcccgtacc

SEQ ID NO: 270382 - DNA, 691 bp, Homo sapiens
  misc_feature: GYAE6OF02HZER0.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccaggatggtgacatccagatgacccagtctccatccttcctgtctgcatccataggagacagagtcaccatcacttcgccgggcatcaggacattagactaattatttagctttaggtatcgaacggtaaaaccgagggggaaccgacccctaaaggccttaccctaggtattccgttccgttccggtaccgtcccgttaactttttaacgaaacgggttcggggtaccccaaccgtaacggtaacttcgaacggcgggtacgtttagggtaactccggtaggggacctaaggtaactttcgaccttccgtacacgaactacgacgcgtacggtcccggccggtacctggacgtactcgtcggcgtactttacgttacgtcgtaacaacgcgtacctttacggtccccggttacccccctacgttaccgggaccgtaacgggacctacggtaccgaggtaagaaccgttaacggaacttgggtacggtacctaggaccctaaccgtacgttcgttccgttacctttaccgactttacccggtcccgtacc

SEQ ID NO: 270383 - DNA, 616 bp, Homo sapiens
  misc_feature: GYAE6OF02IL49O.34.57.F02.1.454.CMB.1.raw
  modified_base (197)..(197): a, c, t, g, unknown or other
  misc_feature (197)..(197): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccatagganacagagtcaccatcacttcggccgggccgatcgaggacattagactaattattagtcttaggtactacaaggtaaaaccgaggggaccgaccccgtaagcctacctgtactcctcgttccgcgtcctatttaacaacggtcgggtacccacgaagtacttcgacggtcggtcgttggactcgtagggacagtaacttcactctacacaactcagcgacgtccgcgccgtggacgtactcgtgcgtactttattactcgtactacgtacgtacgtttaccgtacccgttacccccctaccgttaccggaccgtaacgggaccgaccggacgtacggaacgtaacgttaacgtacgtggtacggacctacggacctaccgtattaccgtcgttaccttacctacttcccgttacccgtacc

SEQ ID NO: 270384 - DNA, 796 bp, Homo sapiens
  misc_feature: GYAE6OF02FOLM2.34.57.F02.1.454.CMB.1.raw
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
tcagtacacgtgatcacgaccggtgctcgatttagctcgatatagttgggttttgggggagtcagtccagtcaggacacagccagtggtacatgtagggtccccgtctcagctcctggggctcctgctgactctggctcccgaggttgccagatgtgactatccagatgtaccngtcncatcttctgtctgcatccataggagacgaagagttcaccagtccggacttggaccgggcctatccagggactattacgctaattatttagtctttaggtatacgtaggtaaaaccgacggggaccgtcccgtaacgtccgttcccgtcgaactccttccgttccgggacggttcctaagttttaacgaaacgggtttcggggtacccctaaccgtaaagtacgtttacgaggtaccggtcggtttacggacttacggtagggaactaaggaaactttacaaccttccgtacgaaccgtaaacgttccaacggtaccacggttaccccggcgggtacccgtaggacggtaaccgtacgtacgtaccggttactttaacgttacgtttcgttaaccgaacgtacgttacgttaaccggtacccggtttaacccccccaccgtttacccggaccggtaaaccgggtaccgaaccggaaccggttaacgggaacgttaaacgtttaaaccggtaacgtttaggttaaccgggttaccttacgggttaacccctaccgtttaacgttacccgtttacggtttacccttttaccgtaccgtttacccgtaccccgttaaccccg

SEQ ID NO: 270385 - DNA, 623 bp, Homo sapiens
  misc_feature: GYAE6OF02GMNGQ.34.57.F02.1.454.CMB.1.raw
  modified_base (240)..(240): a, c, t, g, unknown or other
  misc_feature (240)..(240): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcacatcactgccggcatcagcatagctaattattancttgtatacgaaggtaaaccgacggggacctacccgtaagctccgagtacttctcttccgtcgtcctagtttaacgaaggtcgggtacccaacgtaagactcgacggtcggtcgtgtactcgtaggactagattccactcctanaacatcgagaccnggtccgcggctaggcgtactctggccgttatttacgttacctagtaccaactcgttacttaccggttacccccgttaacccccgtcgttaccgggaaccgtacgggaaccaccggtagtagggaacttaacgttaaccgacgttcggtaggtccttaccggcctaaccttacggttacctttcgtttaacccgttcccgtttaacgtttcccccgtacccgtaccg

SEQ ID NO: 270386 - DNA, 812 bp, Homo sapiens
  misc_feature: GYAE6OF02IIVCB.34.57.F02.1.454.CMB.1.raw
  modified_base (202)..(202): a, c, t, g, unknown or other
  misc_feature (202)..(202): n is a, c, g, or t
  modified_base (792)..(792): a, c, t, g, unknown or other
  misc_feature (792)..(792): n is a, c, g, or t
tcagtacacgtgatcacgaccggtgctcgatttagctcgatatagttgggtttgggggagtcagtcccagtcaggacacagcatggacatgagggtccccgctcagctctgggctcctgctgctctggctcccaggtgccagatgtgacatccagatcgacccagtcctccattcccttcctgtctgcactccagtacgganacagacgtacaccgtatcctacttcggacccgggtcgatcacggaactattagactaatttatttaagtcttaggtatacgtaaggtaaaaccgaggggaccgaccccgtaagccttaccgtcgtacgttccttccgttacccgtcgttacccgttaacttttaaccgtaaaacggttccggggtaccccaaacgtaacgtaacgttcgacggtaccgggttcggttacgggtaagttaccggttacgggaactaacggtaactttaccgtaccgttacctacctaactaacgtaccgaaacgtaccggtaccggtaccccgggtccggtaccggtacggtaacgggtaccgtacgttcggtaccgggtttacctttaaacgtttaccgtacgggttaacctaaacgtcgtaaccgttttacccggttacccccggtttaacccccccgtaaccggtttacccggacccgggtaaaccgggtaacccgtaaccggtaacgttaaccgggaacgttaaaccgttaaaccgaacggtttaggaccgggttactaccggtaacctacctagttccttacgttacccgtttacnctttaccccgtacccgtacc

SEQ ID NO: 270387 - DNA, 727 bp, Homo sapiens
  misc_feature: GYAE6OF02GR7I0.34.57.F02.1.454.CMB.1.raw
  modified_base (197)..(197): a, c, t, g, unknown or other
  misc_feature (197)..(197): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccatagganacagagtcaccatcacttcgccggccatacgaggacattagctaattattagcttaggtatacaacggtaaaaccgacggggaaccgtaccccgtaagtacctccgtcgtacttactccttcccgcgttaccctagttttaccgaaaggttccgggtaccccaaccgtaagtactttacgacggtacggtacgttggagttcggtagggtaactaagtaacttcgactcgtactaccgtaataccgacgtccgtaacgtccggccggtaccgttggacggtaccgtcggtacgcggttacctttaactttacgtacgtacctaaacgtcgttaacccgttacggttacccccggtttaacccccccgtaccgttaccgggaacccggtaacgggtaacccctaaccggtacgtaacgggtaaccgttaaacggttaacccgtaacggttccggtaaggtaccgttacgaccgtaccgtactttacccgttacggttccctttacctaccgtttcccgttacccgtacccg

SEQ ID NO: 270388 - DNA, 693 bp, Homo sapiens
  misc_feature: GYAE6OF02I02RD.34.57.F02.1.454.CMB.1.raw
tcagtacacgtgatcacgaccggtgctcgatttagctcgatatagttggggtttgggggagtcagtcccagtcaggacacagcatggacatgagggtccccgctcagctcctggggctcctgctgctctggctcccaggtgccagatgtgacatccagatgacccagtcctcactccttctgtctgcatccagtaggagacagagtcaaccatcaacgttcggccgggcatcgaggactattagacctaaattatttagcctttaggtactacgaaacggtaaaaccggagggaccgtacccctaacgcctccgtagtcttctccgtccggtaccgtacctactttaacgaaacggttcggggtaccctaaccaagtacttcgacgtcggtcgtttgacgtcgtacggactagtaactcactaccgtacactaatcgacgacctacggtccgcggtccgtacggacgtaccgtcggtacgtccggtacttaacgtttaccgttacgtaccgtaacgtcggtaccgttacgggttaccccggtttaacccccccgtacggtttacccggtaaccggtaaccggaccgtaaacggtacgtaacggaacgttaacgtaaccgtacgtacggtacggtactacgacctaccgtacgttcgttacgttccgttaacctccgttaccgtcccgttaccg

SEQ ID NO: 270389 - DNA, 635 bp, Homo sapiens
  misc_feature: GYAE6OF02HGUWI.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccagtaggagacagacgtccaacctatccacgttcggcccgggaccatacgaggactaattagactaattatttagctttaggtatacgaaggtaaaaccgacggggacctaccccgtaagtcctcctgtactcctccgttcccgcgttacctagttttaaccgaaaggttccgggtacccaacaagtacttcgagcggtgttaggatcgtagggacagtacttcactctacacatcagcacgtccgcgctgacggtactcgtcggtcgtactttacgttactacgtacaacgtgtaccgttacgttccccggttaccccctacgttccgaccgaacgggtaccaacggtacgtaggaacgtaacgttaaacgtacgtgggtacgccgtacgccgtaaccgtacgttccgttcgtttacccttacgtacctttccctacccgtaccg

SEQ ID NO: 270390 - DNA, 816 bp, Homo sapiens
  misc_feature: GYAE6OF02I9V9D.34.57.F02.1.454.CMB.1.raw
tcagtacacgtgatcacgaccggtgctcgatttagctcgatatagttgggtttgggggagtcagtcccagtcaggacacagcatggacatgacgggtccccgctcagctcctggggctcctgctgctctggctcccaggtgccagatgtagacatccagatcgacccagtcctaccattcccttcctgtacctgcctacttccgaagtacgggaactaccgaaaggtaccgttccaacctcttaccgtaaccgttccgggacccggggtaccaagttaccgaggtaacctagttacgtacctaaattttacgttagtacgtttacggttaacgtaacggtaaaccgggtaaaaccggaccgggggtaacccgtaccccgttaaagtccgtaccgtaacgtacgttccgttccgttacccgtaccgttaccgttaacgttttaaaccggaaacggttccgggtaacccctaaaccgtaacgtaaccgtaccgtacgggtcggttacggtttacggtacgttcggtaacgggactaacggtaacttccgtaacttcctaacgaactacgtacgacgacgtacgtcccggacggtccgtagaccgtactcggtacgcggttacttaactccgtacgtaccgaaccgtactaccgttaaccgttcccccggttaaccccctacggttacccggaaccggaaccggtaccgtacgtaccgtaagggtaaccgttaacgtaacgtcggtacggtcggtacgacgtacccgtacttacgtaccgttccgttacgttacccaacgttcccggttacccaaccgg

SEQ ID NO: 270391 - DNA, 560 bp, Homo sapiens
  misc_feature: GYAE6OF02G76QD.34.57.F02.1.454.CMB.1.raw
  modified_base (422)..(422): a, c, t, g, unknown or other
  misc_feature (422)..(422): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccatcaggacattagcaattatttagcttggtatcaaggtaaaaccgaggggaccgcccctaagctcctgactctcttccgcgtcctattttaacgaagtcgggtcccacaagattcagcggcgttggatcgtgggacagaattcgactctcacaatcagcgagtccgcggctggagctctgcggtcttattcgtgtacanacgtcgttacgtccggttaccccccaccgttccggaccgaagggaccacggacctagggaacgtaacgttaacgaacttggtcggctcggacctaccgtattcgttacgtcctttaccacttcccgttaccccgtacc

SEQ ID NO: 270392 - DNA, 253 bp, Homo sapiens
  misc_feature: GYAE6OF02FXGRK.34.57.F02.1.454.CMB.1.raw
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (250)..(253): a, c, t, g, unknown or other
  misc_feature (250)..(253): n is a, c, g, or t
tcagtacacgtgatcacgaccggtgctcgatttagctcgatatagttggatctgggacagaattcactctcacaatcagcagtccgcggcctgaggactctgcggcttattactgtcaacagcttagtcggttacccccccacttcggccaagggacacgactggagattaaacgaactgtggctgcacatctgtcttcatcttcccgcatctgaatcacgtgtactgagcgggctggcaaggcncangnnnn

SEQ ID NO: 270393 - DNA, 632 bp, Homo sapiens
  misc_feature: GYAE6OF02ION5T.34.57.F02.1.454.CMB.1.raw
  modified_base (203)..(203): a, c, t, g, unknown or other
  misc_feature (203)..(203): n is a, c, g, or t
  modified_base (606)..(606): a, c, t, g, unknown or other
  misc_feature (606)..(606): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgtcagatgtgacatccagatgaccctagtctcctatcccttcctgtctgcacttccagtagganacaggacgtcaaccatccacgttcggcccgggcctagtcaggacattacgactaattacttagcgtttaggtactacgaaggtaaaaccgacggggaccaccccgtaagtcctaccgtagtacttcctccgtttcccggacgttacctactttttaaccgaaacggttcggggttaccccaacgtaagtacttacgaggtcgggtcgttggacttggtaggaactagtactcactctacactatcagcgacgtcgcgctgacgtactgtcgtcgtacttacttcgtacgtacgtactacgtacgtttacggtacccgttaccccctacgttccggaccgtaacgggacctaacggacgtacggaataacgtacgtagtcggtcggtctacgccacgtatcgtnttcctaccgtacttcccgtccgtacg

SEQ ID NO: 270394 - DNA, 658 bp, Homo sapiens
  misc_feature: GYAE6OF02IG02M.34.57.F02.1.454.CMB.1.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (288)..(288): a, c, t, g, unknown or other
  misc_feature (288)..(288): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgaccccagtcctccattcccttcctgtctgcaatccatagganacagngtccaccatcagttcggccgggcatcgaggactattagactaatttattagcgttgtatacgaaggtaaaccaggggaccncccctaagctacctgacttctcttccgactcctaatttacgaacggtcggtacccataagacttacgagtccggtggttacggattcggtaggtactaacgtactttacacgttacctacaacgtacacctagaccgtaccgtccggtaccgcgttaggaaccggtaccttcggtacggcggtttaacttaactttacgtacgttaccaacgtacggtaccttttacgggtaccccccggtttaaccccctaccggtccggtaaccgtaacgggtaacccaacgggtaacgtcgtaaggtaaccttaacggtactgggtaacgcctacgacgactacggtcttaacgtcgttacacttcccgtaccctac

SEQ ID NO: 270395 - DNA, 721 bp, Homo sapiens
  misc_feature: GYAE6OF02GL5QI.34.57.F02.1.454.CMB.1.raw
tcagtacacgtgatcacgaccggtgctcgatttagctcgatatagttgggtttggggagtcagtcccagtcaggacacagcatggacatgagggtccccgctcagctccgtggggctcctgctgctctggctcccgaggtgccagatgtgacatccaagatcgacccagtctccatccttcctgtctgctactccagtaggacacgagacgtccaccatccacgttcggcccgggcgtagacgtacggactattaggactaatttagttacgtacgttaggttactacggtaacggtaaaaccggacggggtacccgtaccccgtaacgtccctccgtacgtacttccgtccttcccggaccgttaccgttacgtttaacgtaaacggtccggggtaacccctaccgaacgtactaccgtacggaccgggtcggttacggtacgtccggtacggacaaggtaacgttccacgtaccgtaccaacactacgacgctaccgtccggccgccgtaggacgtaccgtcggtcggaccgtcttaacgtacgttacgtacaacgtagtaccgtttaccggtaccccgttacccccgtacccggtacccggaccggtaaccggacgaaccggtacgtacgggaacttaacgtaaccgtcggtacgttccgggtactacggacctaaccgtcgttacgttccttacgtcctacgttcccacccgtaccg

SEQ ID NO: 270396 - DNA, 633 bp, Homo sapiens
  misc_feature: GYAE6OF02HMG7Y.34.57.F02.1.454.CMB.1.raw
  modified_base (314)..(314): a, c, t, g, unknown or other
  misc_feature (314)..(314): n is a, c, g, or t
tcagtacacgtgatcacgaccggtgctcgatttagctcgatatagttggggtttgggggagtcagtcccagtcaggacacagcatggacatgagggtccccgctcagctcctggggctcctgctgctctggctccaggtgccagatgtgacatccagatgacccagtctccattcccttctgtctcgcatccagtaggagacagagtcaccatcacgttcggccgggcatcgaggactagttacgactaattacgtttagtcgttagtactacgaacggtaaaaccgacggggtaccacccgtaagcccttcgngtactccttcgttccgtccgtccttaacttttacgaacggttcgggtacccacgaagtactcgacgtcggtgtggtactcggtaggtacagtaactctactctacactactacagcgtacgtccgcgctaggacgtactcgtcggtacgtattacttacgtacgtacaacgtactccgtttacgtacccgttacccccgtacggttccggaaccgtaacggacgtaacgacgtaagggaactaataaccgtacgttcggtaccgtctaccgtacaccgttagtccgttcgtccttacgtaccgttccctacccgtaccg

SEQ ID NO: 270397 - DNA, 774 bp, Homo sapiens
  misc_feature: GYAE6OF02HPO57.34.57.F02.1.454.CMB.1.raw
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (282)..(282): a, c, t, g, unknown or other
  misc_feature (282)..(282): n is a, c, g, or t
tcagtacacgtgatcacgaccggtgctcgatttagctcgatatagttggggtttgggggagtcagtcccagtcaggacacagcatggacatgacgggtccccgctcagctcctggggctcctgctgctctggcctcccaggtcgccagatgtgacatccagatcgaccccagtcctccattcccttcctgtctcgacactccaagaggagaacagcgacaaccntnacgttcgccgggccaatcgaaggtacattagactaaattagttagtctttaaggtntaaaccgtaacggtaaaacccggaggggaaccccgtaccccgttaaacgacccgtcccttagtaccttactcctttacgacgtaccgttaccttaaaacgttttaaggaaccgggtttacgggtaccccaaccgtaaaggtacctacgtaacggtcccgggtgtttagggacgtttacccggaggtaaacgtaaacggttaactttaacccagtttaaccctaacgactaaacgtacgaaccggttccgacggttacccgccggtaacgttaccgggacgttacccttacgggtaccgtccggttaacgtttaacgttacgttacgaaacctagtaaccgtacgtttaccggtaccccgttaaaccccctccggttaaaccgcccggaaggtacccagaaccgtagaaacgtaacgttaacgtaaggtccgttgacgtcgaacccgttactacggttcctagttacccggtacttaccctaccgtttaaccc

SEQ ID NO: 270398 - DNA, 680 bp, Homo sapiens
  misc_feature: GYAE6OF02HKBN7.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtctccattccttctgtctgcatccataggagacagagtacacctatcacttcggccgggtccatcacggactattagactaattaatttgcgtttagatcgaaacggtaaaacgaggggaccaccctaagcgtctagatctctccgtctacctatttaacgaacgttcgggtaccacgtaagtacttcgacggtcggtacggttggatcggtaggaactacggtaaacttccgtactacgtaccaactaactacgtacgtaccgcggtacccggcggtaccgtacggacggtacttcggtacggtccggtacttaacgtttacgtcgtaacctacgtaacgtaccgtttacgttaccccgttaccccccgtaccgtaccggtaccggaaccgggtaaccacggtaccggtaggtaacgtaaacgttaaccggaacgttcggtaacggtaccgtacgtacccgtaactacgtttccgtacgtttaccgtacgtaaccttccgttacccgtacccg

SEQ ID NO: 270399 - DNA, 880 bp, Homo sapiens
  misc_feature: GYAE6OF02HAHTT.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgacccagtcctccatccttcctgtctgcatccagtaggagacagacgtaccaccatcacgttcggccgggtccatcgaggacattagactaattatttagtacttaggtatacgaaggtaaaaccgacgggaccgtaccccgtaagcctaccgtgtaccttccttaccgttacccggtacgttaccccttaagttttaaaccgaacgggttcccggggtaacccaaccgtaacgtacgttaccggacgggtccggggttacggttacggacgttaccggtaggggaactaggttaaacctttcccgtaaccttaccttaccgaacctaaacgttccgaacggtaccgtaaccgggtccccggaccggtacccgttagggaaccggttaccgttccggtaccgggttcccggttaacttttaacgttacccgttacgtaacccgtacgttaaccggtttacccgttttaacccgggttacccccccggtttaaccccccccgttaaccggtttaccccggggtaaacccggtaaacccgggtaacccgtaaccgggttaccggtaaaccggtaaacgggtttaaaccggtttaaacccgtaacgggtttaccgggttaccgggtaccgttaacccgtacccgggtaaacccttacgttttacccggttaccggttttaccctttaccggttacccccgtttacccgttaccccggttaaccc

SEQ ID NO: 270400 - DNA, 796 bp, Homo sapiens
  misc_feature: GYAE6OF02IQ2RJ.34.57.F02.1.454.CMB.1.raw
  modified_base (146)..(146): a, c, t, g, unknown or other
  misc_feature (146)..(146): n is a, c, g, or t
  modified_base (151)..(151): a, c, t, g, unknown or other
  misc_feature (151)..(151): n is a, c, g, or t
  modified_base (273)..(273): a, c, t, g, unknown or other
  misc_feature (273)..(273): n is a, c, g, or t
  modified_base (790)..(790): a, c, t, g, unknown or other
  misc_feature (790)..(790): n is a, c, g, or t
tcagtacacgtgatcacgaccggtgctcgatttagctcgatatagttgggtttgggggagtcagtcccagtcaggacacagcatggaccatgacgggtccccgctcagctccgtgggctcctgcctgcctcgtggctaccaggtcnccagntgtagacactccgaagtactcgaccctagtcctacctacttcccttcctgttcctcgacctacgtacccagtacggacgacaggtactaccacctacttcctacgttcggacccgggcctancgaggtacctagttacgacttaattttacgttacgtccggtttagtaacgtacggtaaaaccgggttaaaaccgggacgggtaccccgtaaccccgtaagtccccgttcgtaccgtaactttcccgttacccgtccgtaccctttaaccgttaagttttaaaccgaaccgggttcccggtaccctaacccgtaaggttacctccggtacgggaccggttacggttacggtaaccgttcgggttaacgggacctttaaaggttaccccttacccggtacttacccgttaaccaaccgtattccgaacggcccgtaccgggtccgtacggtccgggtaacgtacgttccgtagtcccgggtatttaccggtttacttacggtacgtaacctacggtacttacccgttacggttacccccggttacccctacgggttacgaccggtacggacacgtcggaaagttcgtaatacgccgttgcgtccagtcccgatcgttactcgtacgtcctcgttacccncgtacc

SEQ ID NO: 270401 - DNA, 819 bp, Homo sapiens
  misc_feature: GYAE6OF02IH33Y.34.57.F02.1.454.CMB.1.raw
  modified_base (136)..(136): a, c, t, g, unknown or other
  misc_feature (136)..(136): n is a, c, g, or t
tcagtacacgtgatcacgaccggtgctcgatttagctcgatatagttgggtttgggggagtcagtcccagtcaggacacagcatggacatgagggtcccgctcagctcctggggctcctgctgctcgtggctcccngggtgccagacttgtcgactactaccagactcggaccctagtcctccacttccttcctggttctcgacacctaccgagttacggacgacgtaagacgttccaacctactacctacgttccggccgggtactctacggacgtaacctagttacgacttaattagttacgtcgttaaggtactacgaaacggttaaaccgacgggtacccaccccgttaatccgtaccgttacgacctttccgttaccgttccggttaccttaaccgtttaaacttttaaccggtaaaccggggttccgggttaacccccaaacgttaacggtcgtaacgtcggacggtcggttagaccgttcggacggtaactaagtaccgttaccaccgttaccgtacgaactaactcgtaacgaccgtaccgtccggcgggtacccgtacgtaggtacccgttcgacggttaccgtacgtttaattaccgactaaccgtaccgtacgtttaaccttcccgggttaaccccggtttaccccctacgggtaccggtaaccggtaacgggtacctaaccggtaacggttacgaaccgttaacgtaacccggtacggttaggtccgttaaccggccgtaaccctacggttaaccttccggttaccgttacctttaccccgtactttacccccggtcccgttaaccg

SEQ ID NO: 270402 - DNA, 840 bp, Homo sapiens
  misc_feature: GYAE6OF02JHMG5.34.57.F02.1.454.CMB.1.raw
tcagtacacgtgatcacgaccggtgctcgatttagctcgatatagttgggtttgggggagtcagtcccagtcaggacacagcatggacatgagggtccccgctcagctcctggggctcctgctgctctggcctcccaggtgccagatgtgacatccagtatgacccagtcctaccacttcccttcctgttctcgcctactacccgtagtaaggacgacagacgttccaccaatctacgttcggcccgggtccgtatccggaaggtacctaagttacgaccgtaaattttacgtttagtaccgtttaggtacgttaaccgtaacgggttaaaaaccggaccgggggtaacccacccccggttaaagtcccgttacctacggtaacttccccttcccgtttacccggccgtttaaccccgttagttttaaaaccggaaaccgggtttcggggtaaccccctaaacccgggtaacttacgttaccggtacggtaccgggtacgggtttacgccgtacggttacgggaactaacgttattcccgaattaccgactacgtaactcaccggtacctaccgggcccgtcgaccgtacgtaggtaccctagtcggtaccggtattttaacgtcgttacgaaccttaacgtcggttaaacgttcccggggtaaccccccgtttaccccgtaccccgggtacgacccgggttaaacggacccgttccgaaacggttacgggaacctttaacgggtaaccgttacggtaaccggtcgtaccgttacggaccctaaccgttcgttacccggtttaacttccgttaaccgttcgtttacccgtccgttaaccc

SEQ ID NO: 270403 - DNA, 823 bp, Homo sapiens
  misc_feature: GYAE6OF02GOS2F.34.57.F02.1.454.CMB.1.raw
  modified_base (195)..(195): a, c, t, g, unknown or other
  misc_feature (195)..(195): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctccgaggtcgccagtagtgtgacatccagtatcgaccctagtcctccacttccttccgtgtcgngacctactccagtacggacgacgacggtacgtccaacctacttaccaccggttcggacccgggaccgtactacgaacgggtacctaagtttaacgaaccttaaagtttactttacggtacgttttaggttaactacggtaaacggggttaaaaccgacgggggtaaccccgtaccccgttaaacgtcccgtacctacggtacttccgttacccgtttccggtaccggttaccttaacgtttttaaaccggaacgggtttacccgggtaaccctaaccgtaaacgtacgtaccgttacggaccgggtcggtttacggacgttacggtagggtaactagaactttaccgacgttacctaccaacgtaaccgtagaccgtaccgtaccggttccgggccgtaccgttcggaacgttaccgtgtaccggtaccgttatttacggttactacgttaacgaccgtagtaccggttaccgttacccggtttaccccccgtaccgttaccgggaccgtaaccgggtaaccgtaccgtaacggtacgtaagtaaccgttaacgaccgtagggtaccgtacgtaccgaccgttacctacttcctggtttaccttacggtccttcccgtaccgtaaccg

SEQ ID NO: 270404 - DNA, 505 bp, Homo sapiens
  misc_feature: GYAE6OF02FU1ZV.34.57.F02.1.454.CMB.1.raw
  modified_base (266)..(266): a, c, t, g, unknown or other
  misc_feature (266)..(266): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (453)..(453): a, c, t, g, unknown or other
  misc_feature (453)..(453): n is a, c, g, or t
  modified_base (466)..(466): a, c, t, g, unknown or other
  misc_feature (466)..(466): n is a, c, g, or t
  modified_base (470)..(470): a, c, t, g, unknown or other
  misc_feature (470)..(470): n is a, c, g, or t
tcagtacacgtgatcacgaccggtgctcgatttagctcgatatagttgggtttgggggagtcagtcccagtcaggacacagcatggacatgagggtccccgctcagctcctggggctcctgctgctctggctcccaggtgccagatgtgacatccagatgaccagtctccatccttctgtctgcatccataggagacagagtcaccatccacttggccgggccatcaggacattagcaattattagcttgtactcaggtaaaaccnggggaccgccctaagctcctgatctcttccgcgtctatttacaagtcgggtccacaagatcgagcggngttgatcgtggacagaacttcactcncacaatcagcacgtcgcggctgagactcngcggcttatactntcaacngtcttacgtccgttacccctacgttcggccaaggcacgatagganattaacgactggngtcncgacacgactctacgttcttcacttcctcccgacc

SEQ ID NO: 270405 - DNA, 534 bp, Homo sapiens
  misc_feature: GYAE6OF01DUDU0.21.17.B06.1.454.CMB.1.raw
  modified_base (389)..(389): a, c, t, g, unknown or other
  misc_feature (389)..(389): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (496)..(496): a, c, t, g, unknown or other
  misc_feature (496)..(496): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttgggtgaaggccgggggggtcactcagactctcctgctctgcatctggttttatgataagtgatgcctggatgcactgggtccgccaggcaccgaggggaaggggctggaggtgggtcggccgtagttaggagggcgaagtgcgtgggtgggcgataggaatactctgcagccgtgagnggcagattcacctatcttcagagatgattacgaagaaacacgatgacttntgcagntggatgcctagacgaacgagacacgaggcctatattacttgttaccagtanaattagttaaccncggtanaccgttacggccttaacgg

SEQ ID NO: 270406 - DNA, 535 bp, Homo sapiens
  misc_feature: GYAE6OF01EBD6N.21.17.B06.1.454.CMB.1.raw
  modified_base (516)..(516): a, c, t, g, unknown or other
  misc_feature (516)..(516): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttgggtgaagccgggggggtcactcagactctcctgctctgcatctggttttatgataagtgatgcctggatgcactgggtccgccaggcaccgaggggaaggggctggagtgggtcggccgtattaggagggcgaagtgcgtgggtgggcgaatagaatactctgcagccgtgagaggcagattcaccatcttcagagatgaattcgaagaaacacgatgacttctgcagatggatagcctgacgaaccgaggaccagacggtcctacgtattattgttaccagagtattacgttaactccggtanaccgttacggccgttaacg

SEQ ID NO: 270407 - DNA, 516 bp, Homo sapiens
  misc_feature: GYAE6OF01DAW0S.21.17.B06.1.454.CMB.1.raw
  modified_base (263)..(263): a, c, t, g, unknown or other
  misc_feature (263)..(263): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
  modified_base (500)..(500): a, c, t, g, unknown or other
  misc_feature (500)..(500): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggttttangataagtgatgcctggatgcactgggtccgccaggcaccgagggaggggctggagtgggtcggccgtagttagagggcgaagtgcgtgggtgggcgatagaatactctgcagcgtgagagcagattcaccatctcaganatgattcgagaaacncgatgcttcngcagatggatagctagagaaccgagacacaggccctatattagtgttaccagtagattacttaacctcggtanacgtacggtccttagg

SEQ ID NO: 270408 - DNA, 573 bp, Homo sapiens
  misc_feature: GYAE6OF01ECPJH.21.17.B06.1.454.CMB.1.raw
  modified_base (435)..(435): a, c, t, g, unknown or other
  misc_feature (435)..(435): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggttttatgataagtgatgcctggatgcacgtgggtccgccaggcaccgaggggaaggggctgggaggtgggtcggccgtagtaggagggcgaagtgcgtggggtggggcgagtagaatactctgcagccgtgaggaggcagacttcacctatcttcagtagatgtattacgaagaaacncgatgcttctgcagagtggatacgcctaggaacgaaccggaggaaccacgacggtccttacgttagttacgttcgttaccgaaggtacgtaattaacgttaaccgtaccggtagtaacccgttccggtccgttaacgg

SEQ ID NO: 270409 - DNA, 595 bp, Homo sapiens
  misc_feature: GYAE6OF01C4AGF.21.17.B06.1.454.CMB.1.raw
  modified_base (263)..(263): a, c, t, g, unknown or other
  misc_feature (263)..(263): n is a, c, g, or t
  modified_base (399)..(399): a, c, t, g, unknown or other
  misc_feature (399)..(399): n is a, c, g, or t
  modified_base (436)..(436): a, c, t, g, unknown or other
  misc_feature (436)..(436): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggttttangataagtgatgcctggatgcacgtgggtccgccaggcaccgaggggagggctggaggtgggtcggccgtattaggagggcgaagtgcgtgggtgggcgagtagaatactctgcagccgtgagaggcagattcaccntcttcagagatgattcgaagaaacacgatgctttcgngtcagagtagggactagccttaggaacggaacccgaggaaccgaacgacgggtcccttattaacgtttaacgtttcgtttacccaaagggtaacgtaagttttaaacgtttaaacccggttccgggttacgtaaaccgttccgggtccctttaaccggg

SEQ ID NO: 270410 - DNA, 571 bp, Homo sapiens
  misc_feature: GYAE6OF01CO6UV.21.17.B06.1.454.CMB.1.raw
  modified_base (461)..(461): a, c, t, g, unknown or other
  misc_feature (461)..(461): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagcgtggtcgtcctacggttgctagttttaaaaggtgtccagtgtgaaatacagctggtggagtctgggggagccttggtgaaggccggggggtcactcagactctcctgctctgcatctggttttatgataagtgatgcctggatgcacgtcgggtccgccaggccgaccgaggggaacgggcgtggaggtgggtcggccgtagttaggagggcgaaggtgcgtgggtgggcgagtagaatactctagcagccgtagaggagcagtattccaccattcgttacaggatatgtaataccgaagaaacgacgaattcgacttcgngacagtagtaggtatacggcctaggaaccgaaccggaggaaccacgacgccttatagttcgttacgttacagtataatagttaaccgtcgtacgtacctggtccttacgg

SEQ ID NO: 270411 - DNA, 727 bp, Homo sapiens
  misc_feature: GYAE6OF01AJ5WA.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccttgggtgaaggccgggggggtcacgtcagactctcctgctctgcatcttggttttatgataagtgatgcctggatgcacgtcgggtccgccaggcaccgaggggagggctgggaggttgggcggcgtagttaggagggcgaaggtgcgtggggtgggcgagtagaatactcgtgacaggtccgtggaggaggcaaggtacttaccacctattacgttcgaaggagtagttaggtaacgtttacgaacgtaaaacctacggtaattcggtacctttacgtaggaccgtaaggtagttacgggaacgttaccgggtacccgtaagggtaacgggaaaccccgggaaacggtacccgaaaccggtaccgggtcccctttaacggtttaacgttttaacggtttaccggttaacccgtaaagggttaacggttaaaaccgttttaacgtttaaaaccccggtttcccggggttaaacggtaacccggtttaacccccgggggttcccttttaaacccgggg

SEQ ID NO: 270412 - DNA, 631 bp, Homo sapiens
  misc_feature: GYAE6OF01DQ4I1.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccttgggtgaaggccggggggtcactcagactctcctgctctgcatcttggtttatgatagtgatgcctggatgcacgtcggggtccgcgacggaccgaccgagggggaaggggctgggacggtggggtccggaccgtagttacggagggacgtaaggtggcgtgggtggggcgaagtaggaatactcgtgcagtccgtgaaggagcaaggtacttacacccgaattccgttacgagaagtaagtacgtaagttccggaaagaaacccgtagaacgttaggccgtttactacggcaagtagtaggtactaggtaccctggaaacgaaccgaggaaccacgacggtcctagttacgtttcgtacgtccaaggtacaaatttacgttaaccgttccgggtaattaccggtaccggcctttaacgg

SEQ ID NO: 270413 - DNA, 602 bp, Homo sapiens
  misc_feature: GYAE6OF01DLZJW.21.17.B06.1.454.CMB.1.raw
  modified_base (267)..(267): a, c, t, g, unknown or other
  misc_feature (267)..(267): n is a, c, g, or t
  modified_base (299)..(299): a, c, t, g, unknown or other
  misc_feature (299)..(299): n is a, c, g, or t
  modified_base (396)..(396): a, c, t, g, unknown or other
  misc_feature (396)..(396): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccttgggtggaaggccgggggggtcacgtcagactctcctgctctgcatctggttttangataagtgatgcctggatgcacgtgggtcccnccgaggcaccgagggagggctggagtgggtcggcgtagtaggagggcgaagtgcgtgggtggggcagtaagaattacgtctgcgaaggccgtgaagnggacagtacgtcacctagtccttacagagtatagagttacgaacgaaacacgatcgcttcgtgcagtagtaggatacgcgtaggacaaccggagaccgacgacggtaccttactaacgttttacgttagttacccgtaaggtaacgttacttaacgtttaacccggtaccggttacgtaacccgttacccggttccgttaaccggg

SEQ ID NO: 270414 - DNA, 570 bp, Homo sapiens
  misc_feature: GYAE6OF01ELVZ0.21.17.B06.1.454.CMB.1.raw
  modified_base (267)..(267): a, c, t, g, unknown or other
  misc_feature (267)..(267): n is a, c, g, or t
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
  modified_base (465)..(465): a, c, t, g, unknown or other
  misc_feature (465)..(465): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtggggggagccgttgggtgaaggccgggggggtcactcagactctcctgctctgcatcttggtttangtataagtgatcgcctggatgcacgtcgggtcccgccgacggccaccggaggggaaggggctgggaggtcggggtccggacgtagttaggacgggcgtaaggtgcgtgggtgggcgagtagatactcgtgacgagcgtagagagcagtacttcactatctagagtanatgtatacgaagaaacngtatcgcttgcganagagtaggactacggcctaggaacgaaccggagacacgacggtcctattacgtacttgtacagtacgtattaacgtacgtccggtagaccgttcggtccgtaagg

SEQ ID NO: 270415 - DNA, 672 bp, Homo sapiens
  misc_feature: GYAE6OF01BF9CX.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagtccgttgggtggaaggccggggggtcacgtcagactctcctgctctgctattcgttggttttatgtaattaagtgtatcgcctggatgcgtacgtcgggtccgccgacggaccgaccggaggggaacggggcgtgggtagggttcgggtcgggtacgttagtagggacgggacgtaaggtggtcggtgggggtcgggagtaagtaagtaactacgtcgtcggacgacggtccggtaggacggaggactaaggtacttaccgaacctagtaccgttacgaaggtaagtagtagtaacgttacggaaacgtaaacgagtacgtcgtaccttcgagacgtaaggtacgtaggactaccgtacgtaggaaccgaaccggagaaccgacgtacggtacccttagttaacgttcgttacgtaccagtacgtaagttaccgtaccgtacggtataccgtcgtccgttacgg

SEQ ID NO: 270416 - DNA, 750 bp, Homo sapiens
  misc_feature: GYAE6OF01A200G.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccgttgggtgaagggccgggggggtcacgtcagactctcctgctctgcatcttggttttatgataagtgatgcctggatgcacgtcgggtcccgccgaggccgaccggagggggaacggggcgtagggagggtcggggtccgggtaccgttagtacggaggggacgaaggtggcgtggggtgggacgaagtagaacttactcgtgcgaggccgtagaggaggacagtacttccacctagttccttacgaaggtagtacgttaggtaacgttaacggaaacgtaaaccgtacggtacttcggtcctttcgtaggaaccgtagggtaacgttaggggtaaacttaccgggacccgttaaagggaaacccgggaaaacccgggtacggaaacccgtaccgggtaaaccgggttcccctttaaacgtttaacgttttaaccggtttacggttaaacccgaaggttaaacgttaaccgtttaaacgtttaacccggtcccggggttaaaccgtaacccggtttaaccggggtaccctttaaacgggg

SEQ ID NO: 270417 - DNA, 679 bp, Homo sapiens
  misc_feature: GYAE6OF01B7EKD.21.17.B06.1.454.CMB.1.raw
  modified_base (279)..(279): a, c, t, g, unknown or other
  misc_feature (279)..(279): n is a, c, g, or t
  modified_base (488)..(488): a, c, t, g, unknown or other
  misc_feature (488)..(488): n is a, c, g, or t
tcagtcgtcgctcgcacgaccggtgctcgatttagtcgatagtgaaggggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccgttgggtggaaggccgggggggtcaccgtcgagactctcctgctctgcatcttgttttatgaatagtnatgcgtggatgcacgtcgggtccgccgaggccaaccggagggggaacggggcgtgggagggtcggggtcgggaccgttaagttagggagggacggaaggtcggcgtggggtcggggacgaagtaaggaatcgtctggcgagccgtagaggaggcaggtacttacgacctattccttacgaggtagagtagtaacgttacgaagaaaacncggaattcggtacctttgtacggacgaaggtacggtaggaacgtacgtaccgtacggaacgggtaaacccggacggaaccgaccgtacgggtcccttaagtttaatttaacggttcgtaacctaagggacgttaaattacgtttaaaccgtccgggttaacgaacccgtttaaccgggccgtttaaacggg

SEQ ID NO: 270418 - DNA, 737 bp, Homo sapiens
  misc_feature: GYAE6OF01CX1RF.21.17.B06.1.454.CMB.1.raw
  modified_base (267)..(267): a, c, t, g, unknown or other
  misc_feature (267)..(267): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccgttgggtggaaggccggggggtcactcagactctcctgctctgctatctggttttangtataagtgatgccgtggaatcgctacgtcgggtccgccgaggcgaaccgaagggggaacggggtcgtaggggacgggtggggtaccggaccggttaagttaacgggaggggacgtaaagggtcggtacggtggggtggggacgaagtaaggtaactacgtctacggacaacggtccgtaggacggacggtacgaacggtacttaccgtaaccctatttaccccgttagaaagggtaagtagttaacggttaaagtttacccggaaaagtaaaacccgtaacgtacttacggtaccttttacggagtaaccgtaaggaagttagggaacgttcgggtaaccgagggtaaacgaaacccgggagaacccgaaggacggtaccttacgttaaagtttacgttacgttaccaaggaagttaacgttaacgttaaacccggtcgggttataacccggtccggttccttaacggg

SEQ ID NO: 270419 - DNA, 707 bp, Homo sapiens
  misc_feature: GYAE6OF01CRVW0.21.17.B06.1.454.CMB.1.raw
  modified_base (273)..(273): a, c, t, g, unknown or other
  misc_feature (273)..(273): n is a, c, g, or t
tcagtcgtcgctcgcacgaccggtgctcgatttagtcgatagtgaaggggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtgggagtcgtggggggagtccttgggtgaagggcccgggggggtcactcagacctctcctgctctgcatcttggttttangataagtgatgcctggatcgcacgtcgggtccgccaggcaccggaggggaggggcgtgggaggtggggtccggcgtaagtagggagggcgaaggtggcgtggggtgggcgaagtagtatactcgtggactaggccgtaggacggaggccgaaggtacttaccacctacttacgttcgaacgtagtacgtagtaacgtacggaaacgaaaaccgtacggtactacggttacctttcgtacgacgtaagggtaacgtagggtaacgttaccgtacccggttaaggggaaacccgaaacccggggtaacgaaccggaaccgggtaccggttaccctttaacgttaagtttttccgtaacggtttaccggaaagttagtaaactttaaccgttaacggttacccggtacgtaacccggtaccggttccgttaaccggg

SEQ ID NO: 270420 - DNA, 791 bp, Homo sapiens
  misc_feature: GYAE6OF01DJEI8.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgcttagttttaaaaggtgtccagtgtagaaatacagctggtggagtcgtgggggagtccgttggtggaagggccggggggtcacgtcagactctcctgctctgctattcgttaggttttatgtaagttaagtgtagtcgtccgttggaatcgctacggtcgggtccgccgacggaccgaccggaggggaacgggcgtagggtagggttcggggtccggtaccgttaggttaacgggacggggacgtaaggtcggcggttggggtacgggggaccgtaaagtaaggtaacgttaccgtcgttcggaccgacgggtaccgtagggaacggcggactaagggttacctacccgaactacgtttactacgaagtagtacttaggtacgttaacgaaacggtaactaacggtcttacgtactttcgacggacgtaagtcggtaagggtactaccggtacgtaacggaaaccggtaacccggaagggtaaccctaaccggtacgggttaccccttaacgtttaaacggtttaccgttttacgtaaccccggtaaagttaacgttaactttaaaccggtttaacccggttaccgggtaacccggttaacccgggtttaacccgggtccttttaaaccccgggg

SEQ ID NO: 270421 - DNA, 672 bp, Homo sapiens
  misc_feature: GYAE6OF01EYFDL.21.17.B06.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatcagctggtggagtcgtggggganccttgggtgaaggccggggggtcactcagactctcctgctctgcattcgttggttttatgtataagtgatcgcctggatgcacgtcggggtccgcccgaggccgaaccggaagggggaacggggggccgtagggggacggttcgggggtccgggtaccgttaagtttacgggacggggtacggtaaggtggtcgtgggggtcggggacgtagtaagtaaacgtactcgtggcagtccggtagagacggcagacttacaccgtatcgttacgagagtatgtattacgaagaacgtacgacttcgtcttacgtcgactaggacgttggaactcggtaccgtagggaacggtaaccggaggaacctaccggaaggtcccctagttactttaacggttcgtaaccgtaggtaacgtaatttaacgttaaccccggttcggtaagtacccttaaccgggctttaaccggg

SEQ ID NO: 270422 - DNA, 773 bp, Homo sapiens
  misc_feature: GYAE6OF01D6R65.21.17.B06.1.454.CMB.1.raw
tcagtcgtcgctcgcacgaccggtgctcgatttagtcgatagtgaaggggggagacgagccccagccttgggattcccaagtgttttcattcagtgatcaggactgaacacagaggactcaccatgaagttggctgagctgggtcttcctcgttgcttagttttaaaaggtcgtccaagtgtagaaatacgagtcgtgggtagggaggtcggtgggggtacgtccggttgggtagggaacggggtcccggggggtactaaccgtaccgacgtaccgttcctcccgtgtcctcgtcgactattcgtttaggttttatagtaataagtgacgtgtccgtaggtatcgcgtacgtcggtccggaccgaggaccgacggagggggtagggcgtaggggtaggtcgggtacggtacgtaggtagggacgggtacgtaaggcggtacggtggggtacgggaacgtaagtaaagtaacttacgtcgtacgacgtacggtaccgggtagaacgggacggtaacgtaacgtaacttacccgaaaccttacttaaccgtagaagtaacggtaattacggtaataacggaacgaaaccgtatacgttcgtcttagaagacgtaaggtagtacgtacggtacgtaccggaaaggtaacccggaacggtaacgacgtaaccgacgtttcctaaagttacgtttacttcggtaaactaaggtaacgttaactaaacccggttttacggccggttaaaacgcccgttaaacccggtcgttaaaccggg

SEQ ID NO: 270423 - DNA, 790 bp, Homo sapiens
  misc_feature: GYAE6OF01EFTWN.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgcttgtttaaaaggtgtccagtgtgaaatacagctggtggagtcgtgggggagtccgttgggtggaacgggccgggggggtcacgtcgacggacctctcctgctctgctatcgttaggttttatgtaattaagtgtatcggtccgtggtatcggcgtacgtccggggtcccgccgaacggaccgaccgggaggggggaacgggggtcggtggggaagggtcgggggtccgggtaccggttaagttacgggaggggtacggtaaagggtggtaccgggtgggggtacgggggaccggtaagttaaaggtaaacgttaccgttacgtcgggtaccgtacgggtacccgggtagggaacggggtaacgggaccgtaaagggttaaccttaccgaaccccgttaagttaccggttaaccaaagggtaagttaagttaggttaaaccgtttaaccgggaaacgtaaacccgaccgggttaatccggtacctttcgtacgaccgtaggtagtaacgggtactaccggacgtaggaaaccgaacgggacgtaacaccggacgttccctattaacgtttagttaccgtacgtaagtacgtaaatttaccttacggtacgtagtaaccgtccgtcggttaaccg

SEQ ID NO: 270424 - DNA, 743 bp, Homo sapiens
  misc_feature: GYAE6OF01C1RA9.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccgttgggtggaaggccgggggggtcactcgagactctcctgctctgcatctggttttatgataagtgatgctggatgcgtacgtcgggtcccgaccgacggaccgaaccggagggggaacggggcgtaggggacgggttcggggtccggtaccggttaagttaggggagggacggtaagggtcggacggtgggggtacggggacgtaaagtaacggtaaacgttacgtcggtacggacgtacggtcccggtaggaacggacggacgtaacggtaaccttccgaaccgttattaccgttagaaaggtagtaagtacggtaaacgttaacggaaacgaaaaccgtacgtacgttacgtaccgttacgtagaaccgtaaggtacgtagggactaacggtacgtaacggaacggaaacccggaggaaccgtacggacggtacccttaacttaagtttacgttacgtaccgtaggtaaacttacgtttaaacgttaacccggtacggtaacgtaacccggtacggtcccgtttaacggg

SEQ ID NO: 270425 - DNA, 772 bp, Homo sapiens
  misc_feature: GYAE6OF01C18K5.21.17.B06.1.454.CMB.1.raw
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
tcagtcgtcgctcgcacgaccggtgctcgatttagtcgatagtgaagggggagacgagccccagccttgggattcccaagtgtttcattcagtgatcaggactgaacacagaggactcaccatgaagtttggctgagctgggtcttcctcgttgctgtttaaaaggtgtccagtgtagaaatacagctggtggaggtcgtgggggagtccgttggtggaaggccggggggtcactcagactctcctgctctgcatcttggttttanagtattaagntatcgccgtggatcggcacgtcgggtccgcgaggccgaccgaaggggacgggcgtggaggtcgggtcggcggttagtaggagggacgaaggtggcgtggggtcgggacgtaagtaaaggtaacttacgtactggacgtacggtccggtaggacggacggtacgaacggtacttaacccgaacccctaattacccgttaacgaaaggtaacgtaagttaggtaaagtttacccggaaacgtaaaactaccgggtaatcgggttacctttacgtaccggaacgtaagggtaataggggtaaacgtttaacgggacccgtaaggggaaaacccggtaaccgggaaggtaaaccccgaaacggtaacccgtccgtttaacgttaaaacgttttcgtttacccggaaacgttaaggtaaaaccgtttaaaccgttaacgttttaaaccccgggtaccgggttaaacggtacccgtttaaaccgggtcctttaaacccgggg

SEQ ID NO: 270426 - DNA, 533 bp, Homo sapiens
  misc_feature: GYAE6OF01BZLR4.21.17.B06.1.454.CMB.1.raw
  modified_base (463)..(463): a, c, t, g, unknown or other
  misc_feature (463)..(463): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
  modified_base (515)..(515): a, c, t, g, unknown or other
  misc_feature (515)..(515): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatcttggttttatgataagtgatgcctggatgcacgtcgggtccgccgacgggcaaccggaggggaagggggccgtggggaggtcggggtcggccgtagttagggagggcggaagtgcgtgggtgggcgagtagaatactctggcagccgtgaggaggcagactacactatctacagagatgattacgaagaaacacgagtgcttcagcagntggatgctagacgaccgagacacgagcctgtattntntcngatatacttacncggtagctcggcttacgg

SEQ ID NO: 270427 - DNA, 761 bp, Homo sapiens
  misc_feature: GYAE6OF01CRYA0.21.17.B06.1.454.CMB.1.raw
  modified_base (588)..(588): a, c, t, g, unknown or other
  misc_feature (588)..(588): n is a, c, g, or t
tcagtcgtcgctcgcacgaccggtgctcgatttagtcgatagtgaaggggagacgagccccagccttgggattcccaagtgtttcattcagtgatcaggactgaacacagaggactcaccatgaagtttggctgagcgtggtcttcctcgttgcttagttttaaaaggtgtccgagtgtagaaatacagcgtggtggagtcgtgggggacgtccgttggtggaacggccggggggtcacgtcgagtactcctcctgtctctgctagtcgtttggtttatagtaagttaagtagtacgtcgtccgtggactgcctaacggttccgggcccgaccgaacgggcccgaaccgggaagggggaacggggtccggtaggggtaacgggttcggggtacggtaccggttaagttaagggacggggtacgtaaggtcggtacggtgggggtacgggacggtaagtaaggtaacgttacgttcgcggacgtacggtccgtaggacggaggtacaggtactacctaccgtacttcgtacgaagtaagtagtaacggtaacttaacggaaactaaacgtacgtaacgtcgttaccgtntacgtagaggtaagagtaacgttaccggcgtaacggaaacgtaaccggacgaccgtaaccggtaacgtcccttaagttaacgtttacgttaccggttaacgaaacgttaagtaacgtttaacgtttaacccggtaccggttagtaaccttaaccccgggtcgttaaacccggg

SEQ ID NO: 270428 - DNA, 725 bp, Homo sapiens
  misc_feature: GYAE6OF01EAE51.21.17.B06.1.454.CMB.1.raw
  modified_base (168)..(168): a, c, t, g, unknown or other
  misc_feature (168)..(168): n is a, c, g, or t
  modified_base (247)..(247): a, c, t, g, unknown or other
  misc_feature (247)..(247): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagcggtgtgtccaggtcgctagtttaaaggntcagtgtgaatacagctggtggagtcgtggggagcttggagaaggtccgggggtcacgtcagacctctcctgctcgtanctattcgttagttagtagtaagtagtagtacgtcgtacgtagtagtcgtacgtacggtcggtaccgaccgacggacgacggaacggggacgggtacggtacgggtacgggtacgggtacgggtacggttaacggtagggtacgggtacggtacggtacggtacggtacggggtacgggtacgtaacgtaacgtaacgtaccgtacgtacgtacgtacggtacggtacggtacggtacggtacgtaacgtaacgttaaccgtaaccgtaccgtacgtacgtaggtaacgtaacgtaacgtaacgtaacgaacgtaacgtacgtacgtacgtacgtacgtacgtacgtaacgtagtagtacgtacgtacgtacgtacgaacgacgacgtacgtacgtacgtacgttacgttacgttacgtacgtacgtaacgtaacgttaacgttaaccgttaccgtacgtaaccgtaccgtaccgtacg

SEQ ID NO: 270429 - DNA, 714 bp, Homo sapiens
  misc_feature: GYAE6OF01DKET3.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccttggtggaaggccggggggtcactcagactctcctgcctctgcattcttggttttatgataagtgatgccgtggatgcgtacgtcgggtcccgccgacggccgaaccggaggggaacggggcgtgggaggtcggggtccggccgtagttaggagggacgaaggtgcggtggggtgggacgagtagaactcgtcgtgcgacgccgtaggacggaggacgagtacttaccgaaccctagtttcctacgaaggtaagttagtgtaacgttaccggaaagaaaccgtacgtagtccgttctttacgacggactaggacgttagggtaacttacggtacccgtaaggaaacccgaaaccgggacggaaccaaccgtaccgggtaccctttagttaacgttttacgttaccggtttaacccgaaaggttaaccgtaaagttttaacccgttaacccggtttacccggtaaggtttaaccccgtaaccggggttccccgttttaaacgggg

SEQ ID NO: 270430 - DNA, 592 bp, Homo sapiens
  misc_feature: GYAE6OF01A047Y.21.17.B06.1.454.CMB.1.raw
  modified_base (376)..(376): a, c, t, g, unknown or other
  misc_feature (376)..(376): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtggggagccgttgggtgaaggccggggggtcacgtcagactctcctgctctgctatcttggttttatgataagtgatgcgtggatgccacgtcgggtcccgccgaggccgaccggaagggaagggcgtgggaggtgggtcggccgtaagttaggagggacgaaggtgacgtggggngggacgaagtaagaactacgtcgtgacacggccgtagaggaggcagtacttcacctatcttacgagtagtagtacgtagttacgaagaaacacgaagtcgtcttcgagacgagagtaggagtacgtcgtagaacgaacgacggacgcgtcggtcctattagttcgtcgttcagtactaattacttaaccgtcggtaagccgttacggtccgttacg

SEQ ID NO: 270431 - DNA, 788 bp, Homo sapiens
  misc_feature: GYAE6OF01DRLOD.21.17.B06.1.454.CMB.1.raw
  modified_base (295)..(295): a, c, t, g, unknown or other
  misc_feature (295)..(295): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgcttagtttaaaaggtgtccagtgtagaaatacagcgtggtggagtcggtgggggagtccgttgggtggaacggggtccgggggggtacaccgtcgaacgtacctcctccgtcgcctcgtgctagttcgttggttttagngtaaataagtgagtcggaccgtggtatcgacgtcggtcgggtacccgcgacggaccgtaaccgggagggggtaacggggcggtggggtagggtcggggtaccgggtaccgttaaggtaacggggacggggtacggtaagggttcgggtacgggttgggggtacggggtaacgtaaagttaaacggtaaacgttacggtcgtacgcgtaaccgggtccggagggtaaagggacggtacgtaaggtaccttacctaacccggtattaccgttagaacggtagtactaggtaactacggtaaaagaacgtacgtaggtccttacgtactcggtacgagtaggttacaacggttcgaacccgtaagggtaaacggaaccggtacgaaaacggtccgtaacggtacctttaacttaacgtttagttaccggttaacgaagttaagtaacgttaacccgttacggtacggtaccgtaacccgttcggttacgttaccgg

SEQ ID NO: 270432 - DNA, 815 bp, Homo sapiens
  misc_feature: GYAE6OF01DVO4I.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagttggctgagctggtcttctcgttgtcttagtttaaaggtcgtcagtgtagaaatacagcgtgggtaggagtcggtgggggacgtccggttgggtagggaacggggccgggggtcacgttcgacgtactcctcgtcgctctgtactacgttgtttaggtttatagtaagttaaggtcgacgttcggcgtaggtacgtcgacgtacgggtccgggtcccgacggaacggacgaccggggaaggggtacgggtcgtaggggacgggtcgggtaccggtacgtttaagggacgggtacgggtaacgtagggtcggtacgggttagggggtacgggaagtaaaggttaacgtaacgttaccggttacggacggtaccggaaaccggggttaccgggaaggaaaggggtaaccggtaccgtaaacggttaacccgttaaccctaaccggtttacttacggttaacggaacggttaaacggtaggttaacgtaaacggtaaaccggaaacgtaaaccgtagtacgtacgtacgtttgacgtacgaagtacgtacgtagaccgtacgtaaggaaacggaccgaggaccgtacggtacttaaccgttagttaacgtcgtttacgaacgtaaagggtacttaaacgttaaccggtaccgttaccgtaaggttacccgttacggttccgtaaaccggg

SEQ ID NO: 270433 - DNA, 923 bp, Homo sapiens
  misc_feature: GYAE6OF01AHV0F.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaggtgtccagtgtgaaatacagctggtggagtcgtgggggagccgttgggtgaaggccggggggtcactcagactctcctgctctgctattcttggttttatgattaaggtgatgccgtggatgcacgtcgggtccgccgaggccgaaccggaggggaacggggcgtaggggtagggttcggggtccgggtaccggttaaggtttacgggacgggggtaccggtaaagggttcggtccggttagggggggtacgggggacggtaaaggttaaaggtaaaacgttacccgttacggttcggaccggtaacgggtacccggtagggaacgggacgggtacgaacggttaacgtttaccccgaaacccttacgtttacccgtttacggaaggtaacggtacgttaacgggttaaacggtttaaccgggaaaccggtaaaaaccgtacgggttaaacgttccgggtttaccctttcccgggttaggaccccgtaaagggtacggttaacgggtaacgttaaccgggtacccggtaacggggtaaacccggtaaacccggggtaaggaaccccggtaaacccggtccgggttaaacccctttaaccgttttaacgttttaaccgttttacccgggtttaaaccggtaacgggttaaacgtttaaaccgttttaaacccggttttaaaaccccggttacccggggtttacgggtttaaacccccggtttacccgggggttaacccgtttttaaacccccggggg

SEQ ID NO: 270434 - DNA, 710 bp, Homo sapiens
  misc_feature: GYAE6OF01BRWGV.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagttgggctgagctgggtcttcctcgttgctgtttaaaagtgtccagtgtgaaatacagctggtggagtcgtgggggagccgttggtggaacgggccggggggtcacgtcagactctcctgctctgcatcgttggtttatgataagtgtatcgccgtggatcgcgtacgtacgggtccgccgaggccgaccggaagggggacggggtcgtgggacgggtggggtccggtaccggttaggttagggacggggtacggtaaggtcggtacggtgggggtacggggacgtaaagtaaggaacgttacgtcgtcggccgacggtccggtaggaggacggtacgagtacttaccacctatccttacgaagtagtaagtagtaacgttacggaaacgtaaaccgacgtagtcgtacctttcgtagacgtaaggtagtaggtaacgttacggaccgtaacgggaaccggaaccggaacggaacctaacggtaccgttaccttaacgtttacgttacgtttaccggttaccgtaagtaacgtaacttaaccgttaccgtacgggtacgtaccgtcccggttcgttaacccgg

SEQ ID NO: 270435 - DNA, 890 bp, Homo sapiens
  misc_feature: GYAE6OF01ASYWX.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttggctgagctggtcttcctcgttgctgttttaaaggtgtcagtgtgaaatacagcgtggtggagtcgtggggagtccgttggtgacgggccggggggtacacgtacagtactcctcctcgtctcgtgctatcgttaggttttatagtattaagtcgtagttacgtccgtaggtatcgtaccgtacggtcgggtccccgaccggtaccggaccggaacccggaaggggtaacgggtacgtaggggtacgggttcgggggtaccggtaccggtaaggttacgggaacggggtacggtaacggtcgggtacgggtgggggtacggggtacgtaacgtaaggtaacgttacgttacggtagaccggtacggtacccgtaagggacgggtaacggtacggtaacgttacgttaaccccaacccgttagttacccggtttaacgacgggtaaaggttcgttaaacgggttaaccggtttaaccggaaacgtaaacccggtaggttaacccgttcgttaacccgtttacggacggtaaccgtaagggtaaccgtttaaggggaacccgttaacgggtacccgttaaaccggggaaacccgtaaacgggaacggaaccgtaaaccggtccggtttaaaacccggtttacgtttaagtttaaccggttaccgggttttaacgaaaggttacgtttaaacccgtttaaccgtttaacccccgggttacgggttaaacgttaccccggtaacccgggtttccgtaaccggg

SEQ ID NO: 270436 - DNA, 629 bp, Homo sapiens
  misc_feature: GYAE6OF01ATJ0R.21.17.B06.1.454.CMB.1.raw
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (454)..(454): a, c, t, g, unknown or other
  misc_feature (454)..(454): n is a, c, g, or t
  modified_base (468)..(468): a, c, t, g, unknown or other
  misc_feature (468)..(468): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacaactggtggagtcgtgggggagccgttggtggaacggccgggggggtcactcagactctcctgctctgctattcgttggttttatgtaataagtgatgccgtggatcgctacgtcgggtcccgccgaggccaacggaggggaagggcgtgggaggtcgggtcggcgtagtagggagggacgaaggtgcggtgggtggggacgagtagaatcgtgngcngcgtgagngacagtactcactatctagagacatagtatacgaacgaacgngtatcgtcttacgngactagtagtacgatacggacgtaggaacgtaaccggacggaacacggacgtaccttagtttaacgttaggttacttaccggaagttacgtaaactttaaccgttaaccggttcccggttaagtaacccgtaacccgggttccgttacggtaaacccgggg

SEQ ID NO: 270437 - DNA, 638 bp, Homo sapiens
  misc_feature: GYAE6OF01EKY8V.21.17.B06.1.454.CMB.1.raw
  modified_base (168)..(168): a, c, t, g, unknown or other
  misc_feature (168)..(168): n is a, c, g, or t
  modified_base (174)..(174): a, c, t, g, unknown or other
  misc_feature (174)..(174): n is a, c, g, or t
  modified_base (184)..(184): a, c, t, g, unknown or other
  misc_feature (184)..(184): n is a, c, g, or t
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (383)..(383): a, c, t, g, unknown or other
  misc_feature (383)..(383): n is a, c, g, or t
  modified_base (500)..(500): a, c, t, g, unknown or other
  misc_feature (500)..(500): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttggctgaggcggtgtcgtcaggtcgcgtagtttaaggntcagtntagaatacgngtgtggtgacgtgtgggctcgtggaggagggccgggtanacctgagtcctctcctgcgttcagtctattgtagtttanagtagttagtccngtactagtgtacgtcgtaccgtcggtccggccgtaaccgaacggtaccggtaacgggagggtcggtcggtaggtacggtcgggtacgtacgttaaggagggagtacgnggtggcggtggtacgaagagtacacgtgtcgcgacgaggtcgaagggcgtagagttaacggtaacctcagttacgtacgtagtaagaggtacgtacgtaagtaacgtaagtaccgtnttacgtacgttacggttagcgacgtacgtagtacgtacgtacgtacgtaacgacgaacgacgacgtacgtacgtacgtacgttacgttacgtacgtacgtagtagtacgtacgtacgtacgtagtacgtcgtcgtacg

SEQ ID NO: 270438 - DNA, 690 bp, Homo sapiens
  misc_feature: GYAE6OF01A9CIZ.21.17.B06.1.454.CMB.1.raw
  modified_base (463)..(463): a, c, t, g, unknown or other
  misc_feature (463)..(463): n is a, c, g, or t
  modified_base (497)..(497): a, c, t, g, unknown or other
  misc_feature (497)..(497): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttggctgagctgggtcttcctcgtgcttagttttaaagtgtccagtgtagaaatacagctggtggagtcgtggggagtccgttggaggaacgggccgggggtcacgtcgacgtactccgtcctgtctcgtgctagttcgttgtttatgtattaagtcgtagtcgtcgtggtactcgacgtacggtccgggtaccgccgacggaccggaaccgggaaggggacggggtcgtaggggtacgggtaccgggtcggtacgttaggtagggacgggtagaggtcggtcggtggggtacgggataagtacgtaactcgtacgtgcgtacggcgtaggagnggacagtacgtacctatattacagaagtaacgtnttaacgtataaacggaacaaaccgtagtacgtcgtaccgtgtacgacgtagtacgtggtaacacggtaagtacggaaacgaaccgtacggaacctagggaccttcgttaaagtttgtacgtttcggaaactaggtaaacgtcttttaaacggtcccggttactaacggtcccgttacggtcccgttaaacggg

SEQ ID NO: 270439 - DNA, 804 bp, Homo sapiens
  misc_feature: GYAE6OF01CBIRS.21.17.B06.1.454.CMB.1.raw
tcagtcgtcgctcgcacgaccggtgctcgatttagtcgatagtgaagggggagacgagcccccagccttgggattcccaagtgttttcattcagtgatcaggactgaacacagaggactcaccatgaagtttggctgagctggtcttcctcgtgcttagtttaaaaggtgtccagtgtagaaatacagtcgtggtggagtcggtggggacgtccgttgggtaggaacgggccggggggtcacgtacgacggtacctcctccgtcggtccttcgtcgcctagttcgttagttttagtagtaagtaggtgtacgtcgtaccgtggatcggtccacggttccgggcccgccgtacgggaccgaaccggaagggggaacgggtcgtacgggtaacgggttcggggtaccggtaccggttaaggtaacgggtaacgggtacggtaaacggtcgggtacggtacgggggtacggggtaacgaaggttaaacggaacggttaccctagttacggaccgtaacggtaccgggtacgggaacggtacggaacgttacgtactttaaccgaaccgttcgtacgtttacgacgaaagttcgttaacggtactttaaagaaaccggtaacgttaccgagttaccgtataacgtcgaacgtgtacgtaggtaactccgtaacgtaagaacggtaaccgacggaaccgtaacgaccgttaccgttagttaccgtttaagtccgtttaacgacggttaactagttaaacccggttacgggttaacccgtagtaaacggttccccggtacgttaaccggg

SEQ ID NO: 270440 - DNA, 727 bp, Homo sapiens
  misc_feature: GYAE6OF01CFBZ7.21.17.B06.1.454.CMB.1.raw
  modified_base (557)..(557): a, c, t, g, unknown or other
  misc_feature (557)..(557): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgcttagttttaaaaggtgtccagtgtgaaatacagctggtggagtcgtgggggagtccgttggtgaagggccggggggtcactcagctctcctgctctgctagtcttggttttatagtattaaggtgagtcgccgtggatcgctacggtcgggtcccgccgacgggaccgaccggagggggacggggcggtaggggacgggtcggggtccggtacggttaagtagggagggtagaaggtcggcggtaggggtcgggacgtaagtaagaactacgtcgtcgacgacgcggtaggacggaggacaggtactaccacctagttccttagaacggtaagtacgtagtaccgttaacggaaacgaaaaccgtcggtactacgttcccgtttacgtaggacgtaaggngttaacgggtacgtacggtaacccgtagggaaacccgtaacgggaaccgaccggtaaccgtacgtacccttagtttaaacgttcgtttaccggtaaccgaaggttaaccgttaatttaacccggtttaaccggttcggtaacggtaccccgttacggtcccgttaacggg

SEQ ID NO: 270441 - DNA, 731 bp, Homo sapiens
  misc_feature: GYAE6OF01DQHMM.21.17.B06.1.454.CMB.1.raw
  modified_base (334)..(334): a, c, t, g, unknown or other
  misc_feature (334)..(334): n is a, c, g, or t
tcagtcgtcgctcgcacgaccggtgctcgatttagtcgatagtgaagggggagacgagccccagccttgggattcccaagtgttttcattcagtgatcgagactagaacacagagactacaccatagtagttggcgtgagcgtggtcttccgtcgttgtctttaaggtttaaaggtcgtccgtagtgtagaaatacgagtcgtggtggtacgtcgggtggggacgtcgttgggtaggaacggggtccgggggtctacgtcgacgacttccgtcctcgccttcgtcgacgtattcgtttagtttagagttaagtagtgtagtcgtcgtgtacgtnacgtcggtacggtcccgacggacgaccgaccggaaggggacggtcggtagggtacggtcggggtccgtacggttaaggtagggaacgggtacggtaaggtcggtacgggtggggcgggtacgtaagtaaacgtacttcgtacgtcgacgcggtcggtagacggaggactacgtactaccgtacctagttaccgtaagagtaatcggtaagtaacggtaacgaaacgtaacgtaacgtacgttcgtacgttcggacacgtagtacgtacgtaacgtccgtactaacgggaacgtaccggagaaccgacgtacccgtacttagttacgttacgttgtaccgagtaaacgttagttaaccgtacggttaccggtagttaacccggcgtttaacggtaccg

SEQ ID NO: 270442 - DNA, 851 bp, Homo sapiens
  misc_feature: GYAE6OF01DHAWJ.21.17.B06.1.454.CMB.1.raw
  modified_base (167)..(167): a, c, t, g, unknown or other
  misc_feature (167)..(167): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagttggctgagctggtcttctgttgtcttagtttaaaaggngtccagtgtagaaatacagcgtggtggagtcggtagggggacgtccgttgggtaggacggggccggggggtacacgtcgaacgacctcctctgctcgtagtctagttcgttaggttttatagtagttaaggtgtacgtcggtcgtggtatcgtacgtacggtccggtccgacggaacggaccgaaccgggaagggggtaacgggtccggtaggggtacgggttacggggtaccgggtaccggttaaggttacggggagggacggtaaggtcggtcgggtagggggtacgggtacgtaaagtaacgtaactacggttcgcggacgtacggtccggtaggacggtacggacgtaacggtacttaccgaaccttgttaccgttagaacgggtaaagtcgtaacggtaacgttaagaaaccggtaaacgtcgttaactcggtaccgtttagacgtaaacgaaggtacgtacgggtaaacgtccggtaaccgtaaacggggaacgtaaacccgggaacggtcccttaaaacgggtacccgggtaacctttaaggtttaacggtttaccctttaacgggtaacccgtaaaggtaaacccgtttaaaacgtttaaacccgggttttaacccgggaccgggtttaaaccccggaacccgggttttaaccggttacccggtttaaacccgggg

SEQ ID NO: 270443 - DNA, 723 bp, Homo sapiens
  misc_feature: GYAE6OF01D2801.21.17.B06.1.454.CMB.1.raw
  modified_base (268)..(268): a, c, t, g, unknown or other
  misc_feature (268)..(268): n is a, c, g, or t
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
  modified_base (593)..(593): a, c, t, g, unknown or other
  misc_feature (593)..(593): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgagttggctgagctggtcttctcgttgcttagtttaaaggtgtccagtgtagaaatacagcgtggtggtagtcggtgggggactccggttgggtagggaacgggtcccggggggtcacgtcgacgtacgtcctccgttgcctcngtacctattcgtttaggttttanaggtaataaggtagtagttcggacgtaggtancgtactacggtccggtcccgaccgacggaccgaacgggaaggggtaacgggtcgtgggaacgggtccgggtacggtacgttaagtacgggaacgggtagtaacggtggtacggtggggtaacgggacgtaagaagtaacgttacgcgtcgacgtacggaccggtagacggaacgtccgtaagtaccttccgaaacgttcgtacgttacgaagtaggtaacttacgggtaactaacggaaacgtaacgtacgtacgtcgtacgtcggtaancgaagtagtacgactacggtaaggacgtaaggaccggtacaaccgacgtcgttaacttacgtttaggttacttgtaagtaagacgtattaaccggtaccgagttacccgaacggttcctacggttaacgg

SEQ ID NO: 270444 - DNA, 907 bp, Homo sapiens
  misc_feature: GYAE6OF01C1WTG.21.17.B06.1.454.CMB.1.raw
  modified_base (504)..(504): a, c, t, g, unknown or other
  misc_feature (504)..(504): n is a, c, g, or t
tcagtcgtcgctcgcacgaccggtgctcgatttagtcgatagtgaaggggagacgagccccagccttggattcccaagtgttttcattcagtgatcaggactgacacagaggacctcaccatgtaaggtttggctagacgtcgtcggtacctttcccgttgttgtcgtttaagttttaaaaggtcgtaccgtagtagtagtaaactacgtagtcgtgggtaggtaggttacgggtagggggacgttccggttagggtacgggaaccgggggtcccgggggtacctaccgtacgaacggtacccttccttccgtcgtacctcgttcgtacgtacgttcgtttagttttagtagtaagttaagtgtacgtcgtaccgtaggtcgtacgtccgtaccggtcggtccccgaccggacggtaccggaaccgggaaggggtaccgggtcggtacggggtacgggtcgggtccgggtacgttaaggttacgggagggtaacgtaggtcggnggttacggggtacggaacggttaagtaacggtaacgttacgtccgtcgaaccgtaccggacggtaggaacggtaccggacgtaacgttacctaacccctacgttacgtttacccgtaaaggacgggtaaacgttacgttaacggtttaaacgaaccggttaaaaccgaaacgttccggttatacccgttaccgtttacgaacggtaaccgtaaggtaaccggttaacggtaacgtccgtaaccgggtaacgaaacccgggaacccggtagaacccgtaacggtccgttaaacccgtttattaaacggttttccgtaacgttaacggaacgttactttaaacccggtttaacggtaacccgggttccgtaaacgtttaccccggttagtttccccgtaaacggg

SEQ ID NO: 270445 - DNA, 826 bp, Homo sapiens
  misc_feature: GYAE6OF01DS1NU.21.17.B06.1.454.CMB.1.raw
  modified_base (617)..(617): a, c, t, g, unknown or other
  misc_feature (617)..(617): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagttgggctgagcgtgggtcttccgtcgttgcttagttttaaaaggtgtccagtgtagaaatacagcgtgggtggaggttcggtggggggacgtccggtttggggtacgggaacgggggtcccggggggggtacctaacgtccgaacgtaccttccgtccgtcgtctctcgctagttcggtttaggtttataggtaattaaggtcgtatcggtaccgtggtagtcgtaccgtacggtccgggtccccgaccggacggacgaacgggaagggggtacgggtcggtggggtgggtcggggtacggtacgttaagggtagggacgggtacggtaggtggacggtgggggtacgggtacgtaaggtaacgtaaccgttccgtacggtacggacgtacgggtccggtaggacgggaacggtacgaaggttactaccctacgttacttaccgtacgaagtaagtcgtaagtaacttaacggaacgtaaacgtacgtntcgttaccgttatacggtagacggtaagtggtaacgacgtaccggtaaggaaacccgaacggtaccggaacgtaccggtacccgttacgtttacgttaaacggtttccggttaacgtacggtaaacggttaactttaaccggttaacccggttaccgggttaacccggtaaggtttaaccccggtcggtttaaccccggttaacccggg

SEQ ID NO: 270446 - DNA, 762 bp, Homo sapiens
  misc_feature: GYAE6OF01A9CBE.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgcttgttttaaaaggtgtccagtgtgaaatacagctggtggagtcgtgggggacgtccgtttgggtaggaacgggcccggggggtcacgtcgagacctccgtcctgctctgcattcgttggttttatgtaattaaggtagtacttcgccgttagggtactcggacctacggttcgggtacccgaccgacggaccgaaccggtaagggggacggggtccggtaggggtacgggtcggggtaccggtaccggttaaggttaacgggagggtacggtaaaggttcggtacggttgggggtagggacgtaagtaacgaacgtacgtcgtgaccgacggtaccggtagaacggtacggacgtaacggtaccttaccgaccttacgttacccgttagaaagtagtaacgttacgttaacgttaaccggaaacgtaaacgtacgtacgttacgtacttcgaagacgtaggtacgtaggtaacgtaccggaccgtagaaaccggtaaccgaggtaaccaacggtacgttcccttaaggtttacttacgttccgacctaagtaacttacgttaacgttacggtacccgtaagtacccttaccggtcgttaaaccgg

SEQ ID NO: 270447 - DNA, 782 bp, Homo sapiens
  misc_feature: GYAE6OF01DTW6M.21.17.B06.1.454.CMB.1.raw
tcagtcgtcgctcgcacgaccggtgctcgatttagtcgatagtgaagggggagacgagtcccagccttgggattcccaagtgttttcattcagtgatcaggactgaacacagaggactcaccatgaagtttggctgagctgggtcttcctcgttgcttagttttaaaaggtgtccagtgtagaaatacagcgtggtaggagtcgtggggagtccgttgggtcgaaggccggggggttcaacgtcgaacgacctcgtcctgtctctgctattcgttaggttttatagtaattaagtagtagtcggaccgttggaagtcgacgtacgtcgggtacccgcggacggaccgaaccggaaggggaacgggtcggtgggtacgggttcggggtacggtccgttaagttagggagggccgtaaggtggtcggtgggtagggaccgtaagtaagtaactctcgtacgacgtaccggtcggtagaggacggtctaaagtcttaaccaaccttacgttacgtacgtaaagtacgtacgtaggttaaacgtacggaaaacgaacgtaacgtaacgttcgttccggttaacgtagtaaccgtaaggtaacgttaacggtaagttaccccggtcggttaaccgaacgggttaaacccggaaggaccgtaaaaccggtcggtaccccttaacgttacgttttaaaccgtacggttaacggtaaagttaaacccggtattaaccgggttaaccgttacccggttaccgtaaccggttaacccgttcgttaaacccgg

SEQ ID NO: 270448 - DNA, 875 bp, Homo sapiens
  misc_feature: GYAE6OF01CRJLA.21.17.B06.1.454.CMB.1.raw
  modified_base (299)..(299): a, c, t, g, unknown or other
  misc_feature (299)..(299): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgcttagttttaaaaggtgtccagtgtagaaatacagtctggtggagtcgtgggggagtcgttgggtggaagggcccgggggggtcacgttcgagaccgttcctcctgcctcgtgctattcgttgttttatgtaagttagtgtancgtcgtgtatcgctacggtccgggtccgaccgacggaccgaaccgggaagggggaacggggtcggtacggggtaggggttcgggggtaccgggtaccggttaaggttttaggggaacggggtaccggtaagggtcggtacgggttcggggggtacgggggtaccgtaaaggttaaacggtaaagtttacccgtcggtcggtaccggtaaccgggtccggggttaagggaaacggggtacggaaccggtacggttaaccttaaccccgtaacccgttaaccgtttcctttaaccggaaaggtaacgttaacgttacgttaaacggttaaccggaaacgaaacccgtagttacgtcgttacctttacgtacggagtaaggtacgtacgggttaagtaccggacgtaaacgggaaacccgggaaaccggaggaaccgtaacggaccggttaacccctttagtttaaacgtttcggtttaacggttaacccgtaagggttaaaccgttaagttttaaacccggttaacccgggttacggtaccgtttaacccggttaacgggtccccgtttaaacggggg

SEQ ID NO: 270449 - DNA, 828 bp, Homo sapiens
  misc_feature: GYAE6OF01AZGYM.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgtttaaaaggtgtccagtgtgaaatacagctggtggagtcgtgggggagccttggtgaaggccgggggggtcacgtcgagacgtctccgtgctctgcattcttggtttatgataagtgatgcctggatgctagtcgggccgcgaggccgtaaccggaggggagggccggtagggaggtggggtccggtaccggtagttagggaggggacgtaaggtgcggtagggggtcggggacgtaagtaacgaacgttaacgtcgtacggtccgacggtacccggttaggaacgggtaggacgtaacgggtaaccttttacccgaaccctttaagtttccccggttaacgtaaaggggtacgttaaagtttacgggtaaaccgtttacgggaaaaccgtaaaacccgggtcgtaaggttccggttacgtttacccggttaggaacggtagtaacgggttacggaaccgttacgggtttacccgaaacgggtaaacgggtaaaccccggacggggtaaacccgtacggaaccgggttaccccgtttactttaaacgttttaccggtttacccgttaacccggaaaggttaacggtaaacttttaaacccgggtttaaccccggtaccggggttaaccggttaacccgttacccccggggttcgtttaaaaccccgggg

SEQ ID NO: 270450 - DNA, 795 bp, Homo sapiens
  misc_feature: GYAE6OF01B2B75.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctagttttaaaggtgtccagtgtagaaatacagctggtggagtcgtagggggagtccgttggtaggaacgggccgggggggtcactcgacgtacctcctcctgcctcgtgactagttcgttaggttttatgtattaagtgatcgcgtggatcgctacggtcggtcccgcgacggccgaaccgggaggggaacggggtcgtaggggacggttcgggggtccggtacggttaagttagggaggggtacgaacggtggtcggtgggggtacgggacgaagttaacggtaacttaccgtacgtggaccgtacggtcccggtaggaaggacggtacgtaagtaccttaccgaaccttacgttcttacggaaagtagtacgtacgttaacgttacggaaaacaaacgtacgtaacgttacgttccgttacgtacgaaccgtagtacgtacggtacgtaagtcccggtaaggaaaccggaaacccgggtaaggtaccccgaacggtaaccgttccccgtttaatttaacgtttaacggtttaccggtaacgtaacggttaaccgttaaacgttttaacccggttaaaccccggtttacgggttaacccgtttaacccggttacccggggtttcccgttaaaccggg

SEQ ID NO: 270451 - DNA, 797 bp, Homo sapiens
  misc_feature: GYAE6OF01EEE5N.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagagactcaccatgaagttggctgagctgggtcttcctcgttgcttagttttaaaaggtgtcctaggtagtagaaatacagcgtggtggagtcgtggggacgtccgttggtggaacgggccgggggtactacgtacacgtacctcctcgtcgtcctctcgctacgttcgtttaggtttagtagtaagttaaggtgtagttcggtaccgtaggtagtcgtacgtacggttccggtcccgaccggacggaccgaacgggaacggggacggggtacggttagggtacgggttacgggtccgggtacggttaaggtacggggacgggtacggtaaggtcggtcgggtggggtacgggacgtaagttaacgtaatacctggtaccgcgtacgggtacggaggtacggagtacgtaacggtacctacccggtactacgttacgtacgaagttaacgtaggtaacgtaacggtaacgaaaccgtaaacgcgttaacgtcgttaccgtgtacggacgtaaggtagtaccggtagtaccgttccggaaggaaaccgtacgggaaccacggtacccggtaattcccgttaatttacggtttaccgttacggtaacgtaaacgggttaactttaaagttaaccccggttaacggtacccgggttaaccgtacgggttacccgtaaccggtttacccgg

SEQ ID NO: 270452 - DNA, 919 bp, Homo sapiens
  misc_feature: GYAE6OF01EQAV7.21.17.B06.1.454.CMB.1.raw
tcagtcgtcgctcgcacgaccggtgctcgatttagtcgatagtgaagggggagacgagccccagccttgggattcccaagtgtttttcattcagtgatcaggactgaacacagaggactcaccatgaagtttggctgagcgtgggtcttcctcgttgtcttgttttaaaaggtgtccagtgtagaaatacagctggtggtagtcggtggggacgtccgtttgggtaggaacgggtccggggggtcacgtcgagacctcctcctgcctcgtcgctagttcgtttaggttttatagtaagttaagtgtagtcggtaccgttggtagtcgtaccgtaccggttccggggtccccggaccggaacgggacccggtaaccggggaagggggtaacgggggtcggtaggggtacggggttccggggtaccgggtaccggtttaaggttaacgggagggggtaacggtaagggttcggtacgggtttcggggggtacggggaacggttaaacggtaacgtaaccgtttacgttaccggtcggaccgtacggtaccgggtagggtaacgggacggtaccggtaacgttaaccttacccgtaacccgttaacgtttaccggtaacgaacggttaaggtaacgttaacggtaacgttaaacggaaaccgggtaaaccgttacggtacgttaccgtttaccggttacggtactaacgggttaacgtaagggtaccggtaacgttaccgggtaaccggtaaccgggtaaacccggaacccgggtaacggaaccgtaacccggtaaccgtttacccgtttaactttacgtttacggttaaccgtaaccgtaaggttaacgttaaaccggttaacccgtttaaccgggttacccggttaccggttaccgttaccggttaacccggttacccgg

SEQ ID NO: 270453 - DNA, 824 bp, Homo sapiens
  misc_feature: GYAE6OF01BJB84.21.17.B06.1.454.CMB.1.raw
  modified_base (734)..(734): a, c, t, g, unknown or other
  misc_feature (734)..(734): n is a, c, g, or t
tcagtcgtcgctcgcacgaccggtgctcgatttagtcgatagtgaagggggagacgagccccagccttgggattcccaagtgttttcattcagtgatcaggactgaacacagagactcaccatgaagttggctgagctggtcttctgttgcttagttttaaaaggtgtccgtaggtgtacgaaaatacagcgtgggtggaggttcgtgggggacgtccgttgggtcggaaggggccggggggtcacgtcaacggtaccttctccgtgtccttcgtgacctacgttcgttaggttttaatacgttaagttaaggtgtagtcgtccgttggtactcggtaccgtcggttccgggtaccccgccggaacggacccggtaaccggggaacgggggtaccgggggaccggttaggggtacggggttaccgggggtacccggtaccggtttaagggttaacgggggaccggggtaacggtaacgggttcggggtacgggtaggggggtaccggggaacggtaaagttaaacgggtaacttacccggtttacgtacgggtaccggtacgggtcccggtaagggcggtaacggaacgtaaccggttactaacccgcgttagttaccgttaacgaagggtaacgtgtacgtaaacgtaacggaaacgaacgtcgtattacgttcgtaccctaggtaaccgagttaagtacggaacgttcgggaacctagggaacggtaaccgngtaacccgagtaacccgtgtttactaccggtttattacgacttaagcttaaacgttaccgtacgtcgggtacacccgtgtcgtaaccggg

SEQ ID NO: 270454 - DNA, 749 bp, Homo sapiens
  misc_feature: GYAE6OF01DOASL.21.17.B06.1.454.CMB.1.raw
  modified_base (295)..(295): a, c, t, g, unknown or other
  misc_feature (295)..(295): n is a, c, g, or t
  modified_base (620)..(620): a, c, t, g, unknown or other
  misc_feature (620)..(620): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagcgtgggtcttcctcgttgcttagttttaaaaggtgtccagtgtagaaatacagtcgtggtggagttcggtcgggggagtccgttgggtacggaacggggtcccgggggggtctacgtcgacgtactctcctgctcctgctattcgttaggttttangtaatagtgactgcctggatacgcgtaccgtcggtccgccgaggaccaaccggaaggggacggggtcgtagggtacgggtcggggtcggtaccggtagttagggagggacgtaggtggcggtggggcgggataagtaagtactccgtgtagcgtacgccggtagaaggaggtacgtagtaccttccgaacttaccgttactaggaacgtagtacttaggtaaccgttaacggaaacgtaaacgacggtacctgtacccgtttgacgacgtaagtagtaggaaccgtacgggtaccctagggaaccggtaacccggaggtaacccncggttaacccgtaccttttaagttaacggtttaacgtttacggttaaccagggttaaacgttaacttaaacccgttttaccgggtaacccggttccgttaaacccggttccggttacccgttaaacggg

SEQ ID NO: 270455 - DNA, 777 bp, Homo sapiens
  misc_feature: GYAE6OF01A91FU.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttggctgagctgggtcttcctcgttgcttagttttaaaaggtcgtccagtgtagaaatacagctgggtggtagtcggtgggggatccgttgggtaggaacggggtccggggggtacacgtcgacgtacctcttccgtgtactcgtcgctagttcgtttggttttatagtaataaggtgatcgcgtggtatcgacgtacgtcggtaccacggtacggaccgtacgggaacggggagggtcgtggggtcgggttacgggtaccgggtacgttaggtagggacggtacggtaacgtcgggtacggttagggggacgggtaacgtaagttaaacgtaaccgtacgttaccgtcgtaccggtaaccgggtcggtaagggaacgggtacgaacggttacgtacgttaacccaacgttacttccgtaaggactaaggtacgtacgtaacgtaaccgaagaacctgaattaccggttgtacccgtaggtactaacggacgttagacgtaacgaccggttagaaacggtacgacgtaacgtacggtaactcgttaagtttataccgttacgggtaacaaggttaacgtttaaacccgttacgttaaacccggttacgggtaaccgttaaacccgttggtaacccggttaaacccggg

SEQ ID NO: 270456 - DNA, 721 bp, Homo sapiens
  misc_feature: GYAE6OF01BZ6ZY.21.17.B06.1.454.CMB.1.raw
  modified_base (140)..(140): a, c, t, g, unknown or other
  misc_feature (140)..(140): n is a, c, g, or t
  modified_base (363)..(363): a, c, t, g, unknown or other
  misc_feature (363)..(363): n is a, c, g, or t
  modified_base (432)..(432): a, c, t, g, unknown or other
  misc_feature (432)..(432): n is a, c, g, or t
  modified_base (620)..(620): a, c, t, g, unknown or other
  misc_feature (620)..(620): n is a, c, g, or t
tcagtcgtcgctcgcacgaccggtgctcgatttagtcgatagtgaagggggagacgagccccagccttgggacttcccaagtgttttcattcagtgatcaggactgaacacgagaggactcaccatgagtttggctgagngttcggtcttccgtcgttgtacgtttaaggttttaaaaggtcgtaccgtaagttgtaacgtaaataccagtcgtagggtggtacggttcggtgggggacgttcgttagggaggaacggggccggggtataccacgtacacgtactccttccgtgactcgactcttcttgttagttagtagtaacgtagtgtagtcgacgttgatcggacgtcggtcggacccncggagtaccggacgggtagggacggcgtggggtcggtcgggacgtaggtaggtcggacgggtatagggngggtggcgggtagagtagtacgattcgagacgtgacggtcggaagacggactagtactaccgtcaactcgtataaggtagtactaggtaacgtaagtaaccgtaaagtaccggtaatccgttaaggtccttcggaagtcggtaagtaggtacgtacgtacggaaccggtaaggaaccggtacggaacncgttacgggacccttaggtttattacgtttacggaacttaggaaccttaaaggttacccttaaggggttaccctaggttacccggttcgtaccggttacgg

SEQ ID NO: 270457 - DNA, 615 bp, Homo sapiens
  misc_feature: GYAE6OF01C3QHR.21.17.B06.1.454.CMB.1.raw
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (502)..(502): a, c, t, g, unknown or other
  misc_feature (502)..(502): n is a, c, g, or t
  modified_base (551)..(551): a, c, t, g, unknown or other
  misc_feature (551)..(551): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttggctgagcgtggtcgtcctaggtgctagtttaaaggtgtcagtgtagaaatcagcgtggtggagtcgtggggatcgtggtagacgggccggggtnacgtcactctcgtccntctctgactcttgttgtttangtatagtagctncgtgtactgctggcgtaccgcgcggacgacggagggaggnggtggtcgggtcggtccggtaggtaagtacggaggnggtaaggtcgnggtggcggagtaaagtagaactcgtgcgaagtcggccgtaggaaggtacgagaactccgtctaaccgtcctttaacgtagaaagtcggtatagttaacgggtaccaaagttaccgagttactcgttaactgaaccgtagngtaacgtagtaacgtcgagacgtaacggaaccgcgactaaccgacgttnttacgttactagtacgtaagtataacgtaactacgttaccgtagttaccgcctaggtcgtaacg

SEQ ID NO: 270458 - DNA, 769 bp, Homo sapiens
  misc_feature: GYAE6OF01DFM9K.21.17.B06.1.454.CMB.1.raw
  modified_base (447)..(447): a, c, t, g, unknown or other
  misc_feature (447)..(447): n is a, c, g, or t
  modified_base (616)..(616): a, c, t, g, unknown or other
  misc_feature (616)..(616): n is a, c, g, or t
  modified_base (679)..(679): a, c, t, g, unknown or other
  misc_feature (679)..(679): n is a, c, g, or t
  modified_base (688)..(688): a, c, t, g, unknown or other
  misc_feature (688)..(688): n is a, c, g, or t
tcagtcgtcgctcgcacgaccggtgctcgatttagtcgatagtgaaggggagacgagccccagccttgggattcccaagtgttttcattcagtgatcaggactgaacacagagactcacatgagttggctgagcgtggtcttccgtcgttgtacgtttagtttaaaggtcgtccgagtagtagtaaatacgagtcgtggtggtaggtcggtagggggacgtccggttagggtaggaacggggccgggggtaccacgttacgaacgtccttcctcgtcgctcgtgtctacgttcgttgtttatagtaagttagtcgtcgtcgtaaccgtggacgtcggtcgacggttccggccgaccggaccggtaccgaacgggtaacggggtcggcggtacggggtacgggtcgggtcccggtaggtaacggttagggacggtagaacggttcggnggtaccggggtaggtaagaacgtaaggaacgttcttcggacgtaaccggcggtaccggtaggacggtacggaactacgtacttaaccggtacctaacgttacgtaacgaacgttagtcgtaacggtataaccggaaaccgtaacaacgtctacgtccgttagacgtaanacggtaagtaccgtagtaccgtaagaccgaaacgacggaacgaccgcggtactacccttttanaccggtttnttaaccgtacgtaacggaaagttaacccgtttacgtaaccgggttacgtaccgttaacccggtagttcccgtacccggggg

SEQ ID NO: 270459 - DNA, 769 bp, Homo sapiens
  misc_feature: GYAE6OF01CN89D.21.17.B06.1.454.CMB.1.raw
  modified_base (167)..(167): a, c, t, g, unknown or other
  misc_feature (167)..(167): n is a, c, g, or t
  modified_base (178)..(178): a, c, t, g, unknown or other
  misc_feature (178)..(178): n is a, c, g, or t
  modified_base (241)..(241): a, c, t, g, unknown or other
  misc_feature (241)..(241): n is a, c, g, or t
  modified_base (286)..(286): a, c, t, g, unknown or other
  misc_feature (286)..(286): n is a, c, g, or t
  modified_base (337)..(337): a, c, t, g, unknown or other
  misc_feature (337)..(337): n is a, c, g, or t
  modified_base (518)..(518): a, c, t, g, unknown or other
  misc_feature (518)..(518): n is a, c, g, or t
  modified_base (526)..(526): a, c, t, g, unknown or other
  misc_feature (526)..(526): n is a, c, g, or t
tcagtcgtcgctcgcacgaccggtgctcgatttagtcgatagtgaagggggagacgagccccagccttgggattcccaagtgtttcattcagtgatcaggactgaacacagaggactcaccagtgagtttgggctgagcgtggtcttctcgttgcttagtttaaggntccgagtgtanaaatcagcgtggtggacgtcggtggggactccgttgggacgggtaacggggcccggggggttnaaccgtcgaccgtaccgtcccgttcctggtcctacgtcgtacttntacggttttagtttacgtagtaagttaggtgtacgtcggtaccgtggttancgtacggtcgtccggtaccgacgaccgggacggtaaccgggacggggacggtacggtggacgggttcgggtacccgttaggtaagttagggacggaccggtagggtcggaacgggttgggggacggttacgaacgttagtacgttacgaccgtcgtaagcggtacgtaggacggtaccggntaaccgtntaccggtactagtacctaggacgtaagcttaagtaacggttagaaacccgtagggtaacccttgtcggttaccttacgacgtaaccggtggttaccagggtacctacggaccgttagggaacgacgggtacggaaccaccgggttaaccttctaaaccgtttgttacccgttacggtaaagacgttaaacgtttacgtaaacggtcctttaacggacggttacccgttggtacggttacccgg

SEQ ID NO: 270460 - DNA, 849 bp, Homo sapiens
  misc_feature: GYAE6OF01AI8PS.21.17.B06.1.454.CMB.1.raw
  modified_base (188)..(188): a, c, t, g, unknown or other
  misc_feature (188)..(188): n is a, c, g, or t
  modified_base (383)..(383): a, c, t, g, unknown or other
  misc_feature (383)..(383): n is a, c, g, or t
tcagtcgtcgctcgcacgaccggtgctcgatttagtcgatagtgaagggggaggacgagccccagccttgggattcccaagtgttttcattcagtgatcaggactgaacacagaggactcaccatgaagtttgggcgtgagctgggtcttcctcgttgctagtttaaaaggtgtccagtgtgaaatanagctggtggagtcgtggggagccgttggtgtaaggccggggggtacacgtcaggactctcctgctctgcagtcgttggtttatgtatagtgaagtcgcctaggactcgctaacgtcgggtcccgccggacggcgtaccggacgggtaacgggcgtcgggtaaggtggggttacccggaccgggtagttaacgggnggggaaccgtaaggtcggtaccggttcgggggtacggggtaccggtaaagtacggttaaagtacccgttacggttcgcggtaaagggtccccggtaagggtacggaacgggtacctaacggttaacgttacccgaacctacggtttaaccccgttaagtacgggtaaaggttaaacctagggttaaacgttaacggggaaaactaaaaccggaccggttaagttaaccggtccttaccggttaacgtacccgtaacgtaggttaacggtaaaacgtccggaacccgttaacggaaacccgggaaacccgtaacgggaacccggtaacgtaaacggtcccgtttaaaccgttaaacgtttacggtttaaacccgtacggttaaaacggtaaccgttaacgttaaaacgtttaaccccgttacggggttaaaccgtaacccgtaaccgggttccctttaaaaccgggg

SEQ ID NO: 270461 - DNA, 753 bp, Homo sapiens
  misc_feature: GYAE6OF01BZVSI.21.17.B06.1.454.CMB.1.raw
  modified_base (748)..(748): a, c, t, g, unknown or other
  misc_feature (748)..(748): n is a, c, g, or t
tcagtcgtcgctcgcacgaccggtgctcgatttagtcgatagtgaagggggagacgagccccagccttgggattcccaagtgttttcattcagtgatcaggactgaacacagagactcaccatgaagttggctgagcgtggtcttccgtcgttgtcttagttttaaaggtcgtctagtgtagaaatacgagtcgtggtggtacggtcggtaggggcgtccgttggtaggaacgggtccggggggtacacgtcgacgtacctccgtctgtcctcgtcgactacttacgtttaggttttaatagtaagttaagtcgtacgtcggtcgtaggtacgtgtaccgtacggtccggtccgaccggacggaccgtacgggaacggggacgggtggtacgggtacgggtacgggtccggacgttaaggtacgggacgggtacggtaggtcggtacgggtcggggtacgggaacgtagttaaacggtaactacgtacggtacgaccgtacggtacggacggaaggtaccggaagtacggtaaccttacccgaaccgttagttaccgtaaggagttaagtacgtttacggaaacgttaacggaaaccgtaagtaacgtcgtttacccgggtccttaaggcaaaggtagtacggtaaggtacgtacggacgtaaccgggaacgtaaccggaccgtacgtacccgtgttacctagttctaagtcgtacagtactacgttcgttacgcgtaacgtgccgtntacgg

SEQ ID NO: 270462 - DNA, 858 bp, Homo sapiens
  misc_feature: GYAE6OF01A0QIY.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggacctcaccatgaagtttggctgagcgtggtcttcctcgttgcttaggttttaaacggtgtccagtgtagaaactacgagtctgggtggacggttcggtgggggacgtccgtttggggtacggaaccggggtccggggggtcctacgttacgaacgtacccttccgttccgtcgtccttcgtacgtccttacgttcgttttaggttttagtaggtaagttagtgtaacgttcggtccgtaggtacttacggtccgtaccggttccgggtaccccgaccggaaccgggaacccgaaccgggggtaagggggtaaccggggtccggttacgggggtacgggtttacccgggggtaccggggttacccggtttaaagggttaacggggaacgggggtaacggttaacgggttcggggtaccgggttacgggggtaccgggtaaggttaacggtaaacggtaacgttaaccgttccggtacggaccggttacgggtccgggtaaggtaacggacggtacgtaaccggttacttacccggtaaccttacgttaaccgttagtaccggtaagtaagtacgtaaaccgttacggaaaaccgtaacgtacgtacgttacgttccgttacggacgtaagtacggaagttacggacgtaccgtacggtacgaacggacgagaccgacgtcgtactgttacgtcttaccgtatagtacttaacgtactacggtcgtaacgtcgttacgtcgtacg

SEQ ID NO: 270463 - DNA, 743 bp, Homo sapiens
  misc_feature: GYAE6OF01BBR5Y.21.17.B06.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (278)..(278): a, c, t, g, unknown or other
  misc_feature (278)..(278): n is a, c, g, or t
  modified_base (488)..(488): a, c, t, g, unknown or other
  misc_feature (488)..(488): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagttgggctgagctgggtcttcctcgttgcttagttttaaaaggtgtcctagtgtagtaaatacagtcnggtggagtcgnggggatcgttggngaagggccgggggtcacgtcgagtaccgtctcgtagctctagctagttcttggttttancgtaagttaagtgaatgtaccgtagtactcgacgtacgtcggtaccgaccgaggccgaacggaggggacggcgtaggtacggtcgggtcggaccgtagttacggaggtacggtaagtcggtcggtgggtacgggagtaagtaagaacgtacgtcgtaggtcgaacggccgtaggacggacggtacgagtacttccgaacgtatacgttanaaggtacgtataggtactaacggaactaagtaccgttgtcgtacccgttagacgactaaggcgtacgagttaaccggacgttacggaaaccgaaccggagtaaacccgtacgtaacccgtcgttttaacgtaaaggttttacctaccgggttaaacctaaaggtaccccggttaaaagtttaaacccgtttaaaccccgggtcgggttaaaacgggtacccccgttttaaaggggtaccccccttttaaaggggg

SEQ ID NO: 270464 - DNA, 514 bp, Homo sapiens
  misc_feature: GYAE6OF02I3B35.21.17.B06.1.454.CMB.1.raw
  modified_base (420)..(420): a, c, t, g, unknown or other
  misc_feature (420)..(420): n is a, c, g, or t
  modified_base (467)..(467): a, c, t, g, unknown or other
  misc_feature (467)..(467): n is a, c, g, or t
  modified_base (499)..(499): a, c, t, g, unknown or other
  misc_feature (499)..(499): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgtttaaaaggtgtccagtgtgaaatacagctggtggagtctgggggagccttggtgaagccggggggtcactcagactctcctgctctgcatctggttttatgataagtgatgcctggatgcactgggtccgccaggcaccaggggaaggggctgggaggtgggtcggccgtattaggagggcgaagtgctgggtggggcgatagaatactctgcagccgtgagaggcagattcaccatcttcagagatgattcgagaaacncgatgcttctgcagatggatagcctgagaaccgaggacacgagcctntagttattgtccagatatattaactccggtanacgttacgccttacg

SEQ ID NO: 270465 - DNA, 588 bp, Homo sapiens
  misc_feature: GYAE6OF02JJDER.21.17.B06.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccggggggtcactcagactctcctgctctgcatctggttttatgataagtgatgcctggatgcactgggtccgccaggccaccgagggaaggggctggaggtgggtcggccgtagttaggagggcgaagtgcgtggtgggcgatagaatacgtntgcagccgtgagacggcagattcactatctcgagagatgattcgaagaaacacgaatggcttacgtgaccgagataggtaatacggccgtaggaacgtaaacccggaaggaaccaccgaggtcccttaacgtaacgtttacgtttacgttacccgaagtaacgtaagttaacttaaccgttaccggtacgtaaccgttaccggtccctttaacgg

SEQ ID NO: 270466 - DNA, 567 bp, Homo sapiens
  misc_feature: GYAE6OF02GQB21.21.17.B06.1.454.CMB.1.raw
  modified_base (450)..(450): a, c, t, g, unknown or other
  misc_feature (450)..(450): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggttttatgataagtgatgcctggatgcactgggtccgccaggcaccgaggggaaggggctggaggtgggtcggccgtagttaggagggcgaagtgcgtgggtggggcgagtagaatactctgcagccgtgagaggcagatcaccatctcagagatgattcgaagaaacacgatgcttctgcagatggagggtancgtagaacgaaccgaggaacacgacggtcctactaagttagttacgttaccaaggtaacgtaagttaacgtttaaccgttcccgggtacgtaacccgttaccgggtccctttaacgg

SEQ ID NO: 270467 - DNA, 502 bp, Homo sapiens
  misc_feature: GYAE6OF02ITQ0C.21.17.B06.1.454.CMB.1.raw
  modified_base (358)..(358): a, c, t, g, unknown or other
  misc_feature (358)..(358): n is a, c, g, or t
  modified_base (388)..(388): a, c, t, g, unknown or other
  misc_feature (388)..(388): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (493)..(493): a, c, t, g, unknown or other
  misc_feature (493)..(493): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggtttatgataagtgatgcctggatgcacgtgggtccgccgaggccaaccgagggaaggggctggaggtgggtcggccgtataggagggcgaagtgcgtgggngggcataggaatactcgtgcagccgtgagnggcagatcaccntctnagagatgatcgaagaaacngatgcttcngcagagtgatagctgaacgaaccgagacagngctntattntgtcaganatatactcggtanactcgcttg

SEQ ID NO: 270468 - DNA, 584 bp, Homo sapiens
  misc_feature: GYAE6OF02FVIG5.21.17.B06.1.454.CMB.1.raw
  modified_base (295)..(295): a, c, t, g, unknown or other
  misc_feature (295)..(295): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggttttatgataagtgatgcctggatgcacgtgggtcccnccgaggccaccgaggggaaggggctggagtggggtcggccgtagttaggagggcgaaggtgcgtgggtgggcgatagaatactcgtgcagccgtgaggaggcagattcaccatcttcagagatgattcgaagaaacagatgcttctgcagataggatacggcctaggaacgaaaccggaggaaccacgacggccttacttaagtttacgttacggttacccgaagtaacgtaagtttaactttaacccggtcccggttaggtaacccgttaccgggtaccctttaccgg

SEQ ID NO: 270469 - DNA, 726 bp, Homo sapiens
  misc_feature: GYAE6OF02JZSGA.21.17.B06.1.454.CMB.1.raw
  modified_base (362)..(362): a, c, t, g, unknown or other
  misc_feature (362)..(362): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccttgggtgaaggccggggggtcactcagactctcctgctctgcatcttggttttatgataagtgatgcctggatgcactgggtcccgccaggcacccgaggggaacggggctgggaggtgggtcggccgtattaggagggcgaagtgctgggngggcagtagaatacgtctgcagccgtgaggaggcagtacttcacctattcttcgaacgtagtatagtaacgttacgaaacgtaaaacacggaacttcggtaccctttcgtacggaccgtaaggtaagttacggggtaaattaaccgggacccgttaaggggaaaaccggaaaaccccgggtaaacggggaaacccgaaaccggtaacggggttacccccttaacgttttaaccgttttaacggttttaccgggtttaaccccgtaaagggtaaccgtttaaagtttaacccgttttaaaacccggttaccccggggtttaacggtaaaccccggtttaacccggggttccccgttttaaccggg

SEQ ID NO: 270470 - DNA, 515 bp, Homo sapiens
  misc_feature: GYAE6OF02F11UV.21.17.B06.1.454.CMB.1.raw
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (469)..(469): a, c, t, g, unknown or other
  misc_feature (469)..(469): n is a, c, g, or t
  modified_base (484)..(484): a, c, t, g, unknown or other
  misc_feature (484)..(484): n is a, c, g, or t
  modified_base (499)..(499): a, c, t, g, unknown or other
  misc_feature (499)..(499): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaagccgggggggtcactcagactctcctgctctgcatctggttttatgataagtgatgcctggatgcactgggtccgccaggcaccgagggaaggggctggagtggggtcggccgtattagagggcgaagtgcgtgggtgggcgatagaatactctgcagccgtgagaggcagattcaccatcttcagagatgattcgagaaacacgatgcttcngcagntggatagcctagagaaccgaggacacgaggcctntattattgtccaganatattactccggtanacgtacggccttacgg

SEQ ID NO: 270471 - DNA, 511 bp, Homo sapiens
  misc_feature: GYAE6OF02JZC7W.21.17.B06.1.454.CMB.1.raw
  modified_base (266)..(266): a, c, t, g, unknown or other
  misc_feature (266)..(266): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
tcagtcgtcgctcgcacgaccggtgctcgatttagtcgatagtgaagggggaggacgagccccagccttgggattcccaagtgttttcattcagtgatcaggactgaacactagaggactcaccatgaagtttgggctgagctgggtcttcctcgttgctgttttaaaaggtgtccagtgtgaaatacagctggtggagtcgtgggggagccttgggtgaagccgggggggtcacgtcagactctcctgctctgcatctggtttangataagtgatgcctggatgcacgtgggtccgcaggcaccgagggaagggcctggagtgggtcggccgtagttaggagggcgaagtgcgttggtgggcgatagaatactctgcaggccgtggaggaggcaggacttcgaccatctcgagagntgattcgagaaacngatgtcttgngcagntgatagctgacgacgnganacgngcctntatntntcagtanatatactcggtnacgtcgnttacg

SEQ ID NO: 270472 - DNA, 580 bp, Homo sapiens
  misc_feature: GYAE6OF02HV7EH.21.17.B06.1.454.CMB.1.raw
  modified_base (291)..(291): a, c, t, g, unknown or other
  misc_feature (291)..(291): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagcgtggtcgttcctacggttgctagttttaaaaggtgtccagtgtgaaatacagctggtggagtctggggagccttggtgaaggccggggggtcactcagactctcctgctctgcatctggttttatgataagtgatgctggatgcactggcnccaggcaccagggaagggctggagtggtcggccgtagttaggagggcgaagtgcttggggnggagagtagatactntgcgagcgtagagaganagtatcactatctcgagagtatagatacgaagaacgagagtcgtcttgtgacgagtagtagtagtacgtacgtacgaacgaacggaacggaacgaacgaccggtaccgttacgttacgttacgttacgttacgtaacgtaacgtaacgttaacgttaaccgttaccggttacggtaaccgttaccgttacgttacg

SEQ ID NO: 270473 - DNA, 724 bp, Homo sapiens
  misc_feature: GYAE6OF02H5LN5.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccgttgggtggaaggccgggggggtcactcagactctcctgctctgcatctggttttatgataagtgatgctggatgcacgtcgggtccgaccaggccaaccgaggggaagggctgggagtcgggtcggccgtagttaggagggtcgaaggttggcgtggggtggggacgtaagtaggaaatacgtcgtggacgacggccgtaggacggagggctaaggactttacaacctattacccgttacgaaggtaagtaatcggtaattaccggaaaggtaaaaaccgacggtaattacggtaccttttacgacggtaccgaagtaacggttgggaacttacgggacccgttaagggaaacggaaaaccccgggaaggaacccgaaccgtaaccgggtacccttaacggtttaatttaacggtttacggtttaacccgaaagggttaactaaacgtttaaccgtttaacccggttacccgggttaacggttaacccgttacccgggtaccctttaaccggg

SEQ ID NO: 270474 - DNA, 611 bp, Homo sapiens
  misc_feature: GYAE6OF02IVPIU.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaagccgggggggtcactcagactctcctgctctgcatctggttttatgataagtgatgcctggatgcacgtcgggtccgccaggcaccggaggggaaggggcgtgggaggtgggtcggcgtagttaggagggcgaagtgcgtgggtgggcgagtagaatactctgcagcgtgagaggcagacttccacctattcttacagtacgtatcgtaattacgaagaaacacgattcgtacctttcgtgacaggagtagggaactacggacccgtaggaacgaaaccggaacggaaccaaccgacggtaccttacgttaagtttacttacggttaccaaggtaacgtaagtttaacgttaaccggttaccggtacggtaccgttacccgggttcttaaccgg

SEQ ID NO: 270475 - DNA, 570 bp, Homo sapiens
  misc_feature: GYAE6OF02IRTP3.21.17.B06.1.454.CMB.1.raw
  modified_base (372)..(372): a, c, t, g, unknown or other
  misc_feature (372)..(372): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttgggtgaagccgggggggtcactcagactctcctgctctgcatctggttttatgataagtgatgcctggatgcactgggtccgccaggcaccgagggaaggggctgggagtgggtcggccgtattaggagggcgaagtgcgtgggtgggcgatagaatactntgcagccgtgagaggcagatcacatcttcagagatgattacgaagaaacgcgagtgaccttctgacagagtggaatacgcctagacgaaccgaggaaccacgacggtccttacgttaacgtttattcgttaccgtaagtaaggtaactttaacgttaaccgtaccgggttagtaacccgttacgggtacccttaacgg

SEQ ID NO: 270476 - DNA, 536 bp, Homo sapiens
  misc_feature: GYAE6OF02IEFIU.21.17.B06.1.454.CMB.1.raw
  modified_base (373)..(373): a, c, t, g, unknown or other
  misc_feature (373)..(373): n is a, c, g, or t
  modified_base (431)..(431): a, c, t, g, unknown or other
  misc_feature (431)..(431): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaagccgggggggtcactcagactctcctgctctgcatctggttttatgataagtgatgcctggatgcacgtgggtccgccaggccaccgaggggaaggggctggaggtgggtcggcgtattaggagggcgaagtgcgtgggtgggcgatagaatactntgcagccgtgagaggcagatcacatctcagagatgattcgaagaaacacgatgcttcngcagatggatagcctagaacgaacgaggaacacgacggcctatagttattcgtaccaagtagtaattacgttaaccgtccggtagtaccgttaccggtcttacgg

SEQ ID NO: 270477 - DNA, 575 bp, Homo sapiens
  misc_feature: GYAE6OF02I3O7M.21.17.B06.1.454.CMB.1.raw
  modified_base (380)..(380): a, c, t, g, unknown or other
  misc_feature (380)..(380): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
  modified_base (554)..(554): a, c, t, g, unknown or other
  misc_feature (554)..(554): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgtttaaaggtgtccagtgtgaaatacagctggtggagtcgtgggggagccttgggtgaaggccgggggggtcactcagactctcctgctctgcatctggttttatgataagtgatgcctggatgcacgtgggtccgccaggccaccgaggggaaggggctgggaggtcggggtcggccgtagttaggagggcgaaggtgcgtgggtgggcgagtagaatctntgcagccgtgagaggcaagtatcacctattcttanaganatgtattcggaanaaacgngtatcgcttctgcaagtagtggaacgtagccgtagaacgaaaccggaggaaccaacgtacggccttacgttaatttgttaccgtacaagtagtaacttagttaaccgtccggttanaaccgttacggcccttaacgg

SEQ ID NO: 270478 - DNA, 563 bp, Homo sapiens
  misc_feature: GYAE6OF02IJCW9.21.17.B06.1.454.CMB.1.raw
  modified_base (394)..(394): a, c, t, g, unknown or other
  misc_feature (394)..(394): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggtttatgatagtgatgcctggatgcacgtgggtcccgccaggccaccgaggggaggggcgtgggaggtggggtcggccgtagttaggagggcgaagtgcgtgggtgggcgagtagaatactctgcagccgtgagaggnagtattcacctatcttacagtagatgtatcgaagaaacacgtatgtcttcgtgactagatggatacgccgtaggaaacgaaccgaggaaccacgacggtccttacttatttagttcgttaccagagtaacttacgttaacgtccggtagtaccgttaccggccttacgg

SEQ ID NO: 270479 - DNA, 567 bp, Homo sapiens
  misc_feature: GYAE6OF02IITEY.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggttttatgataagtgatgcctggatgcacgtgggtccgccaggccaccgaggggaaggggcgtgggaggtggggtcggccggtattaggagggcgaagtgcgtgggtgggcgataagaatactctgcagccgtgagaggcagattccacctatcttcagagtatgattacgaagaaacacgattgtcttctgacagagtaggatacgcgtaggaacgaaccggaggaaccacgacggtcctattagttacttgtaccgaagtacgtaattacgttaacgttccggtagtaccgttacccgggtacttacgg

SEQ ID NO: 270480 - DNA, 524 bp, Homo sapiens
  misc_feature: GYAE6OF02I7D0K.21.17.B06.1.454.CMB.1.raw
  modified_base (262)..(262): a, c, t, g, unknown or other
  misc_feature (262)..(262): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
  modified_base (469)..(469): a, c, t, g, unknown or other
  misc_feature (469)..(469): n is a, c, g, or t
  modified_base (509)..(509): a, c, t, g, unknown or other
  misc_feature (509)..(509): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaagccggggggtcacgtcagactctcctgctctgcatctggttttangataagtgatgcctggatgcactgggtccgccaggccaccgagggaaggggctgggagtggggtcggcgtattagagggcgaagtgctgggtggggcgatagaatacgtctgcagccgtgagaggcagattcactatcttcagagatgattcgaagaaacncgaatcgcttctggcagntaggatagcctagagaaccgaggacacncggcctctattgttcgtcagacgtatacttacgaccggtnacgtaccggcttacg

SEQ ID NO: 270481 - DNA, 602 bp, Homo sapiens
  misc_feature: GYAE6OF02GPR35.21.17.B06.1.454.CMB.1.raw
  modified_base (464)..(464): a, c, t, g, unknown or other
  misc_feature (464)..(464): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccttggtgaaggccgggggggtcactcagactctcctgctctgcatctggttttatgataagtgatgcctggatgcacgtgggtcccgccaggccaccgaggggaagggcgtgggaggtggggtcggccgtagttaggagggcgaagtgcgtgggtggggcgagtaagaatactctgcagccgtaggacgaggacagacttccacctagtccttacgaaggagtatagtattacggaagaaacacgatcgaccttnagtcgagtagtggatacgccgtaggaacgaaccgggagaaccgaacacgggtacctacttacgtttaattacgttaccgaggtaacgtattaacgtttaaccggttccggttaagtaccgttaccggtccttaaccgg

SEQ ID NO: 270482 - DNA, 572 bp, Homo sapiens
  misc_feature: GYAE6OF02FFXBC.21.17.B06.1.454.CMB.1.raw
  modified_base (207)..(207): a, c, t, g, unknown or other
  misc_feature (207)..(207): n is a, c, g, or t
  modified_base (263)..(263): a, c, t, g, unknown or other
  misc_feature (263)..(263): n is a, c, g, or t
  modified_base (401)..(401): a, c, t, g, unknown or other
  misc_feature (401)..(401): n is a, c, g, or t
  modified_base (525)..(525): a, c, t, g, unknown or other
  misc_feature (525)..(525): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctggggganccttggtgaagccgggggggtcactcagactctcctgctctgcattctggttttangataagtgatgcctggatgcacgtgggtccgccaggcaccgagggaaggggctggagtgggtcggccgtagttaggagggcgaagtgcgtggtggggcgagtagaatactctgcaggccgtgagaggcagattcgacntctcagagtatggtaattacggaagaaacctaggactttacggcctttactggaccaaggtagtgggaactacgtccgtaagaacggtaaacccgaggaaccaccgacggtcctatagtttaancgttaccagtacattactaacgtccggataccgtacgtccttaacgg

SEQ ID NO: 270483 - DNA, 593 bp, Homo sapiens
  misc_feature: GYAE6OF02HMRQA.21.17.B06.1.454.CMB.1.raw
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggttttatgataagtgatgcctggatgcacgtgggtcccgccaggcaccggagggaaggggctgggaggtgggtcggccgtagtaggagggcgaagtgcgtggggtgggcgagtagaatactcgngcgagccgtagagagcagattcacctntcttacgagagatgattacgaaacgaaacacgtatcgtccttcgtgacagtagtaggatacgccgtaaggaacgaaaccggagaaccacgacgtcccttattaacgtttacttcggttaacctaaggtaacgtaacttaacgttaaccggtccggttaagtaacccgttaccggtaccgttaacgg

SEQ ID NO: 270484 - DNA, 650 bp, Homo sapiens
  misc_feature: GYAE6OF02GE3E8.21.17.B06.1.454.CMB.1.raw
  modified_base (261)..(261): a, c, t, g, unknown or other
  misc_feature (261)..(261): n is a, c, g, or t
  modified_base (352)..(352): a, c, t, g, unknown or other
  misc_feature (352)..(352): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccggggggtcactcagactctcctgctctgcatctggtttangataagtgatgcctggatgcacgtgggtccgccaggcaccgaggggagggctggagtgggcggcgtagttaggagggcgaagtgcgtgggngggcgagtagaatactctgcagccgtagaggaggcagtattcaccgtattccgttacgagtagtagtagtaacgttacggaaagtaaacgtacgattcggtaccttttacgtgaccgtaaggtagttagggtaacttacggcccgttaaggaaaccggtaaacccggaaggaacccgtaacggacggttacccttacgttaacgtttaacgtttccggttaacccaaggttaacgtaacgtttaacgttaacccggttaccgggtaagtaacccggttaccgggtaccctttaacggg

SEQ ID NO: 270485 - DNA, 577 bp, Homo sapiens
  misc_feature: GYAE6OF02GFQP9.21.17.B06.1.454.CMB.1.raw
  modified_base (453)..(453): a, c, t, g, unknown or other
  misc_feature (453)..(453): n is a, c, g, or t
tcagtcgtcgctcgcacgaccggtgctcgatttagtcgatagtgaagggggaggacgagccccagccttgggattcccaagtgttttcattcagtgatcaggactgaacacagaggactcaccatgaagtttgggctgagctggggtcttcctcgttgctgttttaaaaggtgtccagtgtgaaatacagctggtggagtctgggggagccttggtgaagccgggggggtcactcagactctcctgctctgcatctggttttatgataagtgatgcctggatgcacgtgggtccgcctacggcaccggaggggaacggggctcgggaggtgggtcggccgtagttaggaggggcgaaggtgcgtgggtgggcgtagtagaatactctgcaggccgtgaggaggcagtcttccacctatcttcagagatgattacgaagaacagtatcgcttcngacagtagtgatacgcgtagaacgaaccgaggaaccacgtacggaccttacttaagttcttacgttaccgaagtacgtaattaacgttaccgtccggttacgtaccgttaccggtccgttacgg

SEQ ID NO: 270486 - DNA, 694 bp, Homo sapiens
  misc_feature: GYAE6OF02H53FF.21.17.B06.1.454.CMB.1.raw
  modified_base (509)..(509): a, c, t, g, unknown or other
  misc_feature (509)..(509): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtggggggagtccttgggtgaaggccgggggggtcactcagactctcctgctctgctatctggttttatgtataagtgatgccgtggatgcacgtgggtccgccaggccaccgaggggaaggggcgtggaggtcggggtcggccgtagttacggagggcgaaggtgcgtggtgggcgagtagaatactctgcagtccggtgaggagcgtagtaacgtcgaaccctattcccttacgaaacggtagtaacgtaggtaacgtttacgggaaaacgaaaaccgaacgggttaaattcggtacccgttttacgnggtacctaaggtaaggttaacggttaagttacgggtaccctagggaaaaccggaaaacccgggagggaaaacccgaccggtaaacggtcccttaacgtttaacgtttagtttaccgttaccaaggtaataacgtttaacttaccggtaaccggttacggtaacccgttaccggtcctttaaccgg

SEQ ID NO: 270487 - DNA, 609 bp, Homo sapiens
  misc_feature: GYAE6OF02G85E4.21.17.B06.1.454.CMB.1.raw
  modified_base (414)..(414): a, c, t, g, unknown or other
  misc_feature (414)..(414): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatcttggttttatgataagtgatgcctggatgcacgtgggtccgccaggccaccggaggggaaggggctgggagtggggtccggcgtagtaggagggcgaagtgcgtgggtggggcgatagatactctgcagccgtagagagcagacttccactattccttanagagtatgtaattacggaagaaacgaacgtagtagtccttacgtgacgaagtagtggatacgaccttaggaaacggtaacccggaggaaccgacgaccggtcctacgtttaatttacgtttcgttaccgaaggtaagtaatttaaccgttaaccggttaccgggtacgtaacccgttacggttacccttaacggg

SEQ ID NO: 270488 - DNA, 708 bp, Homo sapiens
  misc_feature: GYAE6OF02GOBTC.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagtccgttgggtggaaggccgggggggtcacgtcagactctcctgctctgcatcttggttttatgtaataagtgatgccgtggatgctacgtcgggtcccgccgaggccaaccggaggggacgggcgtgggaggtcggggtcggcgtagttaggagggacgaagtgcgtggggtgggcgagtagaatactcgtgcacggccgtaggaggaggacaaggtacttccgaacctagttccgttacgaaagggtaagtaagttcggtaaacgtttaccggaaaaggtaaaaacctacggtaagtttcgacctttacgacggtacgaaggtagttacgggaattaccggtccgtaaagggaaccgtaaacccggaggaaaccaccggtacggtaccctttaagttaacggttttacgttacgttaacccgaaggttaaacgttaagttttaaccgttaacccggttaccgggtacgtaacccggtttaccggtacccgtttaacggg

SEQ ID NO: 270489 - DNA, 603 bp, Homo sapiens
  misc_feature: GYAE6OF02J2TEG.21.17.B06.1.454.CMB.1.raw
  modified_base (269)..(269): a, c, t, g, unknown or other
  misc_feature (269)..(269): n is a, c, g, or t
  modified_base (377)..(377): a, c, t, g, unknown or other
  misc_feature (377)..(377): n is a, c, g, or t
  modified_base (445)..(445): a, c, t, g, unknown or other
  misc_feature (445)..(445): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccgttgggtgaaggccgggggggtcactcagactctcctgctctgcattcgttggttttangataagtgatgcctggatgctacgtcgggcccgcgacggcaccggagggaacggggctgggtaggtcgggtcggccgtagtacggagggcgtaagtggcggttggggngggctagtacgatacgtcgtggcaggtcgtaggaggtaggcgaagtctacgaccattctacgagtagntacgtagttcgaaagaacgacgtatcgtcttagtcgagagtaggtgagtcgaccgtaggaacgaaccggaacgacacgtgtcctacgttatacgttactacgaagtacgttaattaacggttcccgtacggttacgtaacgtcccgtgttaacccggg

SEQ ID NO: 270490 - DNA, 544 bp, Homo sapiens
  misc_feature: GYAE6OF02IBM5O.21.17.B06.1.454.CMB.1.raw
  modified_base (271)..(271): a, c, t, g, unknown or other
  misc_feature (271)..(271): n is a, c, g, or t
  modified_base (349)..(349): a, c, t, g, unknown or other
  misc_feature (349)..(349): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
  modified_base (497)..(497): a, c, t, g, unknown or other
  misc_feature (497)..(497): n is a, c, g, or t
  modified_base (507)..(507): a, c, t, g, unknown or other
  misc_feature (507)..(507): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaggtgtccagtgtgaaatacagctggtggagtcgtgggggagccttggtggaaggccgggggggtcactcagactctcctgctctgcatctgttttatgataagtnatgcctggatgcactgggtccgccaggcaccgaggggaagggctggaggtgggcgccgtagttaggagggcgaagtgngtggtgggcgagtagatacgtctgcagccgtgagaggcagtatcactatctcagagatgattacgaagaacgacgatntccgttcgngcgagagtacggtatacgcgtagaacgtaacgacggaacacgaggctacgtagttacgttntaccgagtanattaagttaccgtaccggtgacgttacccgtcttacg

SEQ ID NO: 270491 - DNA, 716 bp, Homo sapiens
  misc_feature: GYAE6OF02H7LNV.21.17.B06.1.454.CMB.1.raw
  modified_base (294)..(294): a, c, t, g, unknown or other
  misc_feature (294)..(294): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcacgtcagactctcctgctctgcatctggtttatgataagtgatgcctggatgcacgtgggtccnccgaggaccgaccgaggggaaggggctagggaggtgggtccggacgtagttaggagggacgaagtgacgtgggtgggacgagtagaatactcgtgcaggccgtagaggacggactagtacttacaccgtatccgttacgaagagtaactaggtaacttacggaaacgaaaaccgtacgtaacgttacgtccgttttacgacggtacgtaacgtaaggtacgggtaattaaccgggacccgttaagggaaacccggtaaaacccgggacgggtaaaacccgtaacccggtaccgggttacccttaacgtttaagtttaccggttttaccggtttaacccggaaggttaaccgttaaacgttacgttttaaacccggtacccgggtaacggtaacccggtttacccggtacgttttaacccggg

SEQ ID NO: 270492 - DNA, 559 bp, Homo sapiens
  misc_feature: GYAE6OF02GMLCB.21.17.B06.1.454.CMB.1.raw
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggttttatgataagtgatgcctggatgcacgtgggtcccgccaggcaccgaggggaaggggctgggaggtggggtcggccgtagttaggagggacgaagtgcgtggggtgggcgatagaatactcgtgcagccgtgagnggcagtntcacattctnaganatgattcgagaaacacgatcgcttcngacagtntaggagtacgccgtaggaacgaaacggacggaacacgaggtccctagttagttgttacgttaccaagtacgtattaacttacgtccggtacgtacgttaccggcttaacgg

SEQ ID NO: 270493 - DNA, 736 bp, Homo sapiens
  misc_feature: GYAE6OF02GS757.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttggctgagctgggtcttcctcgttgcttgttttaaaggtgtccagtgtgaaatacagctggtggagtcgtggggagccgttggtggaagggccggggggtcacgtcagactctcctgctctgcattcgttggttttatgataagtgatcgccgtggatgactacggtcgggtcccgccgacggaccgaaccggaggggaacggggcgtgggaggtcggggtccggtcgttaagtagggaggggacgtaaggtcggtcggttgggggtcggggacgtaagttaaggtaaacttacgttcgtacggacgtacgggtccggtagggaacgggaggtaccgtaagtaacctttccgaaacccgttactttccgttaacgaaggtaagtaacgtaggtaaccgttaaccgggaaagtaaaaaccgtacgtacgttagttccgttacgtagacgtaaggtagtagtaacgttcggtacctaagggaaacgaacccgggaaaggaacccaggtaccgtaccgtttattaagtttacgttccttaaccgaagtaacgtaagtttaaccgttaaccggtccgttaacggtaccccgtaccgttacgttaacccgg

SEQ ID NO: 270494 - DNA, 761 bp, Homo sapiens
  misc_feature: GYAE6OF02HIPRC.21.17.B06.1.454.CMB.1.raw
  modified_base (303)..(303): a, c, t, g, unknown or other
  misc_feature (303)..(303): n is a, c, g, or t
tcagtcgtcgctcgcacgaccggtgctcgatttagtcgatagtgaagggggagacgagccccagccttggggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccgttggtggaaggccggggggggtcacgtcagactctcctgctctgcatcttggtttatgatagtgatcgtcctggatgctacgtcgggtccnccgaggccgaccggaggggaaggggtcgtagggtaggtcggggtccgggtccggtaggttaggaggggtacggtaaggtggtcggtggggtgggcgtagtaaggtaagtacctcgtcgcgacggtcccgtaggaggtacgggacctaggtacttacccgaacctatttaccgtacaagggtaagtacgttaggtaaccgtttaccgaaacggtaaaaacccgtacggtaacgtaacggttcccgttacgaacgtacccggtaaagtacgggttacgggtaactaccgggtaacccgttaggggaaacccgtaaacccgggacgggttaaacccaacgggtaacccggtaccttttaccgttaagttttacgttaaccggttacccgaaaggttacgtaacgttaacgtttaacccggaccggttaccggtaaccgtttacccgggtcctttaaaccgg

SEQ ID NO: 270495 - DNA, 792 bp, Homo sapiens
  misc_feature: GYAE6OF02I9CJV.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacaggaggactcaccatgaagtttgggctgagctgggtcttcctcgttgctgttttaaaaggtgtccagtgtgaaatacagctggtggagtctgggggagccttggtagaaggccgggggggtcactcagacgtctcctgctctgcatctggttttatgatagtgatgcctggatgctactgggtccgccaggcacgacgggaagggcgtgggagtgggtccggccggttagttacgggagggtacggaaggtacggcgtggggttggggacggtaagtaaggtaacttaacgttacgtcggtaccgaggtacccggttagggaaacgggacgggaccgttaacggtaacggtttaacccctaaaccccgtaggtttccctttaaccggtaaacgggtaaacggtaaggttacgtaacggttttaaccggaaaccggtaaaacgtaaccggttaaagttacgggttcccgtttacgtacgtaaccgaggtaacgttagggtaactacggtacccgttaagggaaccggaaaccggtaacggtaaacccgaacgtaccgggtacccttgtaaaccgtttcggtttaaccggttccgtaaaggtacgttaaacgtttaaccggttttaaaccgttacccggggtttaacggtaacccggttacccgggttacccgtttaaaccggg

SEQ ID NO: 270496 - DNA, 751 bp, Homo sapiens
  misc_feature: GYAE6OF02IWO5P.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggttttatgataagtgtatgccgtggatgcacgtcggggtcccgccgaggaccaccggagggggaagggggtccgtaggggagggttcgggggtccgggtaccgttagttacgggaggggaccggtaaggtcggtcggtgggggtcggggacgaagttaaggaatacgtcgtaggaccgacggtccggtagggacggagggaccgtaagtacttaccgaccctagttccgttacgaaggagtagttaggtaacgtttacggaaacgaaaaccgtacggtaacgttcgtaccgtttcgtacgaccgtaagtaacgttagggtaactacgggtaccgtaggaaacccggaaaccggacggaaaccgacgtaaccggtcccttacgttttaacgtttacgttttaccggttacccgtaaggtaacgttaaactttaaccggtttaaacccggttccgggttaacggtaccccggttaccgggttacccgtttaaccggg

SEQ ID NO: 270497 - DNA, 638 bp, Homo sapiens
  misc_feature: GYAE6OF02F9NRR.21.17.B06.1.454.CMB.1.raw
  modified_base (411)..(411): a, c, t, g, unknown or other
  misc_feature (411)..(411): n is a, c, g, or t
  modified_base (436)..(436): a, c, t, g, unknown or other
  misc_feature (436)..(436): n is a, c, g, or t
  modified_base (461)..(461): a, c, t, g, unknown or other
  misc_feature (461)..(461): n is a, c, g, or t
  modified_base (499)..(499): a, c, t, g, unknown or other
  misc_feature (499)..(499): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaagggtgtccagtgtgaaatacagctggtggagtcgtgggggagccgttggtggaaggccggggggtcactcagactctcctgctctgcatcttggtttatgatagtgatgcctgatgcgtacgtcggggtccgccgacggcgaaccggagggggaacggggcgtaggggagggtcggggtccggccggttaagttagggagggtacgaaggtggcggtggggtgggacgtataagacgtactcgngacgaggccgtagaggaggacagtntaccactacttcgttaacaggagtntagtactacggaaagaaacgacgtattcgtctttacgngactagagtaggatacggcctaaggaacggaaaccggacgaacacgtacgtaccttatttaggtttacttacggtaccgtaagtacgtaagttacgttaacccggaccggttagaacccggttccggtaccgttaacgg

SEQ ID NO: 270498 - DNA, 845 bp, Homo sapiens
  misc_feature: GYAE6OF02HCOEE.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccgttggtggaaggccgggggggtcacgtcagactctcctgctctgcattcgttggttttatgaattaagtgatgccgtaggatgcacgtcggggtcccgccgacggaccgaaccggaggggaacggggtccgtaggggtagggtcggggtccggtaccggttaagttagggagggacggtaaggtggtcggtggggtcggggcgtaaagtaagtaacttacgtcgtaggaccgtacggacccgtagggaaggacggacgtaagtacgtttacccgaacctagttaccgttacgaaggtaagtacgttacggtaacgtttaaccggaaaaggtaaaaccgaccggttaagttaccgttacgttacccgtaagggtacgaaacggttacggttacgggtaactttaaccgggtacccggttaaggaaacccggggtaaaacccgggaaacgggaacccgtaaccgggtaacccgggttacccttttaacgtttaaacgtttttaccggtttaaccggtttaaccggaaaacgggttaacgttaaacggtttttaaacccggtttaaacccgggttcccggggttttaaaaccggtaccccgggtttttaaacccggggtaccccttttaacccggggg

SEQ ID NO: 270499 - DNA, 700 bp, Homo sapiens
  misc_feature: GYAE6OF02GHFSR.21.17.B06.1.454.CMB.1.raw
tcagtcgtcgctcgcacgaccggtgctcgatttagtcgatagtgaagggggagacgagccccagccttgggattcccaagtgttttcattcagtagatcaggactgaacacagaggactcaccatgaagtttgggctgagctgggtcttcctcgttgctgttttaaaaggtgtccagtgtgaaatacagctggtggagtctgggggagccttgggtgaaggccgggggggtcactcagactctcctgctctgcatctggttttatgtataagtgatgccgtggatgcacgtgggtccgccaggccaccgaggggagggcgtggaggtgggtcggccgtagtaggagggcgaaggtgcgtgggtgggcgagtagaatacgtctgcgagccgtaggaggaggcagacttccaacctattccttacgaaggtagtagttacggtaacgttaccggaaagtaaaaccgacggtaagttcggtacctttacgcggtaacgacgggtaagtcggggaaataaccgggtcccgttaaggggaaaccggtaaacccgggaagggaaaccctaccgggtaacgggtaccccttacgtttaaaggttttacgtttaccggttaaccgtaagttaaacgtaaccgttttaaagtttaaccccggttcccgggttaacgtaacccggttacccgggtaccttttaaccgggg

SEQ ID NO: 270500 - DNA, 711 bp, Homo sapiens
  misc_feature: GYAE6OF02HWWU5.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctagttttaaaaggtgtccagtgtgaaatacagctggtggagtcgtggggacgccgttggtgaaggccgggggggtcacgtcagactcctcctgctctgcatctggttttatgtataagtgatgctggatgcacgtcggtccgaccaggtacaccggaggggaacggggctagggaggtcggggtccggtaccggttagtaggagggacgaaggtcggtagtggggtggggacgtaataacggaattacgtcgtacggacgacgaccgtaggaacggacggacaacggttacttacgaacccttagtccgtttacgaagtaacgataaggtaacttaccgggaaagtaaaaccgacgttaattcggtcctttacgtcggacgaacggtagtacggggtaacttacggaacgttacgggaaacgaaacccgggaaggtaaacccgaacggccgttaccttaacgttttagtaccgtttaaaggttccaaaggtagttaaattaccgttaacggttacccgggtaacgttacccggttaccggtacctttaaccggg

SEQ ID NO: 270501 - DNA, 742 bp, Homo sapiens
  misc_feature: GYAE6OF02JOIBL.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagtccttggtgaaggccggggggtcactcagactctcctgctctgcactcgttggttttatgataagtgtatcgccgtggatcgcgtacgtcgggtccgccgacggccgaaccggaggggaacggggtcgtagggacgggtacggggtccgggaccgttaaggttacgggaggggtaccggtaagggtcggtcggttggggtacgggggacgtaacgtaaggtaaacttaccgtcgtggaccgacggtcccgaagtcggaacggtacgggacgtaacggtaccttacccaaacccgtacgtttccgtacgaaaggtaacgtagttacggtaagttaaccggaaaggaaaaccgtacggtacgttacgtcgtttacgacgtaacgtaggtaacgtagggactaacggtccgaacggaacggacggaacgaccgaacggtacggtaccctacgtttaactttacggttacgttaccgtaagttaagtaacgttacggtttaccggttacccggtaacgtaccgttacccggttacccg

SEQ ID NO: 270502 - DNA, 601 bp, Homo sapiens
  misc_feature: GYAE6OF02FWVQO.21.17.B06.1.454.CMB.1.raw
  modified_base (384)..(384): a, c, t, g, unknown or other
  misc_feature (384)..(384): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaaggccgggggggtcactcagactctcctgctctgcatctggttttatgataagtgatgcctggatgcacgtgggtccgccaggcaccgaggggagggctggagtgggtcggcgtagtaggagggcgaagtgcgtgggtgggcgagtagaatactctgcagccgtgagnggcagacttcaccattctcagngatgattcgaanaaacgacgattgtcttcgtgacaagataggatacgaccgtaggaaaccgtaaccggaggacctaaccggacggtacccttattaagttttaacgttcggttaccaaagggttaacgttaacgttaaccgtttaaccgttaccccggggttagtaacccggttacccgggttcctttaaccggg

SEQ ID NO: 270503 - DNA, 797 bp, Homo sapiens
  misc_feature: GYAE6OF02JQ3ET.21.17.B06.1.454.CMB.1.raw
  modified_base (264)..(264): a, c, t, g, unknown or other
  misc_feature (264)..(264): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctgggtggagtctgggggagccgttggtgaaggccggggggtcactcagactctcctgctctgcatcttggtttangatagtgatgccgtggatgctacgtcgggtcccgccaggccaaccggaggggtaaggggcgtagggagggtcggggtaccggaccggttagttaacggaggggacgtaaggtcggcggtggggtacggggcgtaagtaagtaactaccgtgtacgacggtaacgccggttagaagggtacggacgtaaaggccttttaacccgaaacccttacgtttaccttaaccggtaagtacggtaacgttagggtaaaccgtttaaccggaaacgtaaaaccggtaaaccggtaacttacggttaccgtttaccgtacggtacggtaacggagttacgggtaaacgttaaccgggtccggttaaccgggaaacggggaaacccgtaaacggggtaccgtaaaccgtacccgggttactttaccggtttaacgtttttaaccggtttacgttacccggttaaaggaacgtttaaacgtttaaccggtttacccggttaaccgggttacgtacccggtttaacgggtaccgtttaaccggg

SEQ ID NO: 270504 - DNA, 769 bp, Homo sapiens
  misc_feature: GYAE6OF02JOYYO.21.17.B06.1.454.CMB.1.raw
  modified_base (594)..(594): a, c, t, g, unknown or other
  misc_feature (594)..(594): n is a, c, g, or t
  modified_base (603)..(603): a, c, t, g, unknown or other
  misc_feature (603)..(603): n is a, c, g, or t
tcagtcgtcgctcgcacgaccggtgctcgatttagtcgatagtgaagggggagacgagccccagccttgggattcccaagtgttttcattcagtgatcaggactgaacacagagactcaccatgaagttggctgagctggtccttcctcgttgcgttagtttaaaggtcgtctagtgtagaaatacgagtcgtggtcggtagtcggtggggcgtccgttaggtacgggtaacggggccgggggtctacctcgaacgtccttccgtccgtcgtctcgtcgtaccgttagttcgtttaggtttatagtaagttaggtacgtagtcgtacgtggtagtcgtaccggtcggtccggaccgacgacggtaaccgacggggtaacgggacgggtacggtagggtgggtcgggtaccggtacgtagggtaccggagggacgtaggtggaggtaggggtacggacgtaagtaacgtacgtacgtcgtacgacggtacgaacggtaggaacggcgtaacgtccgtaccgttaccgaactttcgacgtaagacggtaatacgtaaagtaccgaaaggtaaccgtaagttaccgtaattcgtacncgggttaanaacggtaattacggtagaacgtccgtaaaccgtaacgaaccggtacgaacgttaacgaccgtttacgtttacgttacgttaacggttcgttaaccgttaagtaagttaccgttacgttacggttacccggttaacgcccggttacttacccggttccgtaaccggg

SEQ ID NO: 270505 - DNA, 656 bp, Homo sapiens
  misc_feature: GYAE6OF02GVKSL.21.17.B06.1.454.CMB.1.raw
  modified_base (466)..(466): a, c, t, g, unknown or other
  misc_feature (466)..(466): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtacttcctcgttgctgttttaaaaggtgtccagtgtgaaatacagctggtggagtctgggggagccttggtgaaggccgggggggttcacgtcagactctcctgctctgctatctggttttatgataagtgatgcctggatgcacgtgggtccgcaggcaccgagggaagggctggaggtgggtcggacgttagtaggagggcgaaggtgcgtgggtgggctagtagaactactcgtagcaggccgtgaggacggacagtacttccactattccttagagagtatagtacttacggaacgaaacgcgtaagtcgtcttccgngaccgagtagtacggtagtacgtaccgttaggaaaccgtaaaccggacggaaccaaccgtaaccggtaccctttaactttaacgttttaacggtttacgtttaccccgaaaggttaagtaaaccttttaacgtttaaccggttaccccgggtaaacgttacccggttaaccgggtccgttttaacccggg

SEQ ID NO: 270506 - DNA, 629 bp, Homo sapiens
  misc_feature: GYAE6OF02IZGME.21.17.B06.1.454.CMB.1.raw
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (441)..(441): a, c, t, g, unknown or other
  misc_feature (441)..(441): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccgttggtggaaggccggggggggtcaccgtcgagacctctcctgctctgcatctggtttatgataagtgatgcctggatgctacgtcgggtcccgcgacggccaaccggaggggaaggggcgtgggaggtcggggtcggtccgtagttaggagggcgaaggtgngtgggngggngagtaggatactcgtgccaggccgtagacggagcgagacttcacctatctacgagatntacgtacttacgaaggaaaccacgattcgtcttgtagacctagtacgtaggattaccgaccgagggtaaaccgaaccgggacggaaccaacggtaccgtacccttagttaacgtttaacgttcgtttaccaaggtaacgttaattaccggtttaacgtcccggtagtaccgttacggtccttaacggg

SEQ ID NO: 270507 - DNA, 722 bp, Homo sapiens
  misc_feature: GYAE6OF02GHC6O.21.17.B06.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagtcgatagtgaagggggaggacgagccccacgccttgggagttcccaacgtgttttctattcagtgatcaggactgaacacagaggactcaccatgaagtttgggtcgtgagctgggtcttccgtcgttgctgttttaaaaggtgtccagtgtgaaatacagctggtggagtcgtgggggagccgttgggtggaaggccgggggggtcgacgtcgagactctcctgctctgctatctggttttatggtataagtagtatgccgtggtatgtacncgttcgggtccgtccgaggcaccggaggggaacgggcgtggaggtcgggtacggccggtaagttacggagggacggtaaggtcgcggtgggtcggggacgagtaagaagttaacctcgtagcgacggccggttagacgggaggccagtacgttaccgaacctattccgtacaagggtaacgtaatcggtacttaacggaacgtaaaacgacgaagttacgttcgttaccgtggtacaaggtcttaagggacttaacgggcccgttaagggaaacggtaaccccgaaagggacccgaaacggaccggttcccttaacgttagttttacttaaccggttacccgtaagtaacgttacgttaaagtttacccgttaaccggggttacccaacggtttaccccgggtaacctttacgg

SEQ ID NO: 270508 - DNA, 678 bp, Homo sapiens
  misc_feature: GYAE6OF02FVLO9.21.17.B06.1.454.CMB.1.raw
  modified_base (544)..(544): a, c, t, g, unknown or other
  misc_feature (544)..(544): n is a, c, g, or t
  modified_base (606)..(606): a, c, t, g, unknown or other
  misc_feature (606)..(606): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagcgtggtgggagtcgtgggggagccgttgggtggaaggccggggggtcactcagactcgtcctgctctgcatcgttggtttatgataagtgtatcgccgtggatcggacacggtcgggtcccgccgacggaccgaccgggaagggggacggggtcgtagggacgggtcggggtcggtaccgttaagttagggacgggaacggtaaggtcggtcggtgggggtcgggagaagttaaggaaacttacgtcgtacggacgtacggtccggtaggagggacggacgaagtactaccgaaccgtgttacgttacgagtagacgttagtacgtaacggaagtaaacgcggtaatcgtacttcnggaacctagtagtaggtataccgtagtacggaacgtaaacgcggtaacgaccgcgttacgtnttaacgtttgttaccgtacaggtacttaacgttacgttaccggtcgtacgtaacggttcctacgttaaccgg

SEQ ID NO: 270509 - DNA, 753 bp, Homo sapiens
  misc_feature: GYAE6OF02I9NSO.21.17.B06.1.454.CMB.1.raw
  modified_base (676)..(676): a, c, t, g, unknown or other
  misc_feature (676)..(676): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagttggctgagctgggtcttcctcgttgcttaggtttaaaaggtgtccagtgtagaaatacagctgggtggagtcggtgggggacgtcgttgggtaggaacgggccggggggtcacctcacgacctcctcctgctctcgctacttcgtttagttttatagaagttaaggtgtacttcggccgttaggagttacggccgtacgttccggggtccccgaccggaacggaccggaaaccggaagggggaacgggtacggtaggggtacgggttcggggtcccgggtaaccgttaaggttaacggggaacggggtaccggtaaaggtcggtaccggggttgggggtacggggacgtaaaggtaacggtaacttccgtagtacggaccgaacggtccggttaaggagggacggtaacgacgtaaccgttccaaacccgtatttaccgtacaaggacgtaatacggttaacgtaacggaaaaacaaccggtaacgagttccgcctttggactaacggagtagtacggtgtaaacggctaacgggaaacgtacgganaaccgcgtaccgcttacttacgttgttccaagtaagtactaattacgtacggtccgagaacccttcggtactaccgg

SEQ ID NO: 270510 - DNA, 810 bp, Homo sapiens
  misc_feature: GYAE6OF02GOJAS.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagttgggctgagctgggtcttcctcgttgctgttttaaaaggtgtccagtgtgaatacagctggtggagtcgtggggatccgttggtggaacggccggggggtcacgtcgagtacctctccgtgcctcgtgctagtcttggtttatgaatagtacgtatcgcgtaggatcgcgtacgtcggggtcccgcgacggacgaaccggaagggggaacggggcggtacgggtacgggtcggggttaccgggtaccggttaaggttaacggggacggggtaccggtaaggtcggtcgggttgggggtacggggaaccgtaaggttaaacggtaaactaccggttacgtacggaccggtacgggtaccggtaaggacgggtaacggacctaaggtaaccttacccgtaaccttaaccgttccgttaacggaacgttaaggtaacggtttacggtaaacgttaaccgggaaaacgtaaaacccggttaacgtaccggttacgttactttccgtacgggtaacctaagggtaaacggttacggaagttaccgggaacgttaaccgggaaaccgtaaaaccggacgtaaaccggacgtaccggtaccttacgtttacgtaactttaccgtaaccgaagttacgtaacgttacgttaccggtaccgtacgtaaccggttacgacccgttaacggg

SEQ ID NO: 270511 - DNA, 756 bp, Homo sapiens
  misc_feature: GYAE6OF02FID4L.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccgttggtggaacggccgggggggttcacgtcagactcctcctgctctgcattcgttggttttatgtataaggtgagtcgccgtggtatcgccgtacgtcgggtcccgccgacggccgaaccggagggaacgggtcgtgggaggtcgggtcggtaccgtaagttaggacgggcgaaggtcgcgtggggtgggacgaagtacgtaacgtaccgtcgtacggcgacgtccgtaggacggtacggcgtaagtaccttacgaaccctagtttcccttacggaaagtacgaattacggtaattaaccggaaacgtaaaccgtaccggtaattcgtaccctttgtacgactaaggtacgtacggtaacttccggaccgtaaggaaccgggtaaacccggaaacggtcccgaaaccgtcggttaccctttaacgtttaacgtttttaaacgttccgggttaaccctaaagggttaaaccgttaaactttaacccggttttaaccgggttacccgggttaacgtaacccggttacccgggtttaccttaacccggg

SEQ ID NO: 270512 - DNA, 585 bp, Homo sapiens
  misc_feature: GYAE6OF02GRIIF.21.17.B06.1.454.CMB.1.raw
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
  modified_base (356)..(356): a, c, t, g, unknown or other
  misc_feature (356)..(356): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctagttttaaaaggtgtccagtgtgaaatacagctggtggagtctgggggagccttgggtgaaggccggggggggtcactcagactctcctgctctgnatctggttttatgataagtgatgctggatncagtggccgacaggcacgagggagggctggagtgggtcggcgtagttaggagggcgaagtgacgtggtgggngagtagatactctgcgagccgtagacgaggcagtataccaaccngttctacgagagtntgaagtcggaaacgaaacgtacgaattgtaccttgtgtaccgaagtagacggtatacggtacctaggacgaaccggagaacacgtacggcttactacgtttagttaccgtacgtaagtacgtacgtaatttaccggtaccggttaacgccggttaaccggttacctaacgg

SEQ ID NO: 270513 - DNA, 623 bp, Homo sapiens
  misc_feature: GYAE6OF02J0DT1.21.17.B06.1.454.CMB.1.raw
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctggggagccgttggtgaaggtccggggggtcactcgagactctcctgctctgcatctggtttatgataagtcgatcgcctggatgcgacgtcgggtccgccgtacggcgaccggacgggaagggctgggaggtcgggtcggcgtagttagagggcgaagtcgngtggnggcgatagactacnctgcgagcgtgaggacgcagattccacctattctacgagagacttgatcgaagtaacctcggtatcgacttcgtgaccgtagtaggtacgtaacgtacggtcgtacggaaaggtaaacccggaggaaaccacgtacggtacccctttgtttaaacttcggtttcgtaaccgaagttaaacgtatttaaccggtttaccggaaccggttacggtaacccggtttaccgggtacctttaacggg

SEQ ID NO: 270514 - DNA, 734 bp, Homo sapiens
  misc_feature: GYAE6OF02IFSF4.21.17.B06.1.454.CMB.1.raw
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
  modified_base (562)..(562): a, c, t, g, unknown or other
  misc_feature (562)..(562): n is a, c, g, or t
tcagtcgtcgctcgcacgaccggtgctcgatttagtcgatagtgaagggggagacgagccccagccttgggattcccaagtgttttcattcagtgatcaggactgaacacagaggactcgaccatgaagtttgggctgagctggtcttcctcgttgcctgttttaaaggtgtacctagtgtacgaaatacagctaggtggagtcgtggggganccgttggngaagggccggggggtcacgtcagacttctcctgctctgtctagttacttgttttangtataagtgtacgtgcttggntcgtacgacggtcgggtaccgaccgtacggaccgtaaccggaggggtaacgggcgtagggtaacggtgggtaccggtacgttagttacgggacgggtacgaacggttcggccggttaggggacgggtaccgtaagtaaggtaacgttaaccgtacgttggtaccgaagtccggtaggaaggacggtacgtaggtaacctttcgacccttaagtccgttacgaaggtagtacgtacgggtacttacggaaactaacgacgttacncggttcttagacggacttacgacgttacgacgttaccggccgtaacggaaacgtaacccgggataaccgaaccgtcggtaccctttacttacggtttaacgtttccgacgtaaccgtaagtaacttttacggaaaccggtttccggaacgtaccgtacggttccccgtaagg

SEQ ID NO: 270515 - DNA, 622 bp, Homo sapiens
  misc_feature: GYAE6OF02JMU9U.21.17.B06.1.454.CMB.1.raw
  modified_base (274)..(274): a, c, t, g, unknown or other
  misc_feature (274)..(274): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtggggggtagccgttggtggaacggccgggggggtcacgtcgagactctcctgtctctgcatcgttggttttancggataagtgagtgccgtggatgctacgtcggtccgcgcgcgaccggagggaggcgtggaggtcgggtccggcgtagttacggagggcgaaggtcgcggtgggtagggcgtaagtaggtaactacgtcgtgccgtaggtccggtagacggtagcgtaagactacaccctagtccgttagacggagtagtacgtaagttacggaagtaaccgacgtatacgttcctgtaagccgtaagtaggtgaacgtcgacctaggaacggaaccgaacggacgaccgagtacccgtagtttacgtaggttcttacgaagtacgtatacgtacgtccgagtacgtccgtacgttacg

SEQ ID NO: 270516 - DNA, 813 bp, Homo sapiens
  misc_feature: GYAE6OF02FIUCR.21.17.B06.1.454.CMB.1.raw
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctggtcttcctcgttgctagttttaaaaggtgtccagtgtgaaatacagctggtggagtcgtggggagccgttggtggaacggccggggggttccaccgtccgacgacctccgttcccgtgctctgctattccgttggttttatgaattaagtgtactcgtcccgtggactgcctacgtccgggtcccgccgtaccggtaccgaaccggaggggtaacgggtcgtacgggtacggttacggggtccggtaccggttaagttacggggacggggaccggttaaacggtcggtacggttcggggtacggggtacgtaacggttaaacgtaaacttaaccggttcgtacggtaccgaccgggtacccggttaggaacgggtacggtacaacgtacctttaccgaaccctacgttccttaaccggaacggtaacgtacgttaaggttaccgtaaccggtaaaacgtaaaccgtaaccggttaattaccgttaccgttgtaccgacgtaagttacggtacggtaacgtacgtaccgtaacggaaccggtaaaccgaacggaacctaccgggaccgttaccgttacttaggtttaaaccttcggttaaacccgaagttaccgtaacgtttaacgttaacccggtaacccggttgtaacccggtaccgttaccgttaacgg

SEQ ID NO: 270517 - DNA, 783 bp, Homo sapiens
  misc_feature: GYAE6OF02G8VU6.21.17.B06.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagtcgatagtgaaggggagacgagccccagccttgggattcccaagtgttttcattcagtgatcaggactgaacaccagaggactcaccatcgaagttggctgagctgggtcttcctcgttgcgttagttttaaaaggtcgtccagtgtagaaatacgagcgtggtggacgtcgtgggganccgttggtagaacggtccgggggtaccactcgaagtaccttcctccgtgccttacgtcgcgtattccgttaggttttaagtcgtaagttaacggtgtacgtcggtccgtggatcgtcctacggttcgggtacccgacccggacggtacccgaaccgggacgggggtaacgggtccggttaggggtacggtcggggtcccggacggtaagttagggaacgggtcgtaaggtgtcggtggggtacgggagtaactaagaagttactcgacgtagtaacggccggtaggacgacgtacgtagtaccttacgactacgttcgtacgaggtagtagtcgtaaccgttaaggaagaaaccgtgtacttcgtaccgttcgtgaaccgtagttaaagggtcctaacggtccgttaaccggacgtaaagggaaaccccggtgtaaacccgcgtaaccggttaccctttaagtttaacgtttccgttaacggtaccctaaggttaccgtaaagtttaacccgttttaccgggaccccgggttaggtttaaccccccgtaacgggttccttaaaaccggg

SEQ ID NO: 270518 - DNA, 694 bp, Homo sapiens
  misc_feature: GYAE6OF02J2NGH.21.17.B06.1.454.CMB.1.raw
  modified_base (542)..(542): a, c, t, g, unknown or other
  misc_feature (542)..(542): n is a, c, g, or t
  modified_base (557)..(557): a, c, t, g, unknown or other
  misc_feature (557)..(557): n is a, c, g, or t
tcagtcgtcgctcgcacgaccggtgctcgatttagtcgatagtgaagggggagacgagccccagccttgggattcccaagtgttttcattcagtgaatcaggactgaacacagagactcaccatgaagtttggctgagtctggtcttcgtcgttgtcttaggttttaaaggtgtccagtgtagaaatacagtcgtggtggaggtcggtggggactccgttggtaggtaacgggtcccgggggtatacgtcgaagtcctccttccgtgtcctcgtcgtacttcgttacgtttagggtttactagtaagttagtacgtctcggtccggtagtacgtccgtacgtccggttccggacgccgcggaccggtacgggaagggtcgggagttcgggagggtccggtcgggtacgtaggtacggaggacggtaggtcggtcgggtagggaccggagtaacgtacgtacttcggacgcgtacgtaggtccggtagtggaaccgtcgtacgtacgtactactcgtctacgagtatagtactaagacgtaanacgttactgtccgtntgtacaggtacgaagtgtaacctgtaacggtacgaacgtacggtaaccgcaacggtcttacctattcggttacgtacgaatcgttaaagtaccgttacggtaccgttacggccgttaacgtcggttacgttaaccgg

SEQ ID NO: 270519 - DNA, 781 bp, Homo sapiens
  misc_feature: GYAE6OF02GZDNL.21.17.B06.1.454.CMB.1.raw
  modified_base (293)..(293): a, c, t, g, unknown or other
  misc_feature (293)..(293): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtcgtgggggagccgttgggtgaagggccgggggggtcacgtcgagactctcctgctctgcattcgttggttttatgtaattaagtgatcgcgtggntgctacgtcgggtccgccgtacggaccgaaccggagggggaaggggtccgtggggtagggtcggggtccggtaccggttaagttagggacgggaccggtaaggtcggtcggtgggggtggggacgtaagtaacggtaattaccgtacgtggtaccgaccgggtccggttagggacgggtacgggacctaaagggtaccttaccacccgttaatttcccgttaacgaggttaacggtagtacggttaagttaaccgaaacggaaaaccgtacgtagtcgttaccgttagtcggacgtaagtacggtagggtaacttaccggaccgtaagggaacggaacccggaaggaacccgtaccggaacggtttaccccttagtttaacgtttacggttaccggttaaccgaaggttaacgttaaccgttttaaacgttacccgggttaccgggttaaaccggtacccggtttacccgggttacctttaaccgggg

SEQ ID NO: 270520 - DNA, 902 bp, Homo sapiens
  misc_feature: GYAE6OF02HLV9X.21.17.B06.1.454.CMB.1.raw
  modified_base (634)..(634): a, c, t, g, unknown or other
  misc_feature (634)..(634): n is a, c, g, or t
tcagtcgtcgctcgcacgaccggtgctcgatttagtcgatagtgaagggggagacgagccccagccttgggattcccaagtgttttcattcagtgatcgggactgaacacagaggactcaccatgaagtttgggctgagctgggtccttcctcgttgcttagtttttaaaaggtgtccagtgtgaaatacagctggtggagtcgtggggagtccgttggtgaagggccggggggtcacgtcagactctcctgctcgtcgacattcgttaggttttatagtaattaagtgtatggtccgtggtaatcgacctaggttacggtcccggtccgaacggccgaaacccgggaaggggggtaaccggggtacggttaggggtacggggttacgggggtaccgggtacccggttaaaggttacgggaggggtaacgaaggttcggtccgggtaggggtacggggacggtaaacggtaagtaacgtttacctacgtacgggaccgacggtaccgggtgggaaacggacgggtaccgtaaggttaacccgtttacctaaacccgttactttacccgtttaacgaaaggggtaacgttacggttaacggttaacggttaaaccggaaaacggttaaaaacccncggttaaaggtttcccgttacccgttttacgaacgggtaactaacggggttagttaacgggtaagttaaaccgggttacccggtaaggaaaacccggtaacccggggaaacgtaaaccggtaaacccgtaccgttaccgtttaacgtttaacctttttacggttaccgggtaaacctaggggttaaaacttaccgttttaaaacggtttaacccgggtccgttaaacggttaccccgttaacgggttaccctttaaggtaaccccggg

SEQ ID NO: 270521 - DNA, 733 bp, Homo sapiens
  misc_feature: GYAE6OF02FPD73.21.17.B06.1.454.CMB.1.raw
  modified_base (382)..(382): a, c, t, g, unknown or other
  misc_feature (382)..(382): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttggctgagctgggtcttcctcgttgctagttttaaaaggtgtccgagtgtagaaatacagctgggtggagtcgtggggagtccgttgggtagaacggtccgggggggtcacgttcgaagtacctcctccgtgcgtcgtgctattcgttaggttttagtagtaagtaagtgattcgtcgtaggtatcgcgacgtcgggtccgcgcgacgacggagggacgggtgtggaggtcgggtcggtacgttagtacggngggtacggtaacggtggtcggtggggtcgggacgtaagtaacgtaatacgtgtacgtacgacgaccggtggacggacggacgttacgactttaccgacgtcgtttaacctcgaaagggtacctgttaacggttagtaaacccgaaacggtaaacgtaagtgtacgttacctacggtcgtaacgtgtaaacgtaggaccgtagtaacccgtaagggtaacccgaaacggaaccgtaaccgtaccggtacgtcccgttagttaagttttcgtaacccgtttaaggaagttaaccggttaattacccgggttaacctccgggttaaccgtaccggtttaaccgtggtaacccgg

SEQ ID NO: 270522 - DNA, 847 bp, Homo sapiens
  misc_feature: GYAE6OF02JSJVJ.21.17.B06.1.454.CMB.1.raw
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (282)..(282): a, c, t, g, unknown or other
  misc_feature (282)..(282): n is a, c, g, or t
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
  modified_base (477)..(477): a, c, t, g, unknown or other
  misc_feature (477)..(477): n is a, c, g, or t
  modified_base (527)..(527): a, c, t, g, unknown or other
  misc_feature (527)..(527): n is a, c, g, or t
  modified_base (592)..(592): a, c, t, g, unknown or other
  misc_feature (592)..(592): n is a, c, g, or t
tcagtcgtcgctcgcacgaccggtgctcgatttagtcgatagtgaagggggagacgagccccagccttgggattcccaagtgttttcattcagtgatcagactgaacacagagactcaccatgagtttggctgagcgtggtcttcctcgtgcttagttttaaaggngtacngtgagaaatcagctggtgagtctgggggactccgttggtagagggccgggggtcacgtnaacggtctcgtccngtacgtctcgctattcttaggtttatagagttaatcgnggttcgtccgtaggaagttcgtccgtggttccgggacctaccgacgggtacgaacccgggaaggggttacggtaccggtggggtacgggtcgggttacggtccgttaaggttacggggtacgggcggtaaacgggttcggnggtaacgggggttccgggngtaaagttacggtaacccggttgtttacgtacggngttaaccgcggggttagaccgggtaggacccttaggacttacccggttanacgtttcgtactaaccggtagttaaccgtagtaaccccgtttaaggaaaccgtaaacccgggttntttacggtaccggtttaccgtacgttaacggacggttaaacgggttaaccgggttaagaccggtttaccggaaccgggttaaaaccgggacccgggaaaccggtaaaccggaggttaaaccggtaccgtttacccgtttaacgttttaacggtaacggttttaccgaacgttaacggttaacccgttaaccggttttaacgggttaccggtttaccgggttaacccggtaacggtttacccggtccgggttaacg

SEQ ID NO: 270523 - DNA, 702 bp, Homo sapiens
  misc_feature: GYAE6OF02JNX7Y.21.17.B06.1.454.CMB.1.raw
  modified_base (403)..(403): a, c, t, g, unknown or other
  misc_feature (403)..(403): n is a, c, g, or t
  modified_base (511)..(511): a, c, t, g, unknown or other
  misc_feature (511)..(511): n is a, c, g, or t
  modified_base (578)..(578): a, c, t, g, unknown or other
  misc_feature (578)..(578): n is a, c, g, or t
  modified_base (694)..(694): a, c, t, g, unknown or other
  misc_feature (694)..(694): n is a, c, g, or t
tcagtcgtcgctcgcacgaccggtgctcgatttagtcgatagtgaagggggagacgagccccagccttgggattcccaagtgttttcgattcagtgatcaggactgaacacagaggactcaccatgaagtttgggctgagctgggtcttctcgttgctagttttaaaggtgtccagtgtagaaatcagcgtggtggacgtcgtggggatccgtttggaggaacggccggggggtacacgtgacgtactctcgtgcgtctcgcgtactcgttgtttagtgtaatagtagtgtcgcgtgagtcgactacggtcggtaccgccgacggtaccgaaccggtaggggaagggtcgtagggtacggttacgggtccgtacggttagttacgggaaggtcgtaaggtcgnggtcgggacgggtcgtaagtaacgattaccgtgtacgaccgtacgacggtgaacgggtacgagtaaccggatttacccggaccttacgttaccgttagaccgggtaanccgttaaggtacggttaaacgacggaaaaactccgggtacttcgtaccgtacgtccgaggtaaccgnggttaaaccggttcaggttacccggaagaaccgtaccggcgtaaaccggtaccgtcttagttacggttctggtaaccgtgtaacttgtaacgttccggcgttacgaccgttcggtntaacccgg

SEQ ID NO: 270524 - DNA, 662 bp, Homo sapiens
  misc_feature: GYAE6OF02H6GVJ.21.17.B06.1.454.CMB.1.raw
  modified_base (193)..(193): a, c, t, g, unknown or other
  misc_feature (193)..(193): n is a, c, g, or t
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
  modified_base (433)..(433): a, c, t, g, unknown or other
  misc_feature (433)..(433): n is a, c, g, or t
tcagtcgtcgctcgcacgaccggtgctcgatttagtcgatagtgaagggggagacgagccccagccttgggattcccaagtgttttcattcagtgatcaggactgaacacagaggactcaccatgaagtttgggctgagcgtcggtcgtccgtaggttcgcttagtttaaaggtgtcagttgagaaactcagntggtggagtcgtggggactccgtgtaggacggtcgggggtcactcgagtctctcgtagctactgcntgttaggttatcatagtgatgcttaaggntcgacgtacggtcggccacgacgaccgacgggtacggaggcgtaggtcggtcggtaccgtacggttaggtaggccggtaaggcgtggaccggttgggacggaactacgtaggtaagttcgcgtaccggaggtaacgtacggaagnggacggtacgtacgtacgtaaccgtacgtacgtacgtacgagtacgagtagtacgtacgtaacgtaaacgtaacgtacttacgtctacgtacgtacgtaagtaggtacgtacgtacgtacgacgaacgaacggaacgaacgacgaccgtaccgtacgtacgttacgttacgttactacgtaacgttacgttaacgtacgttaccggtaccggtacgtaccgtacgtacg

SEQ ID NO: 270525 - DNA, 759 bp, Homo sapiens
  misc_feature: GYAE6OF02GADW2.21.17.B06.1.454.CMB.1.raw
  modified_base (568)..(568): a, c, t, g, unknown or other
  misc_feature (568)..(568): n is a, c, g, or t
tcagtcgtcgctcgcacgaccggtgctcgatttagtcgatagtgaagggggagacgagccccagccttgggattcccaagtgttttcattccagtgaatcaggactgaacacagaggactcaccatgaagtttgggctgagctgggtcttcctcgttgctgttttaaaaggtgtccagtgtagaaatacagctggtggagtcgtgggggagtccgttggtgaacgggccggggggtcacgtcgagactctccgtgctcgtcgctattcgttaggttttatgtaattagtagatcgccgtgatgacacgtcggtccgactacggccgaccggaggggaacgggtcgtagggtacggtcggggtaccggaccgttagttaacggaggggtaccgtaaggtcgtcggtagggggtcgggacgtagtaacgaattacgtctaggccaaggtccggtagacggacggtcaacggtactaccgaaccttactttccgttaagaggttaagtcgtaaggttactaacggaaacgtaaccggatgtaccgtccgtttcgaacgtacctagggttanaccgggttagtacggaccgtaagggaacccggttaaacggacggttaaacgaccggtaacccggttcccttaaggtttaaccgtttttacgggtaccgttaaacccggaaggttaacgtttacgtttaaaccggttcccgggtttaccggtaacggtaaccccgtttaccgggttacctttaaccccgggg

SEQ ID NO: 270526 - DNA, 155 bp, Homo sapiens
  misc_feature: GYAE6OF01CA8O2.44.27.C05.1.454.CMB.1.raw
  modified_base (153)..(155): a, c, t, g, unknown or other
  misc_feature (153)..(155): n is a, c, g, or t
tcagacagtatatacacgaccggtgctcgatttagacgcgatcgaagggtttgggaaggaggaagactgacggtcctgccacagcggccctgggctgcctggtcaaggactacttcctatatactgtctgagcgggctggcaaggcgcatagnnn

SEQ ID NO: 270527 - DNA, 153 bp, Homo sapiens
  misc_feature: GYAE6OF01ELXCX.44.27.C05.1.454.CMB.1.raw
  modified_base (153)..(153): a, c, t, g, unknown or other
  misc_feature (153)..(153): n is a, c, g, or t
tcagacagtatatacacgaccggtgctcgatttagacgcgatcgaagggtttggggaagaggaagactgacggtcctgccacagcggccctgggctgcctggtcaaggactacttcctcgatcgcgtctgagcgggctggcaaggcgcatagn

SEQ ID NO: 270528 - DNA, 253 bp, Homo sapiens
  misc_feature: GYAE6OF01DR2O9.44.27.C05.1.454.CMB.1.raw
  modified_base (253)..(253): a, c, t, g, unknown or other
  misc_feature (253)..(253): n is a, c, g, or t
tcagacagtatatacacgaccggtgctcgatttagacgcgatcgaagggtttgggagttgcatactactactacggtatggacgtctggggccaagggaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagn

SEQ ID NO: 270529 - DNA, 318 bp, Homo sapiens
  misc_feature: GYAE6OF01EWA3J.44.27.C05.1.454.CMB.1.raw
  modified_base (308)..(318): a, c, t, g, unknown or other
  misc_feature (308)..(318): n is a, c, g, or t
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccatgtcactctgttcccgcctcctctatatactgtctgagcgggctggcaaggcgcatagnnnnnnnnnnn

SEQ ID NO: 270530 - DNA, 153 bp, Homo sapiens
  misc_feature: GYAE6OF01ETRHP.44.27.C05.1.454.CMB.1.raw
  modified_base (152)..(153): a, c, t, g, unknown or other
  misc_feature (152)..(153): n is a, c, g, or t
tcagacagtatatacacgaccggtgctcgatttagacgcgatcgaagggtttgggaagaggaagactgacggtcctgccacagcggccctgggctgcctggtcaaggactacttcctatatactgtctgagcgggctggcaaggcgcatagnn

SEQ ID NO: 270531 - DNA, 154 bp, Homo sapiens
  misc_feature: GYAE6OF01DSQ93.44.27.C05.1.454.CMB.1.raw
  modified_base (154)..(154): a, c, t, g, unknown or other
  misc_feature (154)..(154): n is a, c, g, or t
tcagacagtatatacacgaccggtgctcgatttagacgcgatcgaagggtttgggggaagaggaagactgacggtcctgccacagcggccctgggctgcctggtcaaggactacttcctatatactgtctgagcgggctggcaaggcgcatagn

SEQ ID NO: 270532 - DNA, 153 bp, Homo sapiens
  misc_feature: GYAE6OF01DZFSR.44.27.C05.1.454.CMB.1.raw
  modified_base (153)..(153): a, c, t, g, unknown or other
  misc_feature (153)..(153): n is a, c, g, or t
tcagacagtatatacacgaccggtgctcgatttagacgcgatcgaagggtttggggaagaggaagactgacggtcctgccacagcggccctgggctgcctggtcaaggactacttcctatatactgtctgagcgggctggcaaggcgcatagn

SEQ ID NO: 270533 - DNA, 312 bp, Homo sapiens
  misc_feature: GYAE6OF01BU2YE.44.27.C05.1.454.CMB.1.raw
  modified_base (309)..(312): a, c, t, g, unknown or other
  misc_feature (309)..(312): n is a, c, g, or t
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgcgtctgggtcgcctggacagtcggtcaccatctcctgcactggagccagcggtcagcccaaggccaaccccactgtcactctgttcccgccctcctctatatactgtctgagcgggctggcaaggcgcatagnnnn

SEQ ID NO: 270534 - DNA, 171 bp, Homo sapiens
  misc_feature: GYAE6OF01BZUAB.44.27.C05.1.454.CMB.1.raw
  modified_base (164)..(171): a, c, t, g, unknown or other
  misc_feature (164)..(171): n is a, c, g, or t
tcagacagtatatacacgaccggtgctcgatttagacgcgatcgaagggtttggtgggtctccactcccgccttgacggggctgccatctgccttccaggccactgtcactctgttcccaccctcctctatatactgtctgagcgggctggcaaggcgcatagnnnnnnnn

SEQ ID NO: 270535 - DNA, 170 bp, Homo sapiens
  misc_feature: GYAE6OF01CZSKI.44.27.C05.1.454.CMB.1.raw
  modified_base (170)..(170): a, c, t, g, unknown or other
  misc_feature (170)..(170): n is a, c, g, or t
tcagacagtatatacacgaccggtgctcgatttagacgcgatcgaagggtttgggtgttcggcggagggaccaagctgaccgtcctgggtcagcccaaggctgccccctcggtcactctgttcccgccctcctctatatactgtctgagcgggctggcaaggcgcatagn

SEQ ID NO: 270536 - DNA, 155 bp, Homo sapiens
  misc_feature: GYAE6OF01BB0N6.44.27.C05.1.454.CMB.1.raw
  modified_base (154)..(155): a, c, t, g, unknown or other
  misc_feature (154)..(155): n is a, c, g, or t
tcagacagtatatacacgaccggtgctcgatttagacgcgatcgaagggtttgggggaagaggaagactgacggtcctgccacagcggccctgggctgcctggtcaaggactacttcctatatactgtctgagcgggctggcaaggcgcatagnn

SEQ ID NO: 270537 - DNA, 590 bp, Homo sapiens
  misc_feature: GYAE6OF01B90ML.44.27.C05.1.454.CMB.1.raw
  modified_base (428)..(428): a, c, t, g, unknown or other
  misc_feature (428)..(428): n is a, c, g, or t
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaatcatcatctatgagcctaataagaggccctgagggtttctaatcgcttcactgcctcaagtccggacaacacgccctcctgacaatctctgggctccgaggctaggaggacgaggctagattattattgtgctcagtnttgttcgtcgactatactaactttagtcgttcgttacgggaagttcgggaaccctaaagggttccaaccccgggtttcctaaggggttacccaacggaccccctaaaacgggccccctaaaaccccccgacgttccggtaccctaaccgttccttaccccgg

SEQ ID NO: 270538 - DNA, 315 bp, Homo sapiens
  misc_feature: GYAE6OF01DLUXJ.44.27.C05.1.454.CMB.1.raw
  modified_base (312)..(315): a, c, t, g, unknown or other
  misc_feature (312)..(315): n is a, c, g, or t
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaaccccactgtccactctcgttcccaccctcctctatatactgtctgagcgggctggcaaggcgcatagnnnn

SEQ ID NO: 270539 - DNA, 164 bp, Homo sapiens
  misc_feature: GYAE6OF01DR4L6.44.27.C05.1.454.CMB.1.raw
  modified_base (163)..(164): a, c, t, g, unknown or other
  misc_feature (163)..(164): n is a, c, g, or t
tcagacagtatatacacgaccggtgctcgatttagacgcgatcgaagggtttggtggtctccactcccgccttgacggggctgccatctgccttccaggccactgtcactctgttcccgccctcctctatatactgtctgagcgggctggcaaggcgcatagnn

SEQ ID NO: 270540 - DNA, 158 bp, Homo sapiens
  misc_feature: GYAE6OF01DE5IL.44.27.C05.1.454.CMB.1.raw
  modified_base (152)..(158): a, c, t, g, unknown or other
  misc_feature (152)..(158): n is a, c, g, or t
tcagacagtatatacacgaccggtgctcgatttagacgcgatcgaagggtttggggaagaggaagactgacggtcctgccacagcggccctgggctgcctggtccaaggctacttccacgtctactgctgagcggctggcaaggcgcatagnnnnnnn

SEQ ID NO: 270541 - DNA, 312 bp, Homo sapiens
  misc_feature: GYAE6OF01D0ZZ6.44.27.C05.1.454.CMB.1.raw
  modified_base (309)..(312): a, c, t, g, unknown or other
  misc_feature (309)..(312): n is a, c, g, or t
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccactgtcactctgttcccaccctcctctatatactgtctgagcgggctggcaaggcgcatagnnnn

SEQ ID NO: 270542 - DNA, 155 bp, Homo sapiens
  misc_feature: GYAE6OF01EHAKT.44.27.C05.1.454.CMB.1.raw
  modified_base (154)..(155): a, c, t, g, unknown or other
  misc_feature (154)..(155): n is a, c, g, or t
tcagacagtatatacacgaccggtgctcgatttagacgcgatcgaagggtttgggggaagaggaagactgacggtcctgccacagcggccctgggctgcctggtcaaggactacttcctcgatcgcgtctgagcgggctggcaaggcgcatagnn

SEQ ID NO: 270543 - DNA, 527 bp, Homo sapiens
  misc_feature: GYAE6OF01EF883.44.27.C05.1.454.CMB.1.raw
  modified_base (315)..(315): a, c, t, g, unknown or other
  misc_feature (315)..(315): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaatcatcatctatgaggcctataagngcctcagggtttctaatcgcttcactgcctcaagtccgcaacacggcctccctgacaatctctggctccaggctgaggacgaggctgattattattgttgctcagtattgttcgtcgctatcctactttatgttacttcggaagttcgggacctaaggtcctaccgtccgtaggcacgcccaaggccccaacccactgtccactcgttcccg

SEQ ID NO: 270544 - DNA, 503 bp, Homo sapiens
  misc_feature: GYAE6OF01A5QQU.44.27.C05.1.454.CMB.1.raw
  modified_base (496)..(496): a, c, t, g, unknown or other
  misc_feature (496)..(496): n is a, c, g, or t
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcactgcctcaagtccgcaacacggcctcctgacaatctctgggctccaggctgaggacgaggctgattattattgttgctcagatgttcgtcgcatctacttatgtcttcggaagtggaccaggtcacgtctagcagcccaaggccaacccatgcnctctccg

SEQ ID NO: 270545 - DNA, 312 bp, Homo sapiens
  misc_feature: GYAE6OF01A905X.44.27.C05.1.454.CMB.1.raw
  modified_base (307)..(312): a, c, t, g, unknown or other
  misc_feature (307)..(312): n is a, c, g, or t
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccactgtcactctgttcccacctctctatatactgtctgagcgggctggcaaggcgcatagnnnnnn

SEQ ID NO: 270546 - DNA, 159 bp, Homo sapiens
  misc_feature: GYAE6OF01DXJEP.44.27.C05.1.454.CMB.1.raw
  modified_base (154)..(159): a, c, t, g, unknown or other
  misc_feature (154)..(159): n is a, c, g, or t
tcagacagtatatacacgaccggtgctcgatttagacgcgatcgaagggtttgggggaagaggaagactgacggtcctgccacagcggccctgggctgcctggtcaaggactacttccacgtctactgctgagcgggctggcaaggcgcatagnnnnnn

SEQ ID NO: 270547 - DNA, 313 bp, Homo sapiens
  misc_feature: GYAE6OF01EESZK.44.27.C05.1.454.CMB.1.raw
  modified_base (311)..(313): a, c, t, g, unknown or other
  misc_feature (311)..(313): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccactgtcactctgttcccaccctcctctatatactgtctgagcgggctggcaaggcgcatagnnn

SEQ ID NO: 270548 - DNA, 511 bp, Homo sapiens
  misc_feature: GYAE6OF01BZH1I.44.27.C05.1.454.CMB.1.raw
  modified_base (223)..(223): a, c, t, g, unknown or other
  misc_feature (223)..(223): n is a, c, g, or t
  modified_base (417)..(417): a, c, t, g, unknown or other
  misc_feature (417)..(417): n is a, c, g, or t
  modified_base (499)..(499): a, c, t, g, unknown or other
  misc_feature (499)..(499): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaggtaaagcccccaaatcatcatctatgaggcctataagaggccctcagggtttcaatcgcttcactgcctcaagtccgcaacacggcctccctgacaatctctgggctcaggctgaggacgaggctgatttattattgttnctcagtatgttcgcgcatctacttatgtcttcggaagtcgggacctaaggtcaccgtctaggccagcccaaagcccaacccntatccatctccg

SEQ ID NO: 270549 - DNA, 159 bp, Homo sapiens
  misc_feature: GYAE6OF01D8B4E.44.27.C05.1.454.CMB.1.raw
  modified_base (159)..(159): a, c, t, g, unknown or other
  misc_feature (159)..(159): n is a, c, g, or t
tcagacagtatatacacgaccggtgctcgatttagacgcgatcgaagggtttgggctgaccaaggtcaccgtcctagttcagcccaaggccaaccccactgtcactctgttcccaccctcctctatatactgtctgagcgggctggcaaggcgcatagn

SEQ ID NO: 270550 - DNA, 174 bp, Homo sapiens
  misc_feature: GYAE6OF01CGXFJ.44.27.C05.1.454.CMB.1.raw
  modified_base (170)..(174): a, c, t, g, unknown or other
  misc_feature (170)..(174): n is a, c, g, or t
tcagacagtatatacacgaccggtgctcgatttagacgcgatcgaagggtttgggtgttcggcggagggaccaagctgaccgtcctgggtcagcccaaggctgccccctcggtcactctgttcccaccctcctctatatactgtctgagcgggctggcaaggcgcatagnnnnn

SEQ ID NO: 270551 - DNA, 499 bp, Homo sapiens
  misc_feature: GYAE6OF01CVZIA.44.27.C05.1.454.CMB.1.raw
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (321)..(321): a, c, t, g, unknown or other
  misc_feature (321)..(321): n is a, c, g, or t
  modified_base (427)..(427): a, c, t, g, unknown or other
  misc_feature (427)..(427): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaagcccccaaatcatcatctatgagcctataagaggccctnagggtttcaatcgcttcactgcctcaagtcgcaacacgcctcctgacaatctctggctccagctgaggacgagctgattattattgtgctcagtattgttcgtcgnatcacttatgttcttggaagtggaccaggtcaccgtctaggcacgcccaaggcccaacccatgcactctccg

SEQ ID NO: 270552 - DNA, 548 bp, Homo sapiens
  misc_feature: GYAE6OF01CCBEW.44.27.C05.1.454.CMB.1.raw
  modified_base (189)..(189): a, c, t, g, unknown or other
  misc_feature (189)..(189): n is a, c, g, or t
  modified_base (284)..(284): a, c, t, g, unknown or other
  misc_feature (284)..(284): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgctcctggtatcaacatcatccaaggtaaacncccccaaatcatcatctatgagcctataagaggccctgagggtttctaatcgcttcactgcctccaagtccggacaacacggcctccctgacaatctctgggcctccgaggctgaggacgaggctgatttattattgttgcttcagtattcgttcgtcgctatctactttatgttcgttcggaaagttcgggaacctaagggtccaccggttccgtaggtcacgaccccaaaggccccaaaccccactgtccacgttccttccg

SEQ ID NO: 270553 - DNA, 257 bp, Homo sapiens
  misc_feature: GYAE6OF01C2O73.44.27.C05.1.454.CMB.1.raw
  modified_base (255)..(257): a, c, t, g, unknown or other
  misc_feature (255)..(257): n is a, c, g, or t
tcagacagtatatacacgaccggtgctcgatttagacgcgatcgaagggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnn

SEQ ID NO: 270554 - DNA, 336 bp, Homo sapiens
  misc_feature: GYAE6OF01ANLDA.44.27.C05.1.454.CMB.1.raw
  modified_base (253)..(253): a, c, t, g, unknown or other
  misc_feature (253)..(253): n is a, c, g, or t
  modified_base (313)..(336): a, c, t, g, unknown or other
  misc_feature (313)..(336): n is a, c, g, or t
tcagacagtatatacacgaccggtgctcgatttagacgcgatcgaagggtttgggggggtcacaaaggaggcagcgctctcgggacgtctccaccatggcctgggctctgcctgctcctcactctccgtcacccaggacacagggtcctgggcccagtctgccctgactcagcctgcctccgtgtctgggtcgcctggacagtcggtcaccatctcctgcactggagccagcggtcagcccaaggccaacccnctgtcactctgttcccacctctctatatactgtctgagcgggctggacaaggcgcatagnnnnnnnnnnnnnnnnnnnnnnnn

SEQ ID NO: 270555 - DNA, 331 bp, Homo sapiens
  misc_feature: GYAE6OF01CVZNP.44.27.C05.1.454.CMB.1.raw
  modified_base (189)..(189): a, c, t, g, unknown or other
  misc_feature (189)..(189): n is a, c, g, or t
  modified_base (249)..(249): a, c, t, g, unknown or other
  misc_feature (249)..(249): n is a, c, g, or t
  modified_base (306)..(331): a, c, t, g, unknown or other
  misc_feature (306)..(331): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcacatctcctgcacgtggagccagcggtcagcccaaggccaacccntgtcactctgtccgcctcctctatatactgtctgagcgggctggcaaggcgcatagnnnnnnnnnnnnnnnnnnnnnnnnnn

SEQ ID NO: 270556 - DNA, 260 bp, Homo sapiens
  misc_feature: GYAE6OF01B418W.44.27.C05.1.454.CMB.1.raw
  modified_base (255)..(260): a, c, t, g, unknown or other
  misc_feature (255)..(260): n is a, c, g, or t
tcagacagtatatacacgaccggtgctcgatttagacgcgatcgaagggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnn

SEQ ID NO: 270557 - DNA, 517 bp, Homo sapiens
  misc_feature: GYAE6OF01AT9TI.44.27.C05.1.454.CMB.1.raw
  modified_base (361)..(361): a, c, t, g, unknown or other
  misc_feature (361)..(361): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcggtcaccatctcctgcactggagccagcggtaatattcttagtcttaactttgtctcctggtatcaacatcatccaggtaaacgcccccaaactcatcatctatgaggcctataagagccctcagggtttctaatcgcttcactcgctccagtccgcaacncggcctccctgacatctctggctcagctgagacgagctgattattatgttgctcagattgttcgtcgctatctacttatgtcttcggaagtcgggacctaaggtccaccgttctaggtcacgaccccgaaggccccaaccccatcgtcacgttccg

SEQ ID NO: 270558 - DNA, 319 bp, Homo sapiens
  misc_feature: GYAE6OF01DCXR4.44.27.C05.1.454.CMB.1.raw
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (314)..(319): a, c, t, g, unknown or other
  misc_feature (314)..(319): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtcagcccaaggcccaaccccatgtcactctcgttccccgccctcctctatatactgtctgacgcgggctggcaaggcgcatagnnnnnn

SEQ ID NO: 270559 - DNA, 883 bp, Homo sapiens
  misc_feature: GYAE6OF01C2K6P.44.27.C05.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
tcagacagtatatacacgaccggtgctcgatttagacgcgatcgaagggtttgggggggtcacaagaggcagcgcgtctcgggacgtctccaccgatggcctgggcctctgctgcctccgtcacctctcctcacccaggaccaccgagggtcctgggcccagttctgccctgacctcagtcctcgcctccgtgtctcgggtccncctggacagtcgtcacatctcctgcactgganccagtcggtaatnttacttagtacttaactttgtacttccgtaggtactactaaactagttcataccaaggtaaaacgaccccccaaagtcaactccaattctaatgaaggtcccttaagtaacgacggtaccccttaacgtaagggggtttttacctaaacgttaccggtacgtttacccaacgtttccgtaacccgtttacccgaaacggtttccccgggaacgtaaaccgtaccggggtaccccttccccgtttagggaaaccctaaaatttcccgttaccgttacgggggtccctttacccggaacgggtacccttacggaaacggggtaaccggttaacggggtccttaacggtaacgtttttaagtttaacggtttcggttttacgtccgttaccctaaaacggtacttttcgggtttaccgttaccggtaactaaacgtttaccttaaccgttttaacgtttccggtttacccggttttaccggggtaaacgggttaccggggtaaaaccccggtaaacgggttccggaaaccccggtttacccggtaagggtttacccaacgggtaaccccccggaaaaggtcccccgtaaaaccccccgtagtttccggtaccctaacccgtttccgtttaccccggg

SEQ ID NO: 270560 - DNA, 177 bp, Homo sapiens
  misc_feature: GYAE6OF01AP5RK.44.27.C05.1.454.CMB.1.raw
  modified_base (170)..(177): a, c, t, g, unknown or other
  misc_feature (170)..(177): n is a, c, g, or t
tcagacagtatatacacgaccggtgctcgatttagacgcgatcgaagggtttgggtgttcggcggagggaccaagctgaccgtcctgggtcagcccaaggctgccccctcggtcactctgttcccgccctcctctatatactgtctgagcgggctggcaaggcgcatagnnnnnnnn

SEQ ID NO: 270561 - DNA, 325 bp, Homo sapiens
  misc_feature: GYAE6OF01BYNSL.44.27.C05.1.454.CMB.1.raw
  modified_base (314)..(325): a, c, t, g, unknown or other
  misc_feature (314)..(325): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaaggcccaaaccccactgtcactctgttcccgccctcctctatatactgtctgagcgggctggcaaggcgcatagnnnnnnnnnnnn

SEQ ID NO: 270562 - DNA, 516 bp, Homo sapiens
  misc_feature: GYAE6OF01ATAUL.44.27.C05.1.454.CMB.1.raw
  modified_base (323)..(323): a, c, t, g, unknown or other
  misc_feature (323)..(323): n is a, c, g, or t
  modified_base (504)..(504): a, c, t, g, unknown or other
  misc_feature (504)..(504): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctnaggggtttctaatcgcttcactgcctcaagtccgcaacacggcctcctgacatctctgggctccaggctgaggacgaggctgattattattgttgctcagtatgttcgtcgcatctactttatgttcttacgggaagtgggaccaggtccaccgtctaggtcacgcccaaggcccaacccntgtcactctccg

SEQ ID NO: 270563 - DNA, 532 bp, Homo sapiens
  misc_feature: GYAE6OF01BEW6F.44.27.C05.1.454.CMB.1.raw
  modified_base (361)..(361): a, c, t, g, unknown or other
  misc_feature (361)..(361): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgagcctataagaggccctcagggtttctaatcgcttcactgcctcaagtccgcaacncgcctccctgacaatctctcgggctccgaggctgaggacgaggctgattattattgttgctcagtatgttcgtcgctatctactttatcgtcttacggaagtgggaaccaggtccaccgttcctaggtcacgcccgaacggccctaaccccactcgtctaccgtcgtcccg

SEQ ID NO: 270564 - DNA, 340 bp, Homo sapiens
  misc_feature: GYAE6OF01A98QW.44.27.C05.1.454.CMB.1.raw
  modified_base (222)..(222): a, c, t, g, unknown or other
  misc_feature (222)..(222): n is a, c, g, or t
  modified_base (319)..(340): a, c, t, g, unknown or other
  misc_feature (319)..(340): n is a, c, g, or t
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtcacgcccaaggcccaaccccatgtcactctcgttccccgcctcctctatactactgtctgacgcgggctggacgaaggccgacagtagnnnnnnnnnnnnnnnnnnnnnn

SEQ ID NO: 270565 - DNA, 551 bp, Homo sapiens
  misc_feature: GYAE6OF01EF6GF.44.27.C05.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (425)..(425): a, c, t, g, unknown or other
  misc_feature (425)..(425): n is a, c, g, or t
  modified_base (484)..(484): a, c, t, g, unknown or other
  misc_feature (484)..(484): n is a, c, g, or t
tcagacagtatatacacgaccggtgctcgatttagacgcgatcgaagggtttgggggggtcacaagaggcagcactcaggacaatctccagcatggcctggtctcctctcctcctcactctcctcgctcactgcacagggtcctgggcccactctgtgctgacgcagccgccctcagtgtcgtggggccccgggnagagggtcaccatctcctgcactgggancagatccaanatcgggacagattctgatgtccactggtaccaacaccttccaacggaacacgacccccaaaactcctacattcttaggtaaacaactactccggccctcgacggggtccctgaccgtattctctggctccaagtctggccacctcacgcctcctgccactcactcgggcctccgagctagaagatggaggtntattattcgtgcctagtcctatgacagcacgtcctgtaggttggttgggtcgttcgggnggacgggacaggtcctggacccgtcgtcgggtcacggacccgaggtccgtcgtcccccgtggtcccg

SEQ ID NO: 270566 - DNA, 175 bp, Homo sapiens
  misc_feature: GYAE6OF01EMVPT.44.27.C05.1.454.CMB.1.raw
  modified_base (155)..(175): a, c, t, g, unknown or other
  misc_feature (155)..(175): n is a, c, g, or t
tcagacagtatatacacgaccggtgctcgatttagacgcgatcgaagggtttgggggaagaggaagactgacggtcctgcctacagcggccctgggctgcctggtcaaggactacttcctatatactgtctgagcgggctggcaaggcgcatagnnnnnnnnnnnnnnnnnnnnn

SEQ ID NO: 270567 - DNA, 155 bp, Homo sapiens; identical to SEQ ID NO: 270536
  misc_feature: GYAE6OF01BKNK3.44.27.C05.1.454.CMB.1.raw
  modified_base (154)..(155): a, c, t, g, unknown or other
  misc_feature (154)..(155): n is a, c, g, or t

SEQ ID NO: 270568 - DNA, 154 bp, Homo sapiens; identical to SEQ ID NO: 270531
  misc_feature: GYAE6OF01EG2BZ.44.27.C05.1.454.CMB.1.raw
  modified_base (154)..(154): a, c, t, g, unknown or other
  misc_feature (154)..(154): n is a, c, g, or t

SEQ ID NO: 270569 - DNA, 747 bp, Homo sapiens
  misc_feature: GYAE6OF01D1FZX.44.27.C05.1.454.CMB.1.raw
  modified_base (162)..(162): a, c, t, g, unknown or other
  misc_feature (162)..(162): n is a, c, g, or t
  modified_base (164)..(164): a, c, t, g, unknown or other
  misc_feature (164)..(164): n is a, c, g, or t
  modified_base (166)..(166): a, c, t, g, unknown or other
  misc_feature (166)..(166): n is a, c, g, or t
  modified_base (170)..(170): a, c, t, g, unknown or other
  misc_feature (170)..(170): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctncncnctcnctcctcgtgtcggtcggtccgtcgtacgacgtcggtccgtaccacctactcccttccgtcgacctacggtaggaccgaccgacgggtaacgttaatttacttttacgtttacgtttaaccttttacgtttcgttccttttggttagttactaaccaactactactacctacggtaaaaggtaacccccaaacccctaactactactactacttacttagacggaccgtaacttaagtaagggcccgtccctaaggggtttacgggtttaacttaacgtccgttaccttacctacgtcccgtccctaacgtaccggtccgaaaccaaccggtcccgtccctaccgaacgaactacttccgtacgggtccgtccctacggcgtcgagggaccggaggtcgtcgtaagttaactttatttacgtttgtactactacgtagtttgttcgtcgtctacgtactacctttagtttacgtcgtttaccggtaggtacgggtaccgtaacggtacgtacccgtccgttacggacgtacacccgaaccgaccgaccccctacctgtactacctcgtccgttccccg

SEQ ID NO: 270570 - DNA, 317 bp, Homo sapiens
  misc_feature: GYAE6OF01EWMX2.44.27.C05.1.454.CMB.1.raw
  modified_base (313)..(317): a, c, t, g, unknown or other
  misc_feature (313)..(317): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccactgtcactctcgttccccaccctcctctatatactgtctgagcgggctggcaaggcgcatagnnnnn

SEQ ID NO: 270571 - DNA, 519 bp, Homo sapiens
  misc_feature: GYAE6OF01AT6Z6.44.27.C05.1.454.CMB.1.raw
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgctcctggtatcaacatcatccaggtaaancccccaaactcatcatctatgaggcctanaagaggccctnagggtttctaatcgcttcactgcctcaagtccggcaacacggcctccctgacaatctctgggctcaggctgaggacgaggctgattattattgttgctcagtatgttcgtcgctagtctacttatgtcttggaagtgggacctaaggtccaaccggtctaggtcacgcccgaaggcccaacccntnccngtcctccg

SEQ ID NO: 270572 - DNA, 348 bp, Homo sapiens
  misc_feature: GYAE6OF01B1XBF.44.27.C05.1.454.CMB.1.raw
  modified_base (260)..(260): a, c, t, g, unknown or other
  misc_feature (260)..(260): n is a, c, g, or t
  modified_base (314)..(314): a, c, t, g, unknown or other
  misc_feature (314)..(314): n is a, c, g, or t
  modified_base (320)..(348): a, c, t, g, unknown or other
  misc_feature (320)..(348): n is a, c, g, or t
tcagacagtatatacacgaccggtgctcgatttagacgcgatcgaagggtttggggggggtcgacaaggaggcagcgtctctcgggacgtctccaccatggcctgggctctgctgctcctcacgtctcctcacccaggacacgagggtcctgggcccagtctgccctgactcagcctgcctccgtgtctgggtcgcctgggacagtcggtcaccatctcctgcacgtggagccaggcggtcagcccaaggcccaaccccntgtcactctgttccccgcctcctctatatactgtctgagcgggctggcaaggcncatagnnnnnnnnnnnnnnnnnnnnnnnnnnnnn

SEQ ID NO: 270573 - DNA, 317 bp, Homo sapiens
  misc_feature: GYAE6OF01DZ8D1.44.27.C05.1.454.CMB.1.raw
  modified_base (312)..(317): a, c, t, g, unknown or other
  misc_feature (312)..(317): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccatgtcactctcgttcccgccctcctctatatactgtctgagcgggctggcaaggcgcatagnnnnnn

SEQ ID NO: 270574 - DNA, 579 bp, Homo sapiens
  misc_feature: GYAE6OF01DNP2M.44.27.C05.1.454.CMB.1.raw
  modified_base (363)..(363): a, c, t, g, unknown or other
  misc_feature (363)..(363): n is a, c, g, or t
  modified_base (430)..(430): a, c, t, g, unknown or other
  misc_feature (430)..(430): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaatttgtctcctggtatcaacatcatccaggtaaacgcccccaaatcatcatctatgagcctataagacggccctacgtagggtttcaatcgcttcactgcctcaagtccgacaacncgcctcctgacatctcgtggctccgaggcctggacggacgaggctaggtaatttatttatttggttncgttcaagtattgttacgtcgactattcctaactttatcgttcttacgggaacgttcgggaacctaaacgggttcccaaccggttccgtagggtccacggaccccgaaaggcccccaaacccctacgtctacccacgttccgttccccg

SEQ ID NO: 270575 - DNA, 588 bp, Homo sapiens
  misc_feature: GYAE6OF01DRXNO.44.27.C05.1.454.CMB.1.raw
  modified_base (228)..(228): a, c, t, g, unknown or other
  misc_feature (228)..(228): n is a, c, g, or t
  modified_base (447)..(447): a, c, t, g, unknown or other
  misc_feature (447)..(447): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcagtcaccatctcctgcactggaaccaanagtgacgtcggttcgttttgaccgtgtctcctggtaccagcacgacccagaaccacgacccccaaatctatttatttatgacgtacaattcgttccgtcccttccggtgtccctgacgtcgtcttctcgtcggtacaagtctggacaacgccggcctcctagacctatcctcgtgggcctaccgaggctaggacggacgaggtctagtatttagttacngctagctacatactagaagtaggtaacttactttactagttcggacgtacgtaacggaccaagccgtacgaccgtacgtacggccacgacccgtaggccctcgcccccgttggtcctaccgttccgttcgtcccccgtccc

SEQ ID NO: 270576 - DNA, 538 bp, Homo sapiens
  misc_feature: GYAE6OF01DGIV9.44.27.C05.1.454.CMB.1.raw
  modified_base (244)..(244): a, c, t, g, unknown or other
  misc_feature (244)..(244): n is a, c, g, or t
  modified_base (530)..(530): a, c, t, g, unknown or other
  misc_feature (530)..(530): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgatcaccatctcctgcactgggtccagcaatgacagttgggganatataaccttgtctcctggtatcaacaacatccaggcaaacgccccaaactctattactttttgagtccagtgagcggcgtcagtgttactaatcgtcttctctggctcagtctggccacaccggtcctcccgtgtcgtactctcgtcgggcctccggcctggacggacgaggctgactagtactgcgctctattacacttctgtagtacgttgggtgtcggcggaggtctcgacgtcgaccgttcgtaggtcacgacccgaacggtcctaccgcccctcggtccncgttcccg

SEQ ID NO: 270577 - DNA, 525 bp, Homo sapiens
  misc_feature: GYAE6OF01B3U34.44.27.C05.1.454.CMB.1.raw
  modified_base (321)..(321): a, c, t, g, unknown or other
  misc_feature (321)..(321): n is a, c, g, or t
  modified_base (420)..(420): a, c, t, g, unknown or other
  misc_feature (420)..(420): n is a, c, g, or t
  modified_base (515)..(515): a, c, t, g, unknown or other
  misc_feature (515)..(515): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccagtaaacgccccaaactcatcatctatgagcctataagaggccctnagggtttctaatcgcttcactgcctccaagtccggcaacacggcctccctgacaatctctgggctcaggctgaggacaggctgattattattgttgctnagtatggttcgtcgcatctactttatgttacttcggaaagtcgggaacctaaaggtccaccgttccgtaggtcagccccaaaggccccaaacccntgcactctcg

SEQ ID NO: 270578 - DNA, 537 bp, Homo sapiens
  misc_feature: GYAE6OF01EZ48Z.44.27.C05.1.454.CMB.1.raw
tcagacagtatatacacgaccggtgctcgatttagacgcgatcgaagggtttggggggtcgacaagaggcagcgctctcgggacgtctccaccatggcctgggctctgctgctcctcactctcctcacccaggacacagggtcctgggcccattctgccctgactcagcctgcctccgtgtctgggtcgcctggacagtcggtcaccatctcctgcactggagccagcggtaatattcttagtcttaactttgtctctggtatcaacatcatccagtaaagccccaaatcatcatctatgagcctataagaggccctcagggtttctaatcgcttcactgcctccaagtccggcaacacggcctccctgacaatctctgggctccaggctggaggacgaggctgatttattattgtgctcagtatgttcgtcgcaattctaactttatgttcttacgggaagtgggaccctaaagggtccaccggttctagggtaccacggcccaaacggccccaaaccctatagtccactcgtccg

SEQ ID NO: 270579 - DNA, 516 bp, Homo sapiens
  misc_feature: GYAE6OF01BOUCJ.44.27.C05.1.454.CMB.1.raw
  modified_base (283)..(283): a, c, t, g, unknown or other
  misc_feature (283)..(283): n is a, c, g, or t
  modified_base (363)..(363): a, c, t, g, unknown or other
  misc_feature (363)..(363): n is a, c, g, or t
  modified_base (489)..(489): a, c, t, g, unknown or other
  misc_feature (489)..(489): n is a, c, g, or t
  modified_base (506)..(506): a, c, t, g, unknown or other
  misc_feature (506)..(506): n is a, c, g, or t
  modified_base (510)..(510): a, c, t, g, unknown or other
  misc_feature (510)..(510): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaancccccaaatcatcatctatgaggcctataagaggccctcgaggggtttctaatcgcttcactgcctcaagtccggcaacncggcctccctgacaatctctgggctccaggctgaggacgaggctgatttattattgttgctcagtattgttcgtcgcatcaactttatgtcttcggaagtgggacctaaggtccaccgtctaggcngcccaaggcccaacccntgcnctctcg

SEQ ID NO: 270580 - DNA, 314 bp, Homo sapiens
  misc_feature: GYAE6OF01CMWVI.44.27.C05.1.454.CMB.1.raw
  modified_base (310)..(314): a, c, t, g, unknown or other
  misc_feature (310)..(314): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctggcccagtctgccctgactcagcctgcctccgtgtctgggtcgcctggacagtcggtcaccatctcctgcactggagccagcggtcagcccaaggccaaccccactgtcactctgttcccgccctcctctatatactgtctgagcgggctggcaaggcgcatagnnnnn

SEQ ID NO: 270581 - DNA, 567 bp, Homo sapiens
  misc_feature: GYAE6OF01CFY0M.44.27.C05.1.454.CMB.1.raw
  modified_base (285)..(285): a, c, t, g, unknown or other
  misc_feature (285)..(285): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaaggtaaacncccccaaatcatcatctatgaggcctaataagcgccctgtagggtttctaatcgcttcactcgcctccaacgtccggacaacaccggccctccctagactaatctacgtgggctccgaggtctaggacggacgaggctgatttatttacttgttgctcagtattgttcgcgctatcctactttatcgttcttacgggaagtcgggaacctaaggtcctaccgtccgtagggtccacggaccccgaaaggccccaaccccgtctagtccacgttccttcccgg

SEQ ID NO: 270582 - DNA, 561 bp, Homo sapiens
  misc_feature: GYAE6OF01C24JF.44.27.C05.1.454.CMB.1.raw
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
tcagacagtatatacacgaccggtgctcgatttagacgcgatcgaagggtttggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtctgggggaggattggcacagcctggggggtccctgagactctcctgtgcagcctctggccttcccctttaggagcctatgccatgacctgggtccgccgaggcctccgaggggaggggctcggagtgggtctcgacaattggcgctagtgcaactgacacataactacgganagtccgtgaacgggccncttcaccatctccagagacaattccggaaacactacttttctaggaaatgaacagacctgagagtacgaagacgacggtccctttattctgtgcgaaggagggggactggacgtcgacgaggtgggtggtgtcgtaacgtcgtgggccgngggngtcccgg

SEQ ID NO: 270583 - DNA, 514 bp, Homo sapiens
  misc_feature: GYAE6OF01AGH7V.44.27.C05.1.454.CMB.1.raw
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (322)..(322): a, c, t, g, unknown or other
  misc_feature (322)..(322): n is a, c, g, or t
  modified_base (507)..(507): a, c, t, g, unknown or other
  misc_feature (507)..(507): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaacgcccccaaatcatcatctatgagcctataagaggccctnagggtttctaatcgcttcactgcctcaagtccgcaacacggcctcctgaccaatctctgggcctccgaggctggaggacgaggctgattattattgtgctcagatgttcgtcgcatcacttatgtcttaggaagtgggaccaaggtccaccgtccaggtcacgcccaaagcccaaacccatgccntcctccg

SEQ ID NO: 270584 - DNA, 318 bp, Homo sapiens
  misc_feature: GYAE6OF01D0XFN.44.27.C05.1.454.CMB.1.raw
  modified_base (313)..(318): a, c, t, g, unknown or other
  misc_feature (313)..(318): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggcccaaccccactgtccactctcgttccccaccctcctctatatactgtctgagcggctggcaaggcgcatgnnnnnn

SEQ ID NO: 270585 - DNA, 578 bp, Homo sapiens
  misc_feature: GYAE6OF01DSESP.44.27.C05.1.454.CMB.1.raw
  modified_base (223)..(223): a, c, t, g, unknown or other
  misc_feature (223)..(223): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaggtaaacgccccaaactcatcatctatgagcctataagngccctnagggtttctaatcgcttcactgcctccaagtccgacaacacggcctcctgacaatctctgggctccaggctgaggacgaggctagatttattattgttgtctcagtattgtttcgtcgctattctactttatcgttcgttacgggaaaggtcgggaacccaaagggttccaacccggttcccgttaagggttcccaacggacccccaaagggacccccaaaccccctacgttcgtaccctaccttcccgttacccgg

SEQ ID NO: 270586 - DNA, 172 bp, Homo sapiens
  misc_feature: GYAE6OF01EJXI3.44.27.C05.1.454.CMB.1.raw
  modified_base (170)..(172): a, c, t, g, unknown or other
  misc_feature (170)..(172): n is a, c, g, or t
tcagacagtatatacacgaccggtgctcgatttagacgcgatcgaagggtttgggtgttcggcggagggaccaagctgaccgtcctgggtcagcccaaggctgccccctcggtcactctgttcccgccctcctctatatactgtctgagcgggctggcaaggcgcatagnnn

SEQ ID NO: 270587 - DNA, 588 bp, Homo sapiens
  misc_feature: GYAE6OF01AND99.44.27.C05.1.454.CMB.1.raw
  modified_base (436)..(436): a, c, t, g, unknown or other
  misc_feature (436)..(436): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcactggagccagcggtaatattcttagtcttaactttgtctcctggtatcaacatcatccaaggtaaacgccccaaactcatcatctatgacgacctaataacgacggccctcgtaggggtttactaagtcgcttcactgcctaccgaacgtccgacaacacgccctcctgaacatctcgtcggcctcgagcgtaggacggacgacgctagatttattnttgttgctcagtatcgtcgtcgctactctactttagtcgttcgttaggtaacggtcggaaccgtacggttccgaacccggttccgtaaggtccaccggaccccgaaacggacccctaaaccccgtacctagtaccctacgttccttaccccg

SEQ ID NO: 270588 - DNA, 170 bp, Homo sapiens
  misc_feature: GYAE6OF01B805B.44.27.C05.1.454.CMB.1.raw
  modified_base (170)..(170): a, c, t, g, unknown or other
  misc_feature (170)..(170): n is a, c, g, or t
tcagacagtatatacacgaccggtgctcgatttagacgcgatcgaagggtttgggtgttcggcggagggaccaagctgaccgtcctgggtcagcccaaggctgccccctcggtcactctgttcccaccctcctctatatactgtctgagcgggctggcaaggcgcatagn

SEQ ID NO: 270589 - DNA, 154 bp, Homo sapiens; identical to SEQ ID NO: 270531
  misc_feature: GYAE6OF01AWT4T.44.27.C05.1.454.CMB.1.raw
  modified_base (154)..(154): a, c, t, g, unknown or other
  misc_feature (154)..(154): n is a, c, g, or t

SEQ ID NO: 270590 - DNA, 528 bp, Homo sapiens
  misc_feature: GYAE6OF01A3WUK.44.27.C05.1.454.CMB.1.raw
  modified_base (224)..(224): a, c, t, g, unknown or other
  misc_feature (224)..(224): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (420)..(420): a, c, t, g, unknown or other
  misc_feature (420)..(420): n is a, c, g, or t
  modified_base (512)..(512): a, c, t, g, unknown or other
  misc_feature (512)..(512): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgctcctggtatcaacatcatccaggtaaacgcccccaaactcatcatctatgaggcctataagagccctgaggggtttctaatcgcttcactcgcctcaagtccgcaacncggcctcccngacatctcgtggctcgaggctgacggacgagctgattattattgttnctcagtattcgttcgtcgcatctacttatgttacttcggaagtcgggacctaggtccaccgttcgtagtcacgaccaacggccctaaccccnctagtcactcttcccg

SEQ ID NO: 270591 - DNA, 312 bp, Homo sapiens
  misc_feature: GYAE6OF01DGHMF.44.27.C05.1.454.CMB.1.raw
  modified_base (250)..(250): a, c, t, g, unknown or other
  misc_feature (250)..(250): n is a, c, g, or t
  modified_base (309)..(312): a, c, t, g, unknown or other
  misc_feature (309)..(312): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccntgtcactctcgtcccaccctcctctatatactgtctgagcggctggcaaggcgcaatgnnnn

SEQ ID NO: 270592 - DNA, 509 bp, Homo sapiens
  misc_feature: GYAE6OF01AUYLT.44.27.C05.1.454.CMB.1.raw
  modified_base (320)..(320): a, c, t, g, unknown or other
  misc_feature (320)..(320): n is a, c, g, or t
  modified_base (502)..(502): a, c, t, g, unknown or other
  misc_feature (502)..(502): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccagtaagcccccaaatcatcatctatgaggcctataagaggccctnaggggtttctaatcgcttcactgcctcaagtccggcaacacggcctccctgacaatctctggctcagctgaggacgagctgattatattgtgctcagtatgttcgtcgcatctacttatgttcgttacggaagtcggacaaggtcaccgtctaggtcacgcccaaggcccaacccactgtcnctctccg

SEQ ID NO: 270593 - DNA, 666 bp, Homo sapiens
  misc_feature: GYAE6OF01CQT27.44.27.C05.1.454.CMB.1.raw
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (492)..(492): a, c, t, g, unknown or other
  misc_feature (492)..(492): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacngtcggcaccatctcctgcacgtgganccagcgtaatnttcttagtcttattgctctgtatcaacatcatccagtaacnccccaatcatcatctangagcctaagtagacgtccctagtagggttctaatcgtacttccactcgccctaccgtaacgtccggacaaccgtccggtaccctccgttacggaacctaacgttccgtacgtcggggtacccttaccgacggtccgtacggaacgggacgtacggtcttaacggtatttaacgttagtttcggtactacgttacgagttntacggtttccgacgactaacgttacctacgtttacgttcggttaccgttacggtaacggttacggaaccgtaaacgggtcctaaaccggttccgtacgggttaccacccggaacccgaaaccggtaccccctaaacccgttacgtgttaaccctaccgtttccgttaacccccg

SEQ ID NO: 270594 - DNA, 570 bp, Homo sapiens
  misc_feature: GYAE6OF01BSRXT.44.27.C05.1.454.CMB.1.raw
  modified_base (190)..(190): a, c, t, g, unknown or other
  misc_feature (190)..(190): n is a, c, g, or t
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacngtcggtcaccatctcctgcactgganccagcggtaatattcttagtcttaacttgtctcctggtatcaacatcatccaggtaaacgccccaaatcatcatctatgaggctataagacggccctgtagggtttctaatcgtcttcactgcctcaagtccgacaacgacggccctcctgacaatctcgtgggctccgaggctggaggacgaggctagtatttattagtttgtgtctcagtattgttcgtcgctatctactttattcgttcttacgggaagttcgggaaccgtaacggtccgtaccgttccgtaggtaccgacgaccccgaacggacccctaaccccgtactacgtcctaaccgtcgtttacccg

SEQ ID NO: 270595 - DNA, 598 bp, Homo sapiens
  misc_feature: GYAE6OF01ASVY2.44.27.C05.1.454.CMB.1.raw
  modified_base (226)..(226): a, c, t, g, unknown or other
  misc_feature (226)..(226): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggcacagggtcctgggcccagtctgccctgactcagcctgcctccgtgtctgggtcacctggacagtcgatcaccatctcctgcattggaaccngcagtgacattggtgttataactatgtctcctggtaccaacaacacccaggacaaacgcccccaaactcatgattcatgatgtcagtaatccggccctcgacggggtccctgaccgtattctcgtggcctaccaagtcgtggccaccgtcacgccctccctcgggcctaactctacgtcgggtcctcccgaggtctggaccgatcggagtctagtatttacgttactgcacgcctaccggagtgggacggcctaacctatcgtagtttcgtcgttttccggggcgggtacgggtacccaggtaccgtcggtaaccccgttccgttacgggtaccgaccggaccccgtaacgggtccctccggtaccccccgg

SEQ ID NO: 270596 - DNA, 614 bp, Homo sapiens
  misc_feature: GYAE6OF01C782R.44.27.C05.1.454.CMB.1.raw
  modified_base (190)..(190): a, c, t, g, unknown or other
  misc_feature (190)..(190): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatcctcctgcacgtggagccagacggtaatattcttagtctttaatttgtctcctggtatcaanatcatccaaggtaaacncccccaaatcatcatctatgagcctaataagacgccctcgtaggggtttactaaagtcgtctttcactcgaccctacccgaaagtcccggacaaaccgaccggccctaccctagaaccaatcctacgtcgggcctaccgagcgtaggaacggacgaggctaggtaatttattaagttgttcgctcgaagtattgttacgtcgtacactcttaccttatcgttacgttacgggaaagtcgggaactaacgggtccaacccggttccgtaggtacaccgaccccgtaacggaccccaaccccacgtacgacctaccgtcttaccccg

SEQ ID NO: 270597 - DNA, 574 bp, Homo sapiens
  misc_feature: GYAE6OF01AMPLI.44.27.C05.1.454.CMB.1.raw
  modified_base (508)..(508): a, c, t, g, unknown or other
  misc_feature (508)..(508): n is a, c, g, or t
tcagacagtatatacacgaccggtgctcgatttagacgcgatcgaagggtttggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtctgggggaggattggcacagcctggggggtccctgagactctcctgtgcagcctctggtccttcccctttaggagctatcgccatgacctgggtccgccaggcctccgaggggaacgggctcggagtgggtctcgacaagttggcgtctagtgcaactgacacatacgtacggagagtccgtagaacgggccgcttcaccatcctcacgagactaacgttaccggaaacacctactttctagtaaatgaacagctgagagtacgaagacgacgtcctttattctgtcgacgaagggngggggactgggacgtccgagtaggtgggtgggtggttacgacgtcggtagggcgtgggcgtcccgg

SEQ ID NO: 270598 - DNA, 516 bp, Homo sapiens
  misc_feature: GYAE6OF01AQRQ5.44.27.C05.1.454.CMB.1.raw
  modified_base (380)..(380): a, c, t, g, unknown or other
  misc_feature (380)..(380): n is a, c, g, or t
  modified_base (420)..(420): a, c, t, g, unknown or other
  misc_feature (420)..(420): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagccccaaactcatcatctatgaggcctataagaggccctcgaggggtttctaatcgcttcactgcctcaagtccgcaacacggcctccctgacatctntcggctccaggctgaggacgaggctgattattattgttcnctcagtattgttcgtcgctactctacttatgttcttcggaagtggaccaggtcaccgtctaggtcacgcccaaggcccaacccnagtcnctctccg

SEQ ID NO: 270599 - DNA, 961 bp, Homo sapiens
  misc_feature: GYAE6OF01AS675.44.27.C05.1.454.CMB.1.raw
  modified_base (228)..(228): a, c, t, g, unknown or other
  misc_feature (228)..(228): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctcgccctgactcagcctgcctccgtgtcgtgggtcgcctggacagtcgtcaccatcctcctgcacgtggacnccgagtacggttaattactttcttagttaccttttaacttttcgttccttaccgttaggttaacttaccaaactactacctaacgttaacccgtaaacggtaaaaccccgacccccctaaaactcctaactacctactacttagtacggaacggtactaaagtaacggacggtacccgttacggtacgggttttacctaacgttccgtacctttacgtaccgtccgtacccttaccgaaccggtccgaaccgtaaccggtacccggtaccctacccgtacgtaaacctaacgttcccgtacgggttaccgggtacccgtaccggtacgggtacggtaacggggaacgggtaaccgggtaacgggtacgtttaaggtttaagtttttaacgttttaggttttcgtttacggttaccgttaacggtttacggttacggttttccgggttaccgttaacccgtacgtttaaccgttaaccgtttaaccggtttttaacgggtttccggttttaaccggggttaaccgggggttaaaaccggggttacccggggttaaacccggttaaccgggtttacccccgttaacccgggtttaccgttaacccggggttaacccccggaaaccccggtaaacccccgggtaaacccccggttaaacccccccgttaaacccccgttaccggttaccccgttaaccccgtttccccggtttacccccggttttccccccccggg

SEQ ID NO: 270600 - DNA, 582 bp, Homo sapiens
  misc_feature: GYAE6OF01EHOHW.44.27.C05.1.454.CMB.1.raw
  modified_base (223)..(223): a, c, t, g, unknown or other
  misc_feature (223)..(223): n is a, c, g, or t
  modified_base (284)..(284): a, c, t, g, unknown or other
  misc_feature (284)..(284): n is a, c, g, or t
  modified_base (366)..(366): a, c, t, g, unknown or other
  misc_feature (366)..(366): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaggtaaacnccccaaatcatcatctatgaggcctagtaagaggccctcgtaggggtttctaatcgcttcactgcctcaagtccggacaacncgcctccctgacatctcgtgggctccgaggctgacgggacgaggtctaggtaatttagtttatttgttgtctgtagtattcgttacgtcgtcattcctaactttagtcgttacgttcgggaaagttcgggaaccgtaacggtcctaccggttcctaagggtccacggaccccgtaaacggccccaaaccccgctaccgtcaaccgttcgtaccccg

SEQ ID NO: 270601 - DNA, 350 bp, Homo sapiens
  misc_feature: GYAE6OF01E4XYX.44.27.C05.1.454.CMB.1.raw
  modified_base (193)..(193): a, c, t, g, unknown or other
  misc_feature (193)..(193): n is a, c, g, or t
  modified_base (227)..(227): a, c, t, g, unknown or other
  misc_feature (227)..(227): n is a, c, g, or t
  modified_base (254)..(254): a, c, t, g, unknown or other
  misc_feature (254)..(254): n is a, c, g, or t
  modified_base (317)..(350): a, c, t, g, unknown or other
  misc_feature (317)..(350): n is a, c, g, or t
tcagacagtatatacacgaccggtgctcgatttagacgcgatcgaagggtttggggggggtcgacgaagaggcagcgctctcgggacgtctccaccatggcctgggctctgctgctcctcactctcctcacccaggacacagggtcctgggcccagtctgccctgactcagcctgccctccgtgtctgggtcncctggacagtcggtcaccatctcctgcactgganccagcggtcagcccaaggccaaccccntgtcactctgttccccaccctcctctatactactgtctgagcgggctggacaaggcgcatagnnnnnnnnnnnnnnnnnnnnnnnnnnnnnnnnnn

SEQ ID NO: 270602 - DNA, 569 bp, Homo sapiens
  misc_feature: GYAE6OF01BW30K.44.27.C05.1.454.CMB.1.raw
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (357)..(357): a, c, t, g, unknown or other
  misc_feature (357)..(357): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaactttgctctggtatcaacntcatccaagtaaacnccccaaatcatcatctatgagctaataagacgcctgagggtttcaatcgtcttcactgcctcaagtccgacaacncgcctcctagactatctacgtggctccgaggcctggaggacgaggctagtatttattagttgttgctcgagtacttgttcgcgactattactacgtttattcgttacgttacggaacggttcgggaaccctaaagggttcccacccggttcgtaggccctacgaccccgaaaggacccctaaacccgtctacgtcctacgttccgttacccg

SEQ ID NO: 270603 - DNA, 654 bp, Homo sapiens
  misc_feature: GYAE6OF01A5FC9.44.27.C05.1.454.CMB.1.raw
tcagacagtatatacacgaccggtgctcgatttagacgcgatcgaagggtttggggggggtcacaagaggcagcgctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggttcgttttgaccgtgtctcctggtaccagcacgaccccaagaaaccacgcccccaaactcattattatgcgtcaatcgttccgtcccttccggtctccctgagccgtctttctcgtcgggtcctaagtctgggccaaccgaccggtccctcctgtacccgtctcgtcgggcctccgaggtctggaggatggacggtctgtacttatttcgtcgtccttccctacgtattactcggccgagggtccgtaacgttaaggtttttacgtcgttccgtttaccgggtaacgtacgggaacctaacgggtcctacccgttaccgtacgtaccgaccggaccccgaaccggtacccccaaaccccgtacttccgtaccctacccgttccgttccccggtttccccccgcccctttacccg

SEQ ID NO: 270604 - DNA, 539 bp, Homo sapiens
  misc_feature: GYAE6OF01DZYUV.44.27.C05.1.454.CMB.1.raw
  modified_base (361)..(361): a, c, t, g, unknown or other
  misc_feature (361)..(361): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcagtcaccatctcctgcactggaaccaacagtgacgtcggtcgttttgaccgtgtctcctggtaccagcagaccccagaaacacgcccccaaatcatttattatgcgtcaatgttcgccttcggtgtccctgagcgcttctctggtccaagtctggcaacncggcctcctgaccatctcgtgggcctccgaggctggaggacgaggctgattattactgcagctcatataacaagtgggaactactttactagtcgcgcgacgggaccaagctacgaccgtcgtaggtccacggcccaaggcctcgcccccgtcgtccactccgtcgttccccgtcccc

SEQ ID NO: 270605 - DNA, 879 bp, Homo sapiens
  misc_feature: GYAE6OF01BGL2Z.44.27.C05.1.454.CMB.1.raw
  modified_base (190)..(190): a, c, t, g, unknown or other
  misc_feature (190)..(190): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtcgtgggtcnccgtggacagtcggtcaccatctcctgcacgtggacgccaggtcggtaatattcttagttctttaactttgtcctccgttggtactctaacatcataccaacggtaaacaccccaaactcaatctatctagtacgaggtacctaagtaacggacggtaccctacggtacggggttttacctaaacgtccgtacttaccgtaaccgttccgtacccgtacccggtaaaccggttacccggaacccgaaaccggtaacccggtccccttaccccgtacgaaacccttaacgttcccgttccggttacgggtacccgttacccggtaagggtaccgttacgggaaccgggtaaccgggtaacgggtaccgttaaggttaaatttttacgttttaacgtttcggtttacgtcgttaaccgtaggtttaacgtttcgggttttaccgtaccgtacgtttaaccttacccggtttaacttttaacggtttaccgggttttccggttaaccggggttaaacggggttacccggggtaaaacccggttaaacggggttaccccgttaccccgggtaaccggtttaaccgggtacccggtaaaccccggtaaaccccgggaaacccggtaaccccccgtaaaacccccgttacgttacccggttacccctacccggtttccccggtttacccccccgg

SEQ ID NO: 270606 - DNA, 587 bp, Homo sapiens
  misc_feature: GYAE6OF01BCPY5.44.27.C05.1.454.CMB.1.raw
  modified_base (366)..(366): a, c, t, g, unknown or other
  misc_feature (366)..(366): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgctcctggtatcaacatcatccagtaaagcccccaaatcatcatctatgagcctataagagccctgagggtttctaatcgcttcactgcctcaagtccgcaacacggcctccngacatctctggctcaggctgaggacgaggctgtattattatttcgtgtctcgagtacgttgtttcgtcgtcactctactttactgttccgttacgggaaggttcggggaacccgaaagggttcccgtaacccggtccgtttaacgggttaccaccggtacccccgaaacgggaccccctaaacccccaccgttaggtaccctaaccttcccgttaccccgg

SEQ ID NO: 270607 - DNA, 594 bp, Homo sapiens
  misc_feature: GYAE6OF01BVPCK.44.27.C05.1.454.CMB.1.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (283)..(283): a, c, t, g, unknown or other
  misc_feature (283)..(283): n is a, c, g, or t
  modified_base (579)..(579): a, c, t, g, unknown or other
  misc_feature (579)..(579): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtcgtgggtcncctggacagtcggtcaccatctccngcactggancagtcgtaatattcttagtcttaatttgtctctggtatcaacatcatccaaggtaaacnccccaaactcatcatctatgagctaataagcgcctcgagggtttcaatcgtcttcactcgcctacaacgtccgacaacacgcccttccagaacatcgtgtacggctccgaggctaggacggacgtaggctagtaacttaatttatttgttcgactcgtaagtagttcgtttcggtactactacgttactaacctttaagttcgttacgttacggaaaggtacggtaaccgaaaggttcccgaaccgttccgtaggtaccgacgacccgaaacggtccccaaaccccactagtaccncttccgttaccccgg

SEQ ID NO: 270608 - DNA, 605 bp, Homo sapiens
  misc_feature: GYAE6OF01BECEV.44.27.C05.1.454.CMB.1.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (359)..(359): a, c, t, g, unknown or other
  misc_feature (359)..(359): n is a, c, g, or t
  modified_base (419)..(419): a, c, t, g, unknown or other
  misc_feature (419)..(419): n is a, c, g, or t
  modified_base (456)..(456): a, c, t, g, unknown or other
  misc_feature (456)..(456): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaacttgtctcctggtatcaanatcatccagtaaacnccccaaatcatcatctatgagcctataagacgcctgagggtttctaatcgcttcactgcctacaagtccgacaacncggcctcctgacatctctcgggctccaggctaggaggacgaggctgatttattattgttnctcagtattcggttcgtcgctaacgtctaacgttttntgttccgttacgggaaaggttcgggtaaaccctaagggttaccctaacccgggttcccgttaagggtaccccaaacggtacccccaaaacgggtacccccctaaaccccccgtaacgttcggtacccctaaccgttcccgttacccccg

SEQ ID NO: 270609 - DNA, 641 bp, Homo sapiens
  misc_feature: GYAE6OF01B9KR7.44.27.C05.1.454.CMB.1.raw
  modified_base (281)..(281): a, c, t, g, unknown or other
  misc_feature (281)..(281): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcacgtggagccagcggtaatattcttagtcttaatttgctctgtatcaacatcatccaaggtaacncccccaaactcatcatctatgagcctaataagacgcctgagggtttcaatcgtcttcactcgcctaccgaagtcccggacaaaccgcgccctaccctgaacaatcgtcgtcgggctcgaggctggaaggacgaggtcttacggtaatttacgtttagtttgtacgtctacgaagttagttcggttccgttacgaccttagttaccttaacgtttagttcggttacgttaccgggtaaaggtccgggtaaccgtaacggttacccgtaacccggttccgtaacggggtaccctaccggaccccgtaaacgggacccccctaaaccccgtacgttaccgtacctccgtttacccgttccccg

SEQ ID NO: 270610 - DNA, 647 bp, Homo sapiens
  misc_feature: GYAE6OF01EM5KN.44.27.C05.1.454.CMB.1.raw
  modified_base (342)..(342): a, c, t, g, unknown or other
  misc_feature (342)..(342): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattctagtcttaacttgtctctgtatcaacatcatcaggtaaacgcccccaaatcatcatctatgaggcctagtaagacgcctgtagggtttctaatcgcttcactncctcaagtccgacaacacggccctaccctgactaactctcgtcgggcctccgaggctggacggacgacggctagtatttaattagtttggtcgtcctacgtagtagttcgttccgtcgctactacgttaaccgtttattacggttccggttaacgggtaacggttaccggggaaacccgttaaaccgggttccctaaccccgggtttacgttaacgggtacccgtaaacccgacccccggaaacgggaaccccccgtaaaccccctaacgttacccgtaccctaaccgttcccgttacccccggg

SEQ ID NO: 270611 - DNA, 511 bp, Homo sapiens
  misc_feature: GYAE6OF01A4526.44.27.C05.1.454.CMB.1.raw
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaagcccccaaactcatcatctatgaggcctataagaggccctnagggtttctaatcgcttcactgcctccaagtccgcaacncgcctcctgacaatctctggctcgagctgagacgaggctgtattattattgttgctcagtatgttcgtcgcagtctacttatgtcttcggaagtcggactaggtcaccgtctaggcagcccgaagcccaacccactcgcactcgtaccg

SEQ ID NO: 270612 - DNA, 318 bp, Homo sapiens
  misc_feature: GYAE6OF01EQED0.44.27.C05.1.454.CMB.1.raw
  modified_base (311)..(318): a, c, t, g, unknown or other
  misc_feature (311)..(318): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccactgtcactctgttcccaccctcctctatatactgtctgagcgggctggcaaggcgcatagnnnnnnnn

SEQ ID NO: 270613 - DNA, 325 bp, Homo sapiens
  misc_feature: GYAE6OF01BE9SU.44.27.C05.1.454.CMB.1.raw
  modified_base (189)..(189): a, c, t, g, unknown or other
  misc_feature (189)..(189): n is a, c, g, or t
  modified_base (224)..(224): a, c, t, g, unknown or other
  misc_feature (224)..(224): n is a, c, g, or t
  modified_base (317)..(325): a, c, t, g, unknown or other
  misc_feature (317)..(325): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcggtcaccatcctcctgcactgganccagcggtcacgcccaaggctcgcccctggtcactctgttccccgccctcctctatatactgtctgagcggggctgggacaaggcgacatagnnnnnnnnn

SEQ ID NO: 270614 - DNA, 646 bp, Homo sapiens
  misc_feature: GYAE6OF01D4V2A.44.27.C05.1.454.CMB.1.raw
  modified_base (224)..(224): a, c, t, g, unknown or other
  misc_feature (224)..(224): n is a, c, g, or t
  modified_base (473)..(473): a, c, t, g, unknown or other
  misc_feature (473)..(473): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcgttagtcttaactttgtctcctggtatcaacatcatccaaggtaaacgaccccaaactcactcatctatgaggactataagacgtcctacgtagggtttctaatcgtcttcactcgtcctaccgaacgtccggactaaaccgccggtccctccctagacctaatcctacgtcgggtcctcccgagggtcgtggaacgggacgacggacttagtatttaagtttatttggtttcncgttactagtacttggttcgtcgtactactccttactttagttcttccggttacggtaaggttacgggaacccgtaaggttcccgtaacccggttcccgtagggtaccaccggaaccccgaaccgtaccccgtaacccctaacgtaccgttacctaccgttccgttcccccgg

SEQ ID NO: 270615 - DNA, 328 bp, Homo sapiens
  misc_feature: GYAE6OF01DRYZ8.44.27.C05.1.454.CMB.1.raw
  modified_base (316)..(328): a, c, t, g, unknown or other
  misc_feature (316)..(328): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagccccaaaggcccaaccccatgtccactctcgttcccaccctcctctatatactgtctgagcgggctggcaaggcgcatagnnnnnnnnnnnnn

SEQ ID NO: 270616 - DNA, 813 bp, Homo sapiens
  misc_feature: GYAE6OF01AXF0V.44.27.C05.1.454.CMB.1.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcgtaatattctagtcttaacttgtctcctgtatcaacntcatccaggtaaacncccccaaatcatcatctatcgaggtcctaagtaacggacgtccctaggtaacggggttttccaagtccgtccttacgaccttcggccccttaccgaaacggtcccggacctaaaccgtacccggtccccttaccccgtagtaacccttaaacgtcccgttaccgtcgggggtacccttacccgaacggggttccgtaacgggtaacggggaaccccggtagggtacccgttaggtaaagtttttaacgttttacggttttacgggttttaccgtaccgtttccggtaaagggtttaaccgtttcgggttttacccggtacccggtaaccttaacgtttcccgtaaacccgttttttacgttccgggttaccgtttaaccgggggaaacggttaccgggggaccccttaaaaacgggttcccgtaaaccccggtttccgtaacgggttaccgaacccgggtaacccccggaaaacgggcccccctaaaccccggtactttacggacccttacccgtttcccgttacccccggg

SEQ ID NO: 270617 - DNA, 1048 bp, Homo sapiens
  misc_feature: GYAE6OF01D9KL2.44.27.C05.1.454.CMB.1.raw
tcagacagtatatacacgaccggtgctcgatttagacgcgatcgaagggtttggggagctctgagagaggacgcccacgcccgtgggtattttcgtaggttgttttctagtttggtgtactcgaggtactagaaacgaagaagaacgtaacctaccaaccgtaggttagggttagggtttcgggtcgttagggtacgggtttcggttttcttttttcgttggttacgttaaacgttttaaaggttttaaaacggtcgttaccgtaggttggtaggtacgggttccggtccgttgggttcgggtacgggttcggggtagggggtaaggtacggttacggaccgtaaccggtaccggggtcccggggttccggggggtacccgtacggtaaccgttacccgttcccgttccggttcggtccggtaccgtaccgttcccgttccggttcccggtttaccccgttttacccgggtttaacggtaccgttaccgttacgtaccggtaccgttacggttacccggttacccgggttcccgggtaccccggtaccggtaccgggtacccggtaaccggggaacgggggtaccgggtcggtacgggtacggttcggtaccgtacgtaacgtacggtcggacgtacgtacgtacgaaccgtacgtacgaaccgtaacgtaacgtaacggtaacggtacggtaccggtaccgggtaacggtaccggtcccgttaccgtaccgtaaccgtcgtacccgaacgtaacgtaaccgtaaaccgttaacccgttaaccgtaactttaaccgtttaacgtttaacggaaacgtaaacgtaccgtaacgtacgtacgtaaggtaaccgtaacggtaaccgtaaccgttacccggttaccgttttaccgtttaggtccgggtaaggtaccggggaacggggtaacggggggtaccgggtacgtacggtaccggtacgggttagggtacgggggtttcggggttacggttaccggttaaccggtccgggtacggggacggggaccggtaccgggtcccggtacccgg

SEQ ID NO: 270618 - DNA, 793 bp, Homo sapiens
  misc_feature: GYAE6OF01B0DVH.44.27.C05.1.454.CMB.1.raw
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (284)..(284): a, c, t, g, unknown or other
  misc_feature (284)..(284): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcacgtgganccagcggtaatattcttagtcttaacttgtctcctggtatcaacatcatccaagtaacnccccaaactcatcatctatgacgtcctaagtaagacggtcccttacgtacggggttttactaagttccggtactttaccgacttcgtccctaccgaacggttcccggaccaaccgtaccggtaccctccccgtacgtaacctaaacgtccttcggtcgggtacctacccggtacggtacgttgggaacgggaccggaacggtccgttagtaacttttaagttttaagttttggttacgtacccgttacgtaacggttaagtttcggtttaccggttccggtaccttaacgtttccgttaaaccgttttagtttaccggtttaccggtttaacggggtaaacgggttaccggggtaaacccgtaaaccgggttacccggtaaccccgggtttcccggttaacggggttaccctaacccgggtacccccgaaaacccgggtaccccctaaaacccccccgttacggtttaacccgttacccgttaacccgttcccggttttaaaccccccg

SEQ ID NO: 270619 - DNA, 326 bp, Homo sapiens
  misc_feature: GYAE6OF01CAQKO.44.27.C05.1.454.CMB.1.raw
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (318)..(326): a, c, t, g, unknown or other
  misc_feature (318)..(326): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtcacgcccaaggcccaacccntgtccactctgttaccccgcccttcctctatactactgtctgacgcgggctggcaaggcgcatagnnnnnnnnn

SEQ ID NO: 270620 - DNA, 618 bp, Homo sapiens
  misc_feature: GYAE6OF01CMUXM.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcactggagccagcggtaatattcttagtcttaactttgtctctgtatcaacatcatccaagtaaacgcccccaaatcatcatctatgagcctagtaagacgccctagtagggtttctaatcgcttcactgcctccaagtccgcaacgacgcctccctgacaatctcgtcggcctccgaggctggaacggacgaggctagtatttattattgttgctcgaagtgttgttcgtcgactagttcctactttagttcgttcgtttacggaaggttcggggaaccctaaacgggtcctaacccggttccgttaagggtacccaaccgggacccccgaaaacccgggtacccccctaaaacccccgtcgtttaccgtaaccccttaacccgttcccgtttacccccg

SEQ ID NO: 270621 - DNA, 704 bp, Homo sapiens
  misc_feature: GYAE6OF01DUCIB.44.27.C05.1.454.CMB.1.raw
  modified_base (190)..(190): a, c, t, g, unknown or other
  misc_feature (190)..(190): n is a, c, g, or t
tcagacagtatatacacgaccggtgctcgatttagacgcgatcgaatggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatcttctgttcttccagcgacaacttccactcggtacctttaaagtctctatcagtggtacgcagtcggtcccgggccgacgacccccaaagtcctcttttacgacgttcctttcgccggtcgttcggctacgtcccgtggtccgtttttcggccttcctagttctacgaccaccgccggtccctccctcgacccataccaacccaaaccgtcccggccttgacggtatcggaggtctacgtaccgtttaacgttttcggttagtcgtactaatttacgtttctacgtttctaaccttaactaaattagttacgttcggttaccgggtaagggttaccggggaccccgtacggtccgaaggtccgttccttcggtccgtaccggaaccgaccccggaaaccggtcccccgaaacccccgtacgttccgttaccctaccttcccgttcccgttccccccggttcccttacccttccttaacttacttcccgttacgg

SEQ ID NO: 270622 - DNA, 322 bp, Homo sapiens
  misc_feature: GYAE6OF01AKEUQ.44.27.C05.1.454.CMB.1.raw
  modified_base (189)..(189): a, c, t, g, unknown or other
  misc_feature (189)..(189): n is a, c, g, or t
  modified_base (224)..(224): a, c, t, g, unknown or other
  misc_feature (224)..(224): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (313)..(322): a, c, t, g, unknown or other
  misc_feature (313)..(322): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacaggtcggtcaccatctcctgcactgganccagcgtcacgcccaaggcccaacccatgcactctcgttccccaccctctctatatacctgtctgacgcgggctggcaaggcgnaangnnnnnnnnnn

SEQ ID NO: 270623 - DNA, 667 bp, Homo sapiens
  misc_feature: GYAE6OF01BOQ8Q.44.27.C05.1.454.CMB.1.raw
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
  modified_base (375)..(375): a, c, t, g, unknown or other
  misc_feature (375)..(375): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcactggacnccagcggtaatattcttagtcttaacttgtctcctgtatcaacatcatccaaggtaaacgcccccaaatcatcatctatgacggtcctataaggcgcctcgtagggtttactaagtcgtcttcactcgcctaccgaacgtcccgacaaccnccggtccctccctgaacacttctacgtcgggcctccgaggtcgtggaacgggacgacggtactgtaattttatttatttggttacgtcgtactaaggttcttcggttcgtccgtctacttaccttaacgtttagtcggtttaccgtacgggtaaacgggttccgggtaacccgtaacgggtccccgtaacccggttaccggttaacggtccggaacccgtaccccgggaacccggtaaccccctaaacccccgtacgttaccgtaccccgtacccttcccgtttacccccgg

SEQ ID NO: 270624 - DNA, 155 bp, Homo sapiens; identical to SEQ ID NO: 270536
  misc_feature: GYAE6OF01BYVBC.44.27.C05.1.454.CMB.1.raw
  modified_base (154)..(155): a, c, t, g, unknown or other
  misc_feature (154)..(155): n is a, c, g, or t

SEQ ID NO: 270625 - DNA, 642 bp, Homo sapiens
  misc_feature: GYAE6OF01DNKQ9.44.27.C05.1.454.CMB.1.raw
  modified_base (230)..(230): a, c, t, g, unknown or other
  misc_feature (230)..(230): n is a, c, g, or t
  modified_base (412)..(412): a, c, t, g, unknown or other
  misc_feature (412)..(412): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctcgccctgactcagcctgcctccgtgtcgtgggtccgcctggacagtcggtcaccatcctcctgcacgtggacnccagacgtaattacttcttagtctttaactttgtcttcctggtactcaactatcatccaacggtaaaccgacccccaaatccatctactctatgacggactaagtaaggacggtccctgtaacgggtttcaagtccgtcttcactcgaccctacaacgtccgacaaccgaccgtccctaccngacctactctcgtcggcctccgaggcgtggacggacgagtcttagtaactttattagtttcggttgtccgttacgtagtacgtttcgtttcgtcgtactacgttacttacgtttagttccggttcgttacgggtaggttacggaccgtacggtccgtaccgttacgtacgtacgtacccgacccgaacgaccccctaaccctacgtacgtacctccgttccgttcccccg

SEQ ID NO: 270626 - DNA, 579 bp, Homo sapiens
  misc_feature: GYAE6OF01BS7DM.44.27.C05.1.454.CMB.1.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (557)..(557): a, c, t, g, unknown or other
  misc_feature (557)..(557): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaattgtctctggtatcaacatcatccaggtaaacgcccccaaactcatcatctatgagcctataagagccctcgtagggtttctaagtcgtcttcactcgcctaccgaagtcccggacaaccgacggtccctcccctagaacaactcgtcgtcggcctcccgaggtctaggagggacgaggtctgtatttatttagttcgttgtctcgagtattcgttcgtcgtctatctactttattcgttcgttacggtaggtcgggacctaaggtcctaccgtcgtaggcctacgacccctaaggacccctaacccnctacgtcctccgttcgtacccg

SEQ ID NO: 270627 - DNA, 676 bp, Homo sapiens
  misc_feature: GYAE6OF01B0PF7.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtctttaactttgtctcctggtatcaacatcatcaagtaacgaccccaaactcatcatctatgaggcctaataagacggtccctactaggggtttactaagtcgcttccactcgccttaccaacgtcccggacaaaccgaccggtccctaccctagaacctaactctaccgtcgggctccgaggctggacggacggaggcctaggtaatttatttagttagttgtctacgtagtattcggttacgtcggacctacttctaacgtttagttacgtttacccggttacggtaaacgggttacgggaaacccgtaaagggttacccggtaaccccggttaccggttaacgggttccgaaccggacccccgaaaccggggtaacccccaaaccccccgttacgtaccggttaccctaaccgttcccgtttaacccccg

SEQ ID NO: 270628 - DNA, 695 bp, Homo sapiens
  misc_feature: GYAE6OF01ER4CA.44.27.C05.1.454.CMB.1.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (276)..(276): a, c, t, g, unknown or other
  misc_feature (276)..(276): n is a, c, g, or t
  modified_base (310)..(310): a, c, t, g, unknown or other
  misc_feature (310)..(310): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacngtcggtcaccatcctcctgcactggagccagacggtaatnttcttagtactttaacttgtcttctggtactcaactntcactcaacggaacacccccaaatcatcatctangacgactaagaaggacgcctacggtacgggtttactaacgtcgtcttcactcgtcctacgacgtcccgacaaccgaccgcctacccgtagaacctacgtcgtcgtcgggacctaccgaggtcgtacggaagggaccggtaggtaccgttagtaacttttagtttagtttggtccgtacgttagtaacgttcgttacggttccgtacgttactaccgttaccttacgttttacgtacgtttacccggttaaggggtaaaccggtacgggtaaacccggtaacggttaccgtaacccggttacccgtacggtaccgaacccggaaccccgtaacggtaccccccaacccgttactaccggtaacccttcgtcccctttaacccccgg

SEQ ID NO: 270629 - DNA, 633 bp, Homo sapiens
  misc_feature: GYAE6OF01ANO2Z.44.27.C05.1.454.CMB.1.raw
  modified_base (224)..(224): a, c, t, g, unknown or other
  misc_feature (224)..(224): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatattctagtcttaactttgtctctgtactacaacatcatccaaggtaaacaccccaaactcatcatctatgagctataagacgcctcgtagggtttctaagtcgtcttcactcgcctccaacgtccggacaaccgaccggccctcctcgaacaactctctcgggcctccgaggctaggacggacgaggtctagtaattattagtttgttcgtctacgtagtacttggttcgtcgtactacgttcctacgttacttcggttcgttacgggaacggttacgggaaccgtaaccgggttaccgtacccggttaccggttacggtccgtaaccggaccccgtaaacccgggacccctaaaccccccgtattacccggtacccttaccgtcccgtttacccccgg

SEQ ID NO: 270630 - DNA, 695 bp, Homo sapiens
  misc_feature: GYAE6OF01CFI6V.44.27.C05.1.454.CMB.1.raw
  modified_base (329)..(329): a, c, t, g, unknown or other
  misc_feature (329)..(329): n is a, c, g, or t
tcagacagtatatacacgaccggtgctcgatttagacgcgatcgaagggtttggggggggtcacaagaggcagcgctctcaggacgtcaccaccatggcctgggctctgctcctcctcaccctcctcactcagggcacgagggtcctgggcccagtctgccctgactcagccctccctccgcgtccggtctcttggacagtcagtcaccatctcctgccacgtggccaccagcagtgactagttggtaggtttattaactttgtcctccgtaggtaacccaacacccaccgaacggacaaaccgaccccctaaattcaatactatttanagatgtacagtaacgccggacctcgacgggtcctagactcgtcctttctcgtacgtctaccgtaagttccgtaggaacctaaccggtcccggtcccttcccgtacggtacccgttcgtccggtcggggtaccctaccggtaggtcctaagggagggtactaggtacggtaccttaaggtaccttttacttcgtccgtaccttcctagtactagtcgacgagtccgtaagtttaggtttatcgttacgttacggaacggtccggaacctacggtaccctacccgttacgtaaccgccggtacccgacccgtaaaccgaccccctaaaccccgttacttacgttaccgtaccctttcccggtaacccc

SEQ ID NO: 270631 - DNA, 665 bp, Homo sapiens
  misc_feature: GYAE6OF01BOAD5.44.27.C05.1.454.CMB.1.raw
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcacctggacagtcgatcaccatctcctgcagttcggaaccagcagtgactagttggtgttataactatgtctcctagtaccaacaacaccaggcaaacgccccaaactcatgattcatgatgtacagtaactccggcctgtacgggtttctggtcgtcttctcgtgtctccgtaagtctggaccaacgccgtcctccctagacctacgttctcgtcggtcctaccgacgggtcgtacggacgggtacgacggtcgtagtaacgttactttaccgtcgactcgtacctactaaagtaaacgtaaaacgtaacgaacctaaacgtaccctttagtttaacgtaacggtttccgggaacggtaccgggtaaaccgtaagggtacccgtttacggaaccccggttccggttaaccgggtaccctaaaccgggaccccggtaacggtaccccggttcccggtccccccgttacggttaccccg

SEQ ID NO: 270632 - DNA, 690 bp, Homo sapiens
  misc_feature: GYAE6OF01AMJ4W.44.27.C05.1.454.CMB.1.raw
  modified_base (521)..(521): a, c, t, g, unknown or other
  misc_feature (521)..(521): n is a, c, g, or t
  modified_base (565)..(565): a, c, t, g, unknown or other
  misc_feature (565)..(565): n is a, c, g, or t
  modified_base (669)..(669): a, c, t, g, unknown or other
  misc_feature (669)..(669): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctccctcaccgagacacgcggtccgtcggccagtctcgcctgtactcgacgtccctcccgtccgtcggtccggtctcgtcggtctacgtcgacgtccactactcctcctcgacctaccgtacggaaccgacggtacgttaattacttacgttacttacctttaactttcgtccttccgttagtactaccgaactactactactaccggtaacggtaacccgaacccctaaactctactactactactagtcggacgtacctaagtaacggaccggtcctacggttcgggttactacgtcgtcttacactcgacctacgacgtccgacaacgccgtccctacgtacgtactacgtcctacggtcggccctaccggacgtccgtagggacggacggtacgtntacgttatttattaggttgtctgtactgtagttcggttcgactnactcttaacgtgttcgtacggttaacggtaggtaccggaacgtacgtcctaccggtacgtacggtccacggtacccacggaccccctaaaccgtgtacctaccncttacccgtccgtccccctcc

SEQ ID NO: 270633 - DNA, 685 bp, Homo sapiens
  misc_feature: GYAE6OF01CLFHM.44.27.C05.1.454.CMB.1.raw
  modified_base (194)..(194): a, c, t, g, unknown or other
  misc_feature (194)..(194): n is a, c, g, or t
tcagacagtatatacacgaccggtgctcgatttagacgcgatcgaagggtttggggggggtcacaagaggcagcgctcgtcgggacgtctccaccatggcctgggctctgctgctcctcactctcctcacccaggacacgagggtcctgggcccagtctcgccctgactcagcctgcctccgtgtcgtgggtcnccgtggacagttcggcacatcctcctgcacgtggacaccgaggtacgttaatatttcttagtctttaactttgtcctccgttagtactacaactatacactaccgtaacggtaaaccaccccctaaaactcaacttaccatactagtagacgtacctaagtaacgtacggtacccgtacgtaacgggtttactaaaggttccgtactttccaacgttcgacctaccgtaacggtcccggaacaaccggtaccggtcccttacccgacgtaacctctccgtacggtcggcctacgacggcgagacggacggtacggtactacgtacttactactagcacgtactacgtaaattaaagaaaacgtaacgaacctaacgtaaccgttagttaacgtaacggttacgggacggtaacggaacgtaacgcgtacgtaccgtacgtagaccacggacccgagccgtcccgtacccgacgtctccgttccgttccccg

SEQ ID NO: 270634 - DNA, 734 bp, Homo sapiens
  misc_feature: GYAE6OF01B7FMM.44.27.C05.1.454.CMB.1.raw
  modified_base (253)..(253): a, c, t, g, unknown or other
  misc_feature (253)..(253): n is a, c, g, or t
tcagacagtatatacacgaccggtgctcgatttagacgcgatcgaagggtttggggggggtcacaagaggcagcgctctcgggacgtctccaccatggcctgggctctgctattcctcaccctcctcactcagggcacagggtcctgggcccagtctgccctgactcagcctgcctcgtgtctgggtcacctggacagtcgatcaccatctcctgcattggaaccagcagtgactattgggtagttataactntgtctcctggtaccaacaacacccaggcaaacgccccaaatcatgattcatgatgtcagtaactcggccctcgtaggggtttctggtccgtctttcgtcgtcggtcctaccgaagttccgtacggacctaaccgaccgggtccccttacccgtcggaaccctacgttccttcggtcgggtccctaccgagggtccgtcgggaacgggacggacggtacgttacggtaaccttacgtttaaccgtgaccgtacgtaccttactaaacgttaaagtaaaaacggaacggtacctaaaccgttaacgtttacggtttaacgttaacggtttaccgggacgggtaaacgggacccgtaaacggttccggtaaccgggtaaccccggttaccggttaacgggtacccgtaacccgggtacccccgtaaacggggttccccgttaaccccgggtcccccccggttccgggttaacccgttaccccgg

SEQ ID NO: 270635 - DNA, 721 bp, Homo sapiens
  misc_feature: GYAE6OF01C3O2Q.44.27.C05.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacgagggtcctgggcccagtctcgccctgactcagcctgcctccgtgtcgtgggtcgcctggacngtcgtcacntctcctgcacgtggacgcagcgtaatnttcttagtcttattgtctctgtactcatatcactacgaacggtaacacccctaatcatacatactatcggacgaccttaagtaacggacgtccgtacggttacgggtttactaacgtccgtactttcgaacgttcgaccctaccgtaacggtaccgaccaaaccggacccggtcccttacccgtagaaaccttaaccgttccgttacgggttccggtacccgtaccgggtacggtccggtaagggaaccggggtaaccggtaacgggtacgttaacggttaacttttagtttaacgtttcggttcgttacttaccgtaggttacgttacggttcgtacgtacctacgttacgttacgtttagttcgttacggttacgggtacggtacgggtaaccgtaaccggtcccgtaaccggttaccgtggtaaccctacggtaccccgaacgtaccctacccgtattaccgtcctaccgtccgttaccccg

SEQ ID NO: 270636 - DNA, 762 bp, Homo sapiens
  misc_feature: GYAE6OF01D4XAW.44.27.C05.1.454.CMB.1.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacgagggtcctgggcccagtctgccctgactcagcctgcctcgtgtcgtggtcnctggacngtcgtcacatcnctgcatggacnccagcgtaatnttcttagtcttaactttgtctctggtatcaactatcactaccgaagtaaccgaccccaactcatcatactatgacgtacctagtaacgacgtcccgtagtacgggtttactaagtccgtacttctacgtcgtaccctaccgaacggttcccgactaaccgccgtacccttacccgtacgaaactacgttcgtcggtcgggtacctaccggtacggtcgtaggaacgggtacggtacggtacgttagttaactttagtttacgtttaggtacgttaccgtaccgtaagttacgtttaccgggttaccgtaccgtaccgtaacgtttaccttaaccgtttagttacgggttttaccgtaacgggggttaaccggttaaccggggtaaacccggttaacggtaccccgggttaaccccggttaccgtaacggggttaacccgaaccccgggaacccccggtaaccggaacccccccttaaaccgacccgtttaaccggttacccctaacccgtttcccggtttaaccccccggg

SEQ ID NO: 270637 - DNA, 562 bp, Homo sapiens
  misc_feature: GYAE6OF01E0DS4.44.27.C05.1.454.CMB.1.raw
  modified_base (226)..(226): a, c, t, g, unknown or other
  misc_feature (226)..(226): n is a, c, g, or t
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
  modified_base (427)..(427): a, c, t, g, unknown or other
  misc_feature (427)..(427): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcactgganccagcggtaattattcttagttctttaacttgtcctcctggtatcaacatcatccacggtaaacgaccccccaaatccatcattctatgacggcctaagaagacggccctcggtagggtttactaagtcgtcttcactcgcctccacgtccgcaacgaccgcctccgngacatctcgtcggcctcgngcgtggacggacgngctgtattattagttgttnctcagtntgtcgtcnctactctatttatcgttaccgtggtaacgtcgggactacggtccaccggtctaggcacgcccgaacgaccccaacccgtctacgtcctacctcgtaccccg

SEQ ID NO: 270638 - DNA, 909 bp, Homo sapiens
  misc_feature: GYAE6OF01C1PD7.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcgccgtggacagtcggtcaccatctcctgccacgtggacgccgaggaccggttaattactttcgtttagttacttttaacgttttcgtccttcccgttggttaactaccaaactactacctaactaccgaaacgggttaaaaccccgaccccccctaaaactcctaactaccaacttactaacgtcgtaacggtacccgttaaagtaaacggaccggtccccttacggtaacggggttttactaaccgttcgtcctttacctaccgttccgtaccccttaacccggtaaccggttacccggaacccgtaaacccgacccggggttcccccttacccccgttacggaaaccctaacgtttcccgtccgggttaccggggtcccgttacccggtacggggtacccgttaacgggaaccgggggtaaccgggttacgggtacgtttaaacggttacgttttaaatttttacgtttacgggtttctacgttaccgtaaggttacgtttccgggtttaccggttaccgtacgttaactttaccgttaaccgttttagtacggttttaccggttacgggggttaaaccgggttacgggtaaacccggttaccgggttaccccgtaacccgggttaccgtaacccgggttaccgaccgtaaccccggaaacccggtccccaaaccccgtacttaccgttacccgtacctttccccggttacccccgg

SEQ ID NO: 270639 - DNA, 643 bp, Homo sapiens
  misc_feature: GYAE6OF01CVDQS.44.27.C05.1.454.CMB.1.raw
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (453)..(453): a, c, t, g, unknown or other
  misc_feature (453)..(453): n is a, c, g, or t
  modified_base (473)..(473): a, c, t, g, unknown or other
  misc_feature (473)..(473): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggacnccagcgtaatattcttagtcttaactttgctcctggtatcaactatcatccaaggtaaacaccccctaaactcactacacttctaagtgacggtacctaagtaaaggacggaccccttgtaacggggtttcctaagttcgtcttcactcgcctaccgaacgtccggactaaccgacggtcccctacctagaacctaactctcgtcggcctccgaggctaggagacggngctagtactttatattgttncttgagtattcgttacgtcgactagttacctatttacttgttaccgttgggaaacgttcgggaacccgtaaggtcccgtaccgttaccgtaggtaccgtaaccggaccccgtaaaaccggacccctaaacccccgtacgttacgttaccctaacgttcccgttaaccccg

SEQ ID NO: 270640 - DNA, 409 bp, Homo sapiens
  misc_feature: GYAE6OF01A7504.44.27.C05.1.454.CMB.1.raw
  modified_base (383)..(409): a, c, t, g, unknown or other
  misc_feature (383)..(409): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctcgccctgactcagcctgccctccgtgtcgtgggtcgccgtggacacgtcggtcaccattcctcctgcacgtggacgccagctcgtcacgcccgaacggacccctaacccacgttcgttaccaccttccgttaccgtttccccccacccttccttaccttacttaacttaccgttcgttactaggaccggtccgggtacgtgggaaccgaacggccgactaagtcgnnnnnnnnnnnnnnnnnnnnnnnnnnn

SEQ ID NO: 270641 - DNA, 734 bp, Homo sapiens
  misc_feature: GYAE6OF01B6ITF.44.27.C05.1.454.CMB.1.raw
  modified_base (307)..(307): a, c, t, g, unknown or other
  misc_feature (307)..(307): n is a, c, g, or t
  modified_base (420)..(420): a, c, t, g, unknown or other
  misc_feature (420)..(420): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcgcctggacaggtcgtcaccatctcctgcacgtggacgccagcggtaatattcttagtctttaacttgctcctgtatcaacatcataccaaggtaaaccaccccaaactcatcaatctangacgactataagtacgtcctacggtagggttttacctaagtccgtcttaccacgttcgccctaccgaagtcccggacgaaccgtccgccctccctagaactaacgtccgtcgnggtaccctccggacggcgtaggaacgggtacgtaggtaccgttagttaattttagtttagtttcgttacgtcgttacaaggtttatttccgggtttaccgttacgtaccttaacgtaccgtttaagttttacgttacgtttaccggtttaccggggaaagggtttaacccggggtaaactaaacccggggttccccgttaaacccgttccgggtttaaccggaacccgtaaccgacccccgggtaaaccccggtaccccctaaaaccccccgtacgttaccccgttactaccccggtttcccgtttaccccccg

SEQ ID NO: 270642 - DNA, 937 bp, Homo sapiens
  misc_feature: GYAE6OF01CMZVA.44.27.C05.1.454.CMB.1.raw
  modified_base (176)..(176): a, c, t, g, unknown or other
  misc_feature (176)..(176): n is a, c, g, or t
  modified_base (231)..(231): a, c, t, g, unknown or other
  misc_feature (231)..(231): n is a, c, g, or t
tcagacagtatatacacgaccggtgctcgatttagacgcgatcgaagggtttggggggggtcacaagaggcagcgctctcgggacgtctccaccatggcctgggctctactcctcctcagcctcctcactcagggcacagggtcctgggactgtctaccctgactcagccgccctnagtgtctcggggccccggggcaggagggtccaccatctcctgccacgtggggacncagatccaacagtcgggacagtattcagatcgtaccacgtcggtaaccaacctacccttaccgaggaaccaccgacccctaactcctactacttcgtttacggaacctaacttcgtccgaccctcggtacggggtccctacgaaccgtcttccgtacgtcggtaccctacgtacgtcgtcgacctaccgtcctaccgtcccctccggtacggaccctacgtcccgtaacggtccgggtacccttaccggacgggtaccgtaacggtaacggtacggtaggggtaaacggggttacgttaacgttttaaccgttaaccgttaccgggtaccccgttaaaccggtttacccgtttaaacggtacccgggtaaccgtaaccgggtacccgtaaacccgggttaccccgttttaaccggggttaacggggggtttttccgggggttttaccgggggggtttttacccggggttacccgggggggtaaacccgggggtaaacccggggtaacccggttaaaccggggttccccggttaacccggggttaacccccgggttcccggggttaccgggggtaaccccgtaccccggggtaaccccgggtaacccgggttcccccggttcccccgggttacccccccggttaccgggttaccccttacccggttttcccccggttacccccgttttaccccccgttaaccccccg

SEQ ID NO: 270643 - DNA, 677 bp, Homo sapiens
  misc_feature: GYAE6OF01EIOOB.44.27.C05.1.454.CMB.1.raw
  modified_base (228)..(228): a, c, t, g, unknown or other
  misc_feature (228)..(228): n is a, c, g, or t
  modified_base (320)..(320): a, c, t, g, unknown or other
  misc_feature (320)..(320): n is a, c, g, or t
  modified_base (358)..(358): a, c, t, g, unknown or other
  misc_feature (358)..(358): n is a, c, g, or t
  modified_base (492)..(492): a, c, t, g, unknown or other
  misc_feature (492)..(492): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcgcctggacagtcggtcaccatcctcctgcacgtggacnccagtacggtccttatttcttagttcctttaactttcgtctcctggtatacacatacactaccacgaacgacccccaaactctatcatctanatactaactcgaacggtcctacgtgggtttacgttacnccgtacttccacttcgaccctacgaacgtcccgaacaacccgtccgaccctcccgactaaccctaagtcctacgtcgggtaccttccggacggtccgtagggacggtacggaggtccgtaggtacaaaagtttnttgttacgtacgttcgacgtgttcggttacgtcgtccgtactacctaactttactacgtttcgttacggtacggttacgggaaccgtaacgggtacctaaaccggttccgtaccgtaccgaccggccccgtaacggacccccaacccgtacctacctacctccgttcccgttccgttaccccccg

SEQ ID NO: 270644 - DNA, 660 bp, Homo sapiens
  misc_feature: GYAE6OF01CYPMP.44.27.C05.1.454.CMB.1.raw
  modified_base (189)..(189): a, c, t, g, unknown or other
  misc_feature (189)..(189): n is a, c, g, or t
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
  modified_base (293)..(293): a, c, t, g, unknown or other
  misc_feature (293)..(293): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcgtcaccatctcctgcactgganccagcgtatattctagtcttaacttgctctgtatcaacntcatcaagtaaacgccccaaatcatcatctangacggcctataaggacgccctagtacgggttctaatcgcttacgactcgacctaccgaacgtccggacaacgaccggcccttaccctagaaccaacttccgtcgtcgggacctccgaggtccgtaggaacgggacgacggacttagtaacgtttaattaggtttgttacgtctacgtaagtcttaggttaccgttgacctactttaccgtaactttagtcggtttccgttacggggtaacggttacggggaaaccctacgggttacccgaacccgggttaccgtaacgggttacaaccggaacccgaacccgggtacccccaaaccccgtacgttcggttaacccaacccgttccgtttacccccgg

SEQ ID NO: 270645 - DNA, 386 bp, Homo sapiens
  misc_feature: GYAE6OF01DVZGY.44.27.C05.1.454.CMB.1.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
  modified_base (347)..(347): a, c, t, g, unknown or other
  misc_feature (347)..(347): n is a, c, g, or t
  modified_base (360)..(386): a, c, t, g, unknown or other
  misc_feature (360)..(386): n is a, c, g, or t
tcagacagtatatacacgaccggtgctcgatttagacgcgatcgaaggggtttgggggggggtcacaagaggcagcgctctcgggacgtctccaccatggcctgggctctgctgctcctcactctcctcacccaggacacgagggtcctgggcccagtctcgccctgactcagcctgcctccgtgtcgtgggtcnccgtggactggtcgtcaccatcctcctgcacgtggacnccagcggtcacgcccgaacgccccaaccnctcgtaccacttccttccgtacccccacctcgttactataacgttctgtctaggacggccggggtatcgggaccgaaacggggcncgtaaatggcagnnnnnnnnnnnnnnnnnnnnnnnnnnn

SEQ ID NO: 270646 - DNA, 782 bp, Homo sapiens
  misc_feature: GYAE6OF01C2GV3.44.27.C05.1.454.CMB.1.raw
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacgagggtcctgggcccagtctcgccctgactcagcctgcctcgtgtctgggtcnccgtggacngtcgtcacgtntctactgcagtggacncgagtcggttaatcttcgttagtctttaacgttcgtctccgtggtactacaactatactactaccgtaacgaacgtacccccaatactactactatacgtagtacggacgtacctaagtaacggtaccggtacccgttcggtaacgggtttactaacgttcccgtacttacctaacgtcgtccctacgaaccgtcccggacaaccgtccgtacccttacccgtacgaactaacgttccgtacggtccggccgtaccgaggtccgtaggacgggtacgacgtacgtagttaacgttagttaagttcggtacgtcgttacccgtaaagtttcggttacgtttacccggtacgtacctttaaccggttactttaaccggtttaacgttcgggtttaacccgggtttaccggggttaacgggtaaccggggttacccgtaaaaccgggtttcccgaacccggttacggtaccgggtacccgtaaccggttaccccggaaaccccgaccccgtaaacccgtcggttaacctaccccgtacgtttcccggttaccccccgg

SEQ ID NO: 270647 - DNA, 696 bp, Homo sapiens
  misc_feature: GYAE6OF01BWCS2.44.27.C05.1.454.CMB.1.raw
  modified_base (239)..(239): a, c, t, g, unknown or other
  misc_feature (239)..(239): n is a, c, g, or t
  modified_base (270)..(270): a, c, t, g, unknown or other
  misc_feature (270)..(270): n is a, c, g, or t
  modified_base (490)..(490): a, c, t, g, unknown or other
  misc_feature (490)..(490): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcacgtggagccagcggtaattnttcttagtcttaacttgtctcctgtatcaanatcatcaggtaaaccgcccccaaatcatcatctatgacgcctataagacgcccttagtaggggtttactaatccgtcttaccgactcgtaccctaccgaacgtcccggacaaccgacccggtccctaccccgtagaaccaacgttcctaccgttcggggaccttcccggaaggtccgttacggacggacgaggtcctaggtaatttagtttagttggttntcctagaggttagttcggtttcgccgaccttacgttaccttaaccgtttattccgggttacgtttaccgggtaaagggtaccgggtaaaccgtaaaccgggttaccgtaccccggttacccgttaacgggtacccgaccggtacccccgaaacccgccccgtaaaacccctaccgttacgttaccctacccgttccgttacccccg

SEQ ID NO: 270648 - DNA, 599 bp, Homo sapiens
  misc_feature: GYAE6OF01BC0O6.44.27.C05.1.454.CMB.1.raw
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctggtcgcctggacngtcgtcacatctcngcactgagcagcgtatattctatcttattntctctgtatcaacntcactaccaggtaacnccccaaatcatcatctatgacgactaagtaagacgtcctcgtagggtttctaatcgtcttcactncctacgaacgtccgacaaccgccggtcctacccgtanaactacgtcctcgtcggccttaccgacggtcgtacggaacggacgaggtctagtatttacgtttagtttcgtgtctacgtagtacttcgttcgtctactactactaactttgttagttacggtaggttaacggtcggtaaccgttaagtcccgtaccgttacgtacggtcaccgggtaccccaaaggcccctaaccgtactacgtacctaccgttcgttacccccg

SEQ ID NO: 270649 - DNA, 850 bp, Homo sapiens
  misc_feature: GYAE6OF01C29NB.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctcgccctgactcacgcctcgcctccgtgtcgtcgggtcgcctggacaggtcggtccacctatcctcctgcaccgtaggacgccaggtccggttaatactttcttagttactttaacgtttcgtccttccgttgtacttacaactactactacgtaaccgaacgggtaaacctacccccaaactacacttaccaacttaccgttagtacggaccggtacgtaaacgtaacggtaccggtacccgttacgggttaacggggttttacctaacgttccgtactttaccgtaccgttacccgtacccgttaacccgtaaaccgggttaccccgaaacccgtaaaccccggtacccgggtacccccttaacccgtacggaaacccttaacggttcccgttaaccgggtcgggtacccgtaccggtacggtaccggtacgggaacgggtaacggacggttaccgttagttaacgttttacgttttacgtttacggttaccgtacgtttacggtaaagttccggtttcgggtttacgtccgtaacgttacctttacccgttacgttacgttcggtttaaccgggttacggtaacgggttaccggtaaccgtacgggttacccgtaccggttaccgtaacggtccacccgtaaccgtacccggacccctaccgtacgtactaccgtccgtccgtttaccccg

SEQ ID NO: 270650 - DNA, 714 bp, Homo sapiens
  misc_feature: GYAE6OF01A8MV0.44.27.C05.1.454.CMB.1.raw
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacgagggtcctcgggcccagtctcgccctgactcagccacgcctcgtgtcgtcgggtctccgtggacngtcnctcaccctctcctgcactgaactatactgatgttagaaatatactgtctcttcgactatactacctaaccgtaaaccccctaactccttacttactagtaactactaaagtacggccgtcccgtcggtcttacgtttctctacgtctcttctcgacggtcctaccgagtcgtacgacaacgtcggtccttcggttacgtaacttacgtttcgtacgtccccgttacgacgtccgttacggaacgacggtacggtacccgtaagtttacttacgttccgacgttacgtcctagtacgttaacggtccggttaccgtaccgtttaggttaagttcggttttcgggtaccgttccggggaccgggtacgggtacccggtccggttacggtacccgttaccggtacgtaccggtacaccccgggtaggtccccgtaccggtccccgttaggtccccgtacgtcccggttacccgtcccccgtacccttccttactccgttacgttcccgg

SEQ ID NO: 270651 - DNA, 737 bp, Homo sapiens
  misc_feature: GYAE6OF01EHD3M.44.27.C05.1.454.CMB.1.raw
  modified_base (280)..(280): a, c, t, g, unknown or other
  misc_feature (280)..(280): n is a, c, g, or t
tcagacagtatatacacgaccggtgctcgatttagacgcgatcgaagggtttggggagctctgagagaggagcccagccctgggattttcaggtgttttctatttggtgatcaggactgaacagagagaactcaccatggtagttgggctggaggtggtctttttcttgtgacttaattttaaaggtgtccagtgtgaggtggcctgttggagtcggtgggggaggtagttggcacgacggccggtcggggggtccctgacgtacctccgtcctgtcgcncgcctcgtcggtccctttcccgttaggctactacgtcgacctagtccgtaccggtcggtccgccgacggccgtccggaaggggacgggcgtcggtaggtcggtcgtacgactaggtcggcgtacgtagtcgacactagacagtacgtaacgtaacggacgtacggtaccggaggaccggccgtactaccacgttactccgtacgaagaacgtaaccgtaacggtaacccgaaacttccgtttacgttttaccgaaggtaaacctagaacgtacggtctaggaacggtacgaaccgaacgtaaccgtacccgtttacttttacgtcgtagggtacggaaccggggtaaggggggtaccggggtactaaggtccgtaaccggtagggtaggggttggggttacgggttacgaccccgttagggcccgggtacggggacgtaccgggtcccggtacccgg

SEQ ID NO: 270652 - DNA, 767 bp, Homo sapiens
  misc_feature: GYAE6OF01BUZ8Y.44.27.C05.1.454.CMB.1.raw
  modified_base (204)..(204): a, c, t, g, unknown or other
  misc_feature (204)..(204): n is a, c, g, or t
  modified_base (746)..(746): a, c, t, g, unknown or other
  misc_feature (746)..(746): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacgacgggtcctcgggcccagtcctcggccctgactcgacgcctcggcctccgtgtcgtcggggtccnccgtaggacgtacggtccgggtaccacccgtattcctcccgtggaccaacgtcgggacgacccgtaaggtaccgggttaaattacgttttaccgttacggttacctttttaaacgtttcgtaccgttacccgttaggttacctacaaactacttacgtaactaaccggtaacggtaaacccgaccccctaaaactctaaacctctaacttaccgtaagtcggaacgtaccttaaacgtaacggaccggtcccgtaggttacggtttactaacgtcgtctacgacgtcgcctacgtacgccgacccaacggtccgtacccctacgtagtaactactccgtcggtacggtcctacggtgtaccggtaggaacggtacgacggtacgtagttaactttagttgttacggttcacgtataggttacgttcgtcgtacctatacgttcttaatcgttacgttaccgagggtaaccgtggtaccggtacgtacccgtacggttccacgggtaacctaccgaccccggtaacaccccgtacacgttacncccgttacctccgttaccccg

SEQ ID NO: 270653 - DNA, 713 bp, Homo sapiens
  misc_feature: GYAE6OF01EL5W6.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctctgcactggagccagcgtaatattcttagttctttaacttgtctcctggtatcaacatcatccaagtaaacgacccccaaactcatcatctatgacggctaagtaagacgtccctagtagggtttactaagtcgtacttcacgtcacctacgaacgtccgacaaccgaccggtccctacccgtagaacctaactcctcgtcgggtcctccgtacggcgtaggaacggtacgacggtctagtaatttatttagttcgttgtacgtacgtaggtacgtttcgttacggtctacgtacttaccgttaacttttacgttcgtttaccggttaaccggggtaagggttaccggggtaaacccggtaaacgggttacccgttaacccgggttacccggttaacgggttacccgaaccccgggaacccccggaaacccgggtaaccccccctaaacccccgttacggttaccccgttaacccttaccccgttccccgtttacccccg

SEQ ID NO: 270654 - DNA, 841 bp, Homo sapiens
  misc_feature: GYAE6OF01BZ44O.44.27.C05.1.454.CMB.1.raw
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcggtcaccatctctgcactggacnccagcgtaatacttcttagtcttaactttgtctccgtagtatacaacatactactaccgaacggtaaaccgtaccccaaactactactactacttactacgtacgacggtaccttaagtaaacggaaccggtccccgttacggtaacggggttttactaaacgttccgtccttacctacgttaccggaccttacccgtaacggtcccggtaacgaaccgtaccggtacccttaccccgtacgtaacctaacttaccgtcggttacggggtaccctacccggtaacgggtaccgtaagggtaaccggggtaaccggtagggtaccgtttaggttaaagttttaacgttttaggttttacggtttaccgtaccgtttaacgtaacggtttaacgtttcgggtttaccggttaaccggtaccttaacgttacccttaaacgttttacgttacgggttacccggtttacggggtaaacggggttaacgggtaaacccggtaacggttacccgttacccggttaaccggttacgggtacccgtaaacccggaccccgtaaaaccgggtacccccctaaaaccggttaccttaccgtacccttaccgttcccgtttaacccccg

SEQ ID NO: 270655 - DNA, 893 bp, Homo sapiens
  misc_feature: GYAE6OF01B1XCR.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacacggtcggtcaccatcctcctgccacgtgggacgccagtaccgggtaattactttctttaggttaccttttaaacgttttcgtccttcccgttgggttactaccaaactactctacttaccgaaacgggtaaaacccaacccccctaaaaccttccaacttacctaactttaccgttaagttacgggtaacggtcccgttaaagttaaacgggacccgggtacccccgttacggggttaaaccgggggttttttaccgtaaaccgtttcccgttaccgttacccgttaaccgtcccggttacccgttaacccggtaaacggttaccccggtaacccgaaaccccggtaccggttacccctttacccgtacggtaacctaaacctttccgtccgttccggggtaacctcccggacgggtccgtaggtacggggacggtacgggtacttcggtaatttacgttacgtacggccggtaccttacttaaactttaactaaccttttccgtagtacgtttacgggtttaggggttccgggttacggggaaccgggtacggttacctaccggtacccgttccggttaaccccggttccggtacggtacccgacccggtacccggtaaccgggttcccaccccgggttcccccgtttcgggacccttaccccggtcctttaccccggtcccccggttaccccc

SEQ ID NO: 270656 - DNA, 818 bp, Homo sapiens
  misc_feature: GYAE6OF01CV8N3.44.27.C05.1.454.CMB.1.raw
tcagacagtatatacacgaccggtgctcgatttagacgcgatcgaagggtttggggggggtcacaagaggcagcgctctcgggacgtctccaccatggcatgggctctgctgctcctcactctcctcacccaggacacacgggtcctcgggcccagtctgccctgactcagcctgcctcgtgtcgtgggtccgcgtggactagtcggtaccaccgattcctcctgctacgtcggaacgccgtaaggtaccggttaaattactttaccgttttaaacggttacctttttaaacgttttcggtttcccttcccgttacgggtttaactacctaaaactaacgttacctaacgttaacccgtaaacgggtaaaacccgacccccaaaaacttcctaactacctaattactaacgtacgacggtaccgttaataaggaccggtacccgtagttacggggtttaactaacgttcggtacctttcgtaacctcgtcctaccgtaacggttacccggactaaccgtaccgtaccctcctacggtactaaacgtcgttaccggtcgtccgtcgacggtccgtaacggagggaccggtaggtacgttaagtattttacgtttagttacggtttaccgtacttacgtaaggtacgtttaacggttccggttggtaccctttaacgttaccttaacgtttacgttacggttaccgtttacgggttaacggtacgggtaaccggtaacggtaccgtacccggttcgtacggttaccgacggaaccccgtaacggaacccctaccgtactaccgttacctccgttaacccg

SEQ ID NO: 270657 - DNA, 650 bp, Homo sapiens
  misc_feature: GYAE6OF01A4F1D.44.27.C05.1.454.CMB.1.raw
  modified_base (190)..(190): a, c, t, g, unknown or other
  misc_feature (190)..(190): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacgagggtcctgggcccagtctgccctgactcagcctgcctcgtgtctgggtcnctggacagtcggtcaccatcctcctgcactggacgccagcgtaatctttcttagtctttacttgtctcctgtatacaacatcataccgaggtaaacgaccccaaactcatcatctatcgacggacctataacgtacggcccttcgtagggtttctaagtcgtctcactcgacctctagtctacgactacgaccgccctacctcgacctactccgtcgtcggtacctccgaggtctacggacgggaacggtacggactttacgaactttaacttacgttcaccgagtccgtactaacttaacgtaacgtaacggtaacgggtaacttaaccgttttaagttaccgttacgggaccgtacggaaccgggtaaccgtacgtccgtaccggtacgtttcccggaacggttccgaaccgaccgtacggtcccgttacccgccccgtccggtcgtacccgttcccg

SEQ ID NO: 270658 - DNA, 667 bp, Homo sapiens
  misc_feature: GYAE6OF01BR5K5.44.27.C05.1.454.CMB.1.raw
  modified_base (226)..(226): a, c, t, g, unknown or other
  misc_feature (226)..(226): n is a, c, g, or t
  modified_base (485)..(485): a, c, t, g, unknown or other
  misc_feature (485)..(485): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctcgccctgactcagcctgcctccgtgtcgtgggtcgcctggacagtcgtcaccatcctctgcactggacnccagacgttaatattcttagttcttaactttgtctcttggtactcaacatcataccaaggtaaaccacccctaaactcatctatctagtacgacgtactaagtaaggacgtccccgtaggtacgggttttactaactcgtctacactcgtacctacgtacgtccgacaaccgaccgccctcctagacctatcgtcgtacggctaccgagtcgtaggacggtagcgacttagtaatttagtttatttggttacgacttanaagttcgttcgttaccgcgtactaacgttctaacttttggtacgtttacgtagggaaacggttcggaaaccgtttaccggtacccgtaccggttcgttaacgggacccgtaccggaacccgaaacccgggtaccccctaaacccgtacgttaccgtaccctaacccgttccgttaccccccg

SEQ ID NO: 270659 - DNA, 735 bp, Homo sapiens
  misc_feature: GYAE6OF01A5CHG.44.27.C05.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
tcagacagtatatacacgaccggtgctcgatttagacgcgatcgaagggtttgggggggggtcacaagaggcagctctctcgggacgtctccaccatggcctgggctctgctgctcctcactctcctcacccaggacacagggtcctgggcccagtctgccctgactcagcctgcctcgtgtctgggtcgcctggacngtcgtcaccntctcctgcactgganccagcggtaatattcttagtcttaactttgtctctgtactcaacntcataccaggtaaccacccccaactcatcatctatgacgactataagcgtccctagtacgggtttactaagtcgtcttcactcgcctacacgtccggacaacgaccggccctccgtacgtacctaacttccgtacggtcgggtacccttccggtacggtcgtagggacgggtaacggacgggtcgttagttaacttttacgtttagtttcggttacgtcttacgtaacgttacgttcggtttccggtccgtactaccgttaaccgttacgtttacgtttacgtttacggtttaccgggtaacgggttaccggggtaaccccgttaaacgggttacccccgtaaccccgggttaccgttaaccgggtccccggtaaaccgggaccccccggtaaacccggtaacccccccgtaaacccccgttaccgttacccgtaccccttacccgtttcccggtttaacccccccg

SEQ ID NO: 270660 - DNA, 640 bp, Homo sapiens
  misc_feature: GYAE6OF01AHDNK.44.27.C05.1.454.CMB.1.raw
  modified_base (603)..(603): a, c, t, g, unknown or other
  misc_feature (603)..(603): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcactggagccagcggtaatattcttagtctttaactttgtcctcctggtatcaacatcatccaagtaaacgcccccaaactcatcatcctatcgaggcctaagtaagacggccctacgtagggtttctaagtcgtcttacactcgcctccaacgtccgacgaaccacgcctccagacatctcgtcggcctcgagctaggacggacgacggtctggtaatttattagtttgtcgtactccgtagttacttggttccgtcgacgtattaccttaagttcttcgttccggttacgggaacgttacgggaaccgttaccggtccgtaccccggttacgttacgggtaccgaaccggtacccccgaacccgggtaccccctaaacccccgngttaccccgtacctaccccgtttccgtttaccccccg

SEQ ID NO: 270661 - DNA, 833 bp, Homo sapiens
  misc_feature: GYAE6OF01B0RJE.44.27.C05.1.454.CMB.1.raw
  modified_base (151)..(151): a, c, t, g, unknown or other
  misc_feature (151)..(151): n is a, c, g, or t
  modified_base (163)..(163): a, c, t, g, unknown or other
  misc_feature (163)..(163): n is a, c, g, or t
tcagacagtatatacacgaccggtgctcgatttagacgcgatcgaagggtttggggagctctgagagaggagcccagccctgggattttcaggtgttttcatttggtgatcaggactgaacagagagaactcaccatggtagtttggctgnggtgtctttttntgtgacttaattttaaaggtgtccagtgtgaggtggccttgtggagtcgtggggagtgttggctacgcgccggtcggggggtccctggacgtaccttccttccgtgtcgccgacgtcccgttcggttcggtttcctacgttacgtttacgtattagtttagtttttcggtttagccgtaccgttcgggtccccgaccgacggtcccgtaccgacgggaccggaacgggggtccggtaggtcgggtcgacgtagtccgacgttccgtaccgacgtaagtacggaaggtacggaaagttaaacgtttacgttaccgtacgtaacgtaccccgggtttaccgtaaggggtaaccggtacccgtttaaccttacccgtaaacccgtaccgtttacccgtaaacccgaaagggtaaacgtaaaacccgtttaacccctttaaacccgaaaagtttaaacgttacggttacggtaccgtttagtttaccgttttaagaactaaaggtacgtaaacgtggtaccggtaagtagtacgttacgactaacgttacgttactttaggttaacgttcgtaggtacgggtacgggtaccggggtaccgtaaccggtaagggtaaacccgggttacgtaaaccgttagtaaacctttaaaccttacgtttaaagttggttacg

SEQ ID NO: 270662 - DNA, 762 bp, Homo sapiens
  misc_feature: GYAE6OF01BOB4F.44.27.C05.1.454.CMB.1.raw
  modified_base (231)..(231): a, c, t, g, unknown or other
  misc_feature (231)..(231): n is a, c, g, or t
tcagacagtatatacacgaccggtgctcgatttagacgcgatcgaagggtttggggggggtcacaagaggcagcgctctcgggacgtctccaccatggcctgggctctgctgctcctcacctctcctcacccaggacacgacggtcctcgggcccagtctcgccctgactcacgcctcgcctcgtgtcgtggtcgccgtggactagtcgtcaccatcctctgctagtgganccagtacgttaatattcgtagttactttaacttgtccttcgtagtaactacaactacttacgaactaccggaaacggtaaacctaccccaaacttcaactctaattaccgtaagcggtaaccgtactaaacgtacggtaccgtacccgttacggttaacgggtttactaaacgttccgtacttacaaccgttcgaccccgttagaaaccggtccgggaaccaaccgtacccggtacctacccgtaagtaacctacttccgtccggtacggtacctaccggacgggtaccgtaggaacgggacgtaaggtacttaacgttaatttattacgttgttcgtactacgtaagttcgttcggttcgtacctataccgttaccttaagtttacgtacgtttacggtaacggtaacgggttaccgaaccggtaccgttaccgacccggttacgtaacgggaccgtaacggtaaccccgaaacccgtaccccgtaaaccccgttacgttacccgaaccttaccgttcccgttacccccg

SEQ ID NO: 270663 - DNA, 798 bp, Homo sapiens
  misc_feature: GYAE6OF01D653I.44.27.C05.1.454.CMB.1.raw
  modified_base (119)..(119): a, c, t, g, unknown or other
  misc_feature (119)..(119): n is a, c, g, or t
  modified_base (200)..(200): a, c, t, g, unknown or other
  misc_feature (200)..(200): n is a, c, g, or t
  modified_base (526)..(526): a, c, t, g, unknown or other
  misc_feature (526)..(526): n is a, c, g, or t
tcagacagtatatacacgaccggtgctcgatttagacgcgatcgaagggtttggggggggtcacaagaggcagcgctctcgggacgtctccaccatggcctgggctctgctgctcctcnctctcctcacccaggacacagggtcctggcccagtctcgccctgactcagcctgcctcgtgtcgtcgggtcgccgtggacngtcggtccaccactcctcctgccactggacgaccaggtaccggttaattactttactttacgttacttttaaccgtttgtccttccgttaggtactaccaactactacgtaacctaccggaaaacggtaaccgaccctaaacccctaaactctaactactacttacgtacgtacggtaaccggtaacctaaggtaaccgtaccggtcccgtttacgggttaacggtttacctaagttcccgttaccttactccgtctaccccgtaccgacggtccgaacctaccgccctccctacctacacctacgtccgtacgtcgacctacggngtacggtaggacggagacgttcgtaattacgtttagtttaggtcgtaagccgttagtagtttacgggttcttaccgcctaagttcctttaccgttaattttccggtacggtttccgggtaaacgggtaccgggttaccgggtaaacccggtaccggtttaaccccctcgggtttaacgggaacccttcccgggtaaacccccggtaccccaaaccccggttaaacccccgacccttacggtttcccgttaaccttcccggtttaccccccgg

SEQ ID NO: 270664 - DNA, 873 bp, Homo sapiens
  misc_feature: GYAE6OF01BP67P.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccaggacacgagggtcctgggcccagtctcgccctgacctcacgcctcgcccttccgtgtcgtcgggtaccgccgtggacgtcggtccgtaccacctacttcctccgtgccaccgtcggacgacccgaggtaccgttaaatttacgtttacgtttacgtttacgttttaaccgttttcgtaccgttccgttaggttaactacctaaactacttaccgtaacgtaccggtaaaaccggttaaaccccgaacccccctaaaatcctaactacctaaacgttcttaagtccggtaacgtacttaaacggtacggaccggttaccccgttacgggtttacgggtttaacctaacgttacgtccttacacgtccgtaaccctaccggtaaccggtcccggaaccgtaaccctacccgggtcccccttaccgaacgtaaacctaccgtttccgtaccgggtccgtccgtacacgggtacggtacggtacggtaacggaccgtagttaagtttatttacgtttgttacggtctcgtaagtcgtttacgtttacgtacgcgtacttaacctacgtttacgtttacgtccggttaacgtaggggtaaccgggttaccgtaaacccggttacggtaaccccgtcgtttaaccgggaaacccgttaccggaaccccgtaaacccccggaaacccgttacccccctaacgttacccgtttagacccccttacccgggtttccccgttaaacccccc

SEQ ID NO: 270665 - DNA, 636 bp, Homo sapiens
  misc_feature: GYAE6OF01BXGAL.44.27.C05.1.454.CMB.1.raw
tcagacagtatatacacgaccggtgctcgatttagacgcgatcgaagggtttgggggggggtcacaagaggcagcgctctcgggacgtctccaccatggcctgggctctgctgctcctcactctcctcacccaggacacgagggtcctgggcccagtctgccctgactcagcctgcctccgtgtctgggtccgcctggaccagtccggtcaccatcctcctgccactggacgccaggcggtaatattcttagttctttaacttcgtctcctggtatcaacatcatccaaggtaaacgcccccaaatcactcatctagtgacggcctaataagacggccctgtacggggtttctaacgtcgtccttcactcgccctacaaacggtccggacaacaccggtcctccctgaacctaagtcctcgtcggggtacctccgtaggccgtagggacgggacgtaggtcttagtatttagtttacgtttcggttcgtctacgagtacttcggtttaccgcgtactataccttagtttagttcgtcggttacggtaggtcgggacgtaacggtccgaccgtccgtaggtaccaccggacccgtaacggaccctaaaccccgtactacgtcctactccgttacccg

SEQ ID NO: 270666 - DNA, 670 bp, Homo sapiens
  misc_feature: GYAE6OF01AWTRX.44.27.C05.1.454.CMB.1.raw
  modified_base (126)..(126): a, c, t, g, unknown or other
  misc_feature (126)..(126): n is a, c, g, or t
  modified_base (327)..(327): a, c, t, g, unknown or other
  misc_feature (327)..(327): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctccncacccaggacacgagggtcctgggcccagtctgccctgactcagcctcgcctccgtgtcgtgggtcgcctggacagtccggtcacctatcctcctgcacgtggagccagacggtaatcttcttagtctttaacttgtctctgtatcaacatcataccaaggtaaaccaccccaaaatcaactcatactatgacgacctaanaacgacgccgtacgtagggttactaagtcgctcactcgacctacgtaacgtcccgactaaacgccgtccctacccgtagaacctaagtcctacggtcgggtacctacacgggcgttaaggaccggacgtaacggcgttaagttaacgtttatttaagttcggttacgtacgttacgtacggtagtttcgtttacggttacctactacgttacttagtttaacgttcggttaacgttagggaacggttaccggaacgtacgttaccgaccggttaccgtacggacctaaccggacccctaacggacccctaaacccgtcgtaccgtactccgttcctaccccgg

SEQ ID NO: 270667 - DNA, 744 bp, Homo sapiens
  misc_feature: GYAE6OF01BD1QP.44.27.C05.1.454.CMB.1.raw
  modified_base (227)..(227): a, c, t, g, unknown or other
  misc_feature (227)..(227): n is a, c, g, or t
  modified_base (279)..(279): a, c, t, g, unknown or other
  misc_feature (279)..(279): n is a, c, g, or t
tcagacagtatatacacgaccggtgctcgatttagacgcgatcgaagggtttggggggggtcgacaagaggcagcgctctcgggacgtctccaccatcggcctgggctctgctgctcctcactctcctcacccaggacacagggtcctgggcccagtctcgccctgactcagcctgcctcgtgtctgggtcgctggaccaggtcgtcaccatcctcctgcacgtganccagcgtatatctagtctaacttgctctgtatcaacatcgatccaggtaacncccccgaactcatcatctatgacgcctataagacggccctcacggggtttctaatcgcttcacgtgtcctcccaaggtccggacctaacgaccgggtaccctccccgttaggaacctaacttcccgttaccgttacgggggtaccttcccgaaacggggtccttacgggtaacgggaccggtaaacgggccttagggtaacttttagttttaactttcgggtttagtaccttacgtaagggtactttcggtttaccggtccgtacctaaacggtttcccttaaccgtttttaagtacggtttacccggttaccggggtaaacgggtttacggggtaaccccgtaaagggttcccgtaacccgggttaccccggtttaagggttaacccaccgggtacccctaaaccggggccccctaaaacccccgtcttaacccggtttcccaacccgttccgtttaccccggg

SEQ ID NO: 270668 - DNA, 789 bp, Homo sapiens
  misc_feature: GYAE6OF01EPKVD.44.27.C05.1.454.CMB.1.raw
tcagacagtatatacacgaccggtgctcgatttagacgcgatcgaagggtttggggagctctgagagaggagcccagccctgggattttcaggtgttttcatttggtgatcaggactgaacagagagaactcaccatggagtttgggctgaggtggtctttttcttgtgacttaatttaaaggtgtctagtgtgaggtcggtcctggttggagtcggtgggggaggtagttggcacgaggccggttcggggggtccctggacgaccgttcctcccgtggtcgaccgacgtcccgttcgtggtacttcctaccgtttacgtagttagttagtgtacttatcgtccgtacggttcgggtccccgccgacggtcccgtccggacgggaccgggaacggggtcggtaggggagggttggggtcggtaacggtaggttattaacgtcgtaaagtagtagtaaggttaagggaaaagttaacgtaaagtaaagttaacgtaacgtacgtaacgtacggttaccggtacgggaaaccggggtcttaaccgtacccgaactacctaccgtaccgaaggtaaacgaaccgttaaaccgtaacctaaacggaaccttcgtttacgtttaccggtttacgtaacgtaaccgtaaaacgtaacgaaaccgtaggtaacccgtaggtaaccggacggttacggtacggacggtaaccggtacggactaggtttaacggttacgttacgtggacggtacgaacggaacgcgtaacgaactaaaccggtaacgtaggtacgggg

SEQ ID NO: 270669 - DNA, 947 bp, Homo sapiens
  misc_feature: GYAE6OF01AZZI5.44.27.C05.1.454.CMB.1.raw
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtcgtgggtcgcctggacagtccggtcaccatcctcctgcacgtggagcctagacggtaattatttcttagtacttttaactttcgtccttccgttggttaactacctaaacacttaccaacttacccgaagggttaaaaccgaccccccctaaaacttacctaacgttaccaacttaccttaagtcggacgggtacccttaagtaaacggcggtccccttacggtaaggggtttttactaaacgttccggtcctttaccgtaaccttcggtcccttaacccgtaacggtaccccggaccgtaaacccgtaacccgggtccccctttacccgttacgttaccgaaacccttccggtttccgttacggggccctttacccggaagggttccggtaaggggtaacgggtaaccgggtaccgggtcggtttaaggtaaatttttaaccgttttagtttttaccggttacggtaccgtttaccgaacgggtttacgtttaccgggtttacccgggttccctaaccggttacctttaaaccccgttaagttttaccgttttacccgggttttccgggtttaaacggggttaaaccggggttacccgggggtaaaacccgttaaaccggggtaaccccgttaccccgggggtttaaactaacccggggggtaacccgtaccgtaacccccggggtaaacccggtacccccccgtaaaaccccggtcgtttaaccggtcccccttaacggtttcccccggtttaccccccggg

SEQ ID NO: 270670 - DNA, 789 bp, Homo sapiens
  misc_feature: GYAE6OF01EIV5N.44.27.C05.1.454.CMB.1.raw
  modified_base (651)..(651): a, c, t, g, unknown or other
  misc_feature (651)..(651): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacgagggtcctgggcccagtctcgccctgactcacgcctcgcccgtccgtgtcgtcgggtcgccgtggactcggtcggtacaccatcctcctgctacgtcggacgccgaggtaccgtaaattctttcttagttacttttaaccgtttgtccgttccgtggtactactaactctactacttaccgtaaacggtaaaccgaaccccctaaactcctaactccgtacttactagttacggacggtaccgttaagtaacggtaccggtcccgttacggtacgggtttaacgttaacgttccgtaccttacgtacccgtaccgtaccccgtaaccgtaaccggtacccgaaccgtaacccgacccggtacccctcccgtacgtaacctaactccgttacggtccgggtactacccggtacggtacgttacgggacggtaccggtaacggcgttaagtaacgttttaagtttggttacgttcggtcttacgtagttagttcgttacgtccgaacttacgtntttaacgttcgttcgttaccggttagggacgttaaccgggaacgtaccgtaccggttaccgtccggttagaccggtacccgtacccggaaacccgtaccccgtaaccgtactaccgtacctaccgtccgttcccccgg

SEQ ID NO: 270671 - DNA, 709 bp, Homo sapiens
  misc_feature: GYAE6OF01AHFE7.44.27.C05.1.454.CMB.1.raw
  modified_base (696)..(696): a, c, t, g, unknown or other
  misc_feature (696)..(696): n is a, c, g, or t
tcagacagtatatacacgaccggtgctcgatttagacgcgatcgaaggggtttgggggggggtcacaagaggcagcgctctcgggacgtctccaccatggcctgggctctactcctcctcagcctcctcactcgacgggcacagggtcctggggactcgtctacctgactcacgccgcctcagtcgtccggactccgtggtcaggtccggtcactacttcgttctagttcttccgagtaccgaacaacttccacgtcggtacctttaaagtcctcttaactcggggtatcggtacgctacggtcgggtccccggccgaaccgtaccctaaagtccttacctttacgacgtccttcggcggtctcggctacgtcctggtccgttttcggcctctagtctacgccgacgccggccttccgtacgacctactacaacctaacgcccgtactaggacgtactcggaacgtctacgttaacctttagtttgttcgtacgtcctaagttcttaccgtacttacacttaactaagtacgttccttacggttacggaacggttaccggaccgtccgttacgcggtaccgttcgtacgttcctacgaccggtaacccaccgggtacccaaacctcggtctaacctcgtacccgtttccggtccccgtcccgttacctaacttaccggtttactacgtggtttccnggtcggtaccggg

SEQ ID NO: 270672 - DNA, 765 bp, Homo sapiens
  misc_feature: GYAE6OF01EK01L.44.27.C05.1.454.CMB.1.raw
  modified_base (235)..(235): a, c, t, g, unknown or other
  misc_feature (235)..(235): n is a, c, g, or t
  modified_base (295)..(295): a, c, t, g, unknown or other
  misc_feature (295)..(295): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacgagggtcctgggcccagtctcgccctgactcagcctgcctccgtgtcgtgggtccgcctggactaggtccggtcaccgtatcctcctgcacgtgganccaggtacggtaattatttacttacgttctttaacttgtccttcgtaggtactacaactntactactaccgaacggtaaaccaccccctaaactctaactactagtctagtcggacggtacctaagtaacggtacggtccctaggtacgggtttactaacgtcctcttctaactccgtacctaccgtaacggtcccggaactaaccgaccggtccctacccgtagtacctacgttctccggtacgggtcctccggtacggtccggtagggacgggacggacggtacttaggtaactttagttacgtcgtacgtacgtactaccgtaattaacgtaacggtaagggtaaccggttaacttaacgtttaacgttaccgggttacgggaccggtaccggtaaaccggggtaccgtaaaccggtacgttacccggtacccggtacccggttaacgggacccgtaccgggaacccgtaaccgggtccccgtaccccggtccccgttaccggtccttacccgtcccgtttaccccg

SEQ ID NO: 270673 - DNA, 601 bp, Homo sapiens
  misc_feature: GYAE6OF01EC7HM.44.27.C05.1.454.CMB.1.raw
  modified_base (355)..(355): a, c, t, g, unknown or other
  misc_feature (355)..(355): n is a, c, g, or t
  modified_base (441)..(441): a, c, t, g, unknown or other
  misc_feature (441)..(441): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatcagtaaacgccccaaatcatcatctatgagctataagacgcctgagggtttctaatcgcttcactgcctacaacgtccganaaccgcggccctccctagacaactctcgtcgggcctccgaggctggaggtacgaggcttacggaatttaactttattgttgacctntaacgtattcgtttcgtacgtctatacttactttagtcttacgttacggaaggttacgggacccaaaggttccgtacccgttacggtagtccgaacggtacccccgaaaggtacccccaaacccctacgttacgttccctaaacgttcccttaccccggg

SEQ ID NO: 270674 - DNA, 747 bp, Homo sapiens
  misc_feature: GYAE6OF01DGG1I.44.27.C05.1.454.CMB.1.raw
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
  modified_base (411)..(411): a, c, t, g, unknown or other
  misc_feature (411)..(411): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggaccacagggtcctgggcccagtctcgccctgactcacgcctgcctccgtgtctgggtcncctggacagtcggtcacctatctcctgccacgtggacnccagcggtaatcttcttagtcttactttgctcctggtatcaactactctataccaacgtaaacgaccccctaaatccatctactctatacgacgactataacgcgacctcgtaagggttctaagtcgtacttcacgtcgtcctacctaacggtccgaacaaccgccggtaccctccgtanaacctaacgttccgtacgtcgggtacctacccgtaacggtaccgttacgggaaacggggaccgttaagggacctttaaggtaattttaacgttagttttcggttacgtaccggttactaacggtacgtttacgggtttcggtaaccggtacttaacttacccggtttactttaacggttacgttaccggttacgggtaacggttaaccgggtaaaccgtaaaccgggtacccgtacccggttaacggttacgggttacccaccgggtaaacccctaacccggaacccctaaaccccgtaacttaccggaaccttacccgttccgtttacccccggg

SEQ ID NO: 270675 - DNA, 551 bp, Homo sapiens
  misc_feature: GYAE6OF01BIOGU.44.27.C05.1.454.CMB.1.raw
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattctagtcttaactttgtctcctgtatcaacatcatccagtaaacgccccaaactcatcatctatgagcctataagagccctgagggtttctaatcgcttcactgcctccaagtccggacaacacggcctccctgacaatctctcgggtcctcaggctggacggacgaggctagattattatttgtgctnagtntgttcgcgctatctacttatcgttacttcggaagtcgggaacctaggtccgtaccgtccgtaggtccacggaccccgaacgggcccctaaacccctactgtaccctacgttccgttacccg

SEQ ID NO: 270676 - DNA, 695 bp, Homo sapiens
  misc_feature: GYAE6OF01EXHZ2.44.27.C05.1.454.CMB.1.raw
  modified_base (189)..(189): a, c, t, g, unknown or other
  misc_feature (189)..(189): n is a, c, g, or t
  modified_base (244)..(244): a, c, t, g, unknown or other
  misc_feature (244)..(244): n is a, c, g, or t
  modified_base (279)..(279): a, c, t, g, unknown or other
  misc_feature (279)..(279): n is a, c, g, or t
  modified_base (310)..(310): a, c, t, g, unknown or other
  misc_feature (310)..(310): n is a, c, g, or t
  modified_base (661)..(661): a, c, t, g, unknown or other
  misc_feature (661)..(661): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgtcctgactcagcctgcctcgtgtctgggtcncctggacaggtcggtcacctagtcctcctgcacgtggacgccaggcggttaattnttctagttacttaactttgtctcctggtatcaacntcatcaaggtaacaccccaatcatcatctanggagcctaagtaacggcggtccctaggttacggggtttacctaagttcgtctttacgaacttcgtaccctacgtaacgtccgacaacgccggtacctaccctacgactaactccgtacgtcgggtccttaccggaggtcgtacgggaacgggtacggtacggtacgttagtaacgttttatttacgtttcggttacgtacctcgtaagttgtttcgttcgtacggtactaccttacgtacgtttatttccggttacggttacgggaacggttcgggaaccgttacggtacccggttacccggttccgtagggtaccaaccggacccgtaaaccggacccctaaaccccgtntacccggttacctaccgttcccgttaacccccgg

SEQ ID NO: 270677 - DNA, 567 bp, Homo sapiens
  misc_feature: GYAE6OF01AHZII.44.27.C05.1.454.CMB.1.raw
  modified_base (315)..(315): a, c, t, g, unknown or other
  misc_feature (315)..(315): n is a, c, g, or t
  modified_base (368)..(368): a, c, t, g, unknown or other
  misc_feature (368)..(368): n is a, c, g, or t
  modified_base (469)..(469): a, c, t, g, unknown or other
  misc_feature (469)..(469): n is a, c, g, or t
  modified_base (544)..(544): a, c, t, g, unknown or other
  misc_feature (544)..(544): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggacgccagcggtaatattcttagtcttaactttgtctcctggtatcaacatcatccaggtaaacgccccaaatcatcatctatgacggcctaanaagacggccctgagggtttctaagtcgacttcactgcctcaacgtccgacacncgcctccagacatctcgtcggcctcgaggcgtgagggacgaggtctagtaattacgtttattagttcgacttcagtattcgttcgtcgactatctaacttntagtccgtaggaagtcggacctaacggtccaaccggttcgaggtactccggacccgaaccggcccaaaccccgtntacgtcctaccgttcttaccccg

SEQ ID NO: 270678 - DNA, 857 bp, Homo sapiens
  misc_feature: GYAE6OF01DTAYV.44.27.C05.1.454.CMB.1.raw
  modified_base (195)..(195): a, c, t, g, unknown or other
  misc_feature (195)..(195): n is a, c, g, or t
  modified_base (239)..(239): a, c, t, g, unknown or other
  misc_feature (239)..(239): n is a, c, g, or t
tcagacagtatatacacgaccggtgctcgatttagacgcgatcgaagggtttggggggggtcacaagaggcagcgctctcgggacgtctccaccatggcctgggctctgctcgctcctcactctcctcaccaggacacgacgggtcctgggcccagtctcgcctgactcagcctcgcctcgtcgtcgtcgggtcnccgtggactacgtcggtcacctatcctactgacctacgtggacnccgaagtcgttaattcttacgttacgttactttacgttcgtacctcgttggtatacaacgtactccactaccgaacggtaaaccgacccctaatcactcgacttctagtgacggtacaagtaacggcgtcccgttacggtaacgggtttctaacggtcgtccttacgaccgtctcccgtaaccgtaaccggtacccgtaaccgaaccgtacccggtccctacccggttaacaaccgttaaccgtttccgtaccgggttaccggtaccccgttaccggaacgggttacgtacggggaacgggttaacggtacggttccgtttaaaacgggttactttttaaacgttttcgtttacgtttacgtcgttaacgtacgtttaacgtttcgggttacccggtacttaaccgtaaccgttacgtttaaccgtttttacgttaccggggtttaccggtttaaggaacccggggtttaccggtaaacccgggtaaaccggttaccccggttacccggtttaacgttacccgggttaacgtccccggaaaaccccgggtaacccctaccccgggttaaaaccccttccgtacttaacccggtcccgttacccgttttaaccccccgg

SEQ ID NO: 270679 - DNA, 908 bp, Homo sapiens
  misc_feature: GYAE6OF01BO8Z6.44.27.C05.1.454.CMB.1.raw
tcagacagtatatacacgaccggtgctcgatttagacgcgatcgaagggtttggggggggtcacaagaggcagcgctctcgggacgtctccaccatggcctggctctagctgctcctcactctcctcaccaggacacgacgggtcctcgggcccagtctcgccctgacctcacgcctcgtccctccgtgtccggtcgggtccgaccgttggacgtacggttcccggtacacctacttcctccgttacgaccgtaacgttcggaaccgcccgtaacggtacggtttaacttacgtttaccgtttaaccggtttaccttttaacgtttccgttaccgttccggttacggttactaccgtaactacgtaccgtaaccgttaccgtaaacggttaaaccccgaccccctaaacttcctacgttacctacgttacttacggtacgtaaccggtaccttaacgtaaccggtacccggttacccgttacgggttacgggttttaaaccgttaacgtccgttaccgttaccgaccgttccggtacccctacggtaacccggtaccgtaaaccgtaccgtaccccgggaccttacccgttaactaaccgttacgtcggtttccggtacccgggttacccaccgggtacggtccggtaacgggtaacgggtaccccggtaggtaccgtttaagttaacgttttaacgtttggtttacgtttaaccgtcgttaacgttggtttaacccggttgtttccccgaggttaacctacgttaccgttaacgtttcgttaacggttacgttacgaccgggttacgaccggttacgtcccgttaacgtccgtaacggacccgtaccggacccgtaaccggtaccccctaacgtaccgtaccctcgtaccggtttcccttacccccg

SEQ ID NO: 270680 - DNA, 1116 bp, Homo sapiens
  misc_feature: GYAE6OF01CVPMU.44.27.C05.1.454.CMB.1.raw
tcagacagtatatacacgaccggtgctcgatttagacgcgatcgaaggggtttggggggggtcacaagaggcagcgctctcgggacgtctccaccatggcctgggctctgctgcctcctcactcctcctccaccgaggaccacgtacgggtccgtacgggcccgtagttcctccgcccgtcgtactcacgtcctcgtccgtcgtcgtcggtcggcgtccgtaggacgtcggtccgtaccgactactccgtccgtcgccgacgtacggacgacgtaaggtaaccggtatttcttacgtttaacgttctttaacttcgttctacgttacggtaactccaaacgtactaccgtaaactaccggtaaaacgtaacccccgtaaccccttaacgacttaccttaactacgtaacgttaacggtaacgtaaccggtaacctaaaacggtaccgggtacccggttaaccccggtttaagggttttaccggggttaaaccctttaacggtttccgtaacccgttttaccgttaacccggtaccccggttaaacccgttacccgggtaaaccggtttaccccggaaaacccttaacccccgggttaccggaccccccgttttaaacggaacccggttaaacgtttaaaacccggttccgttacccgggggtacccggtaacccggttaaaccggaggggtttacccgggaaacggaacggggtaacccggttaccgggtaaattttacgggttaaacgttttttgttaacccggttttcggttaaccaccgttttaaggaccggtttaaccgttcgggtttaacccggttacctaacccggttttacctttaaaccgttccggtttttaacgggttaacggtttttaaacccggggggtaaccggttttaaaccgggggaaacccgggtttaaaccgtaccccgggggtttaaaaaccccgtttacccggggtttaaaccccggtaccccggggttaaaccccggtaaaaccccccggttacccgggtaaaaacccccccgttaaaacccccgggttaaccccttaacccggggttaccccgttttaaaccccggtttctttacccccggggttttaaaccccgg

SEQ ID NO: 270681 - DNA, 738 bp, Homo sapiens
  misc_feature: GYAE6OF01AWFVE.44.27.C05.1.454.CMB.1.raw
  modified_base (276)..(276): a, c, t, g, unknown or other
  misc_feature (276)..(276): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcaccaggacacgtagggtctcggccagtctcgcctgactcgacgtccgtcgcccttcggtgtcggttcgggccgtccgtaggacgtacggtccgtaccgaacctacgtcctacctggcctacgtacggagaccgaggtaacgttaacttntttaacgttaacgttactttacgttcgtcgttcgtagtaacctacgaaatactaccgtaacgtaccggtaaaacggtaaaccctaacccctaagtactaacgtacgtactacgtagaccggtacgtaacctaaggaacgtaccggccgtaaggttacggttactaacgttcacttcgacaccacgtaacgcgtaccgacaaccaccgtcgtaactacattaccgtgcgtacgtcacgaccgagtaacggaggtaggtacaggttactagtttaactggttcactacgtattcggttactccgggttactcacgttactaacgttaagtttcgtaacggttacttacgggaacggttaccgggaaacgttacgtaccccgtaaacgggtccggtaacgtacccgaaccggtaacccgaaaccgtccctacgtaacctcggttaaacctccgttcggtcccccg

SEQ ID NO: 270682 - DNA, 648 bp, Homo sapiens
  misc_feature: GYAE6OF01B3SMI.44.27.C05.1.454.CMB.1.raw
  modified_base (193)..(193): a, c, t, g, unknown or other
  misc_feature (193)..(193): n is a, c, g, or t
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacgagggtcctgggcccagtctgccctgactcacgcctgccttccgtgtctgggtcnccgtggacagtcgtcactatctcctgcacgtggacncaggcgtaattnttcttagtctttacgtttgtctcttggtatacaactatacactaccgaagtaaaccgacccctaaactcactcattctaagtgacgtacctaagtaacggacgacccttaggtacgggtttactaagtccgtcttacactcgcctacgaacgtccgacaaccgccggccttaccagtaactacgtcctcggtcggtacttccgaggtcgtaggacgggtacgacggtctagttaacttagttacgtttgtcgctacgtagtgtttacggttcgtccgtattacttactacgtttcttcgttacggtcggtaaggttaccgggacgtaacggtcccgtaccgttcggtacgacgtccgaccgaaccggaccctaacccgtcgttacgtccctcgttccgttacccccg

SEQ ID NO: 270683 - DNA, 926 bp, Homo sapiens
  misc_feature: GYAE6OF01EYVMT.44.27.C05.1.454.CMB.1.raw
  modified_base (244)..(244): a, c, t, g, unknown or other
  misc_feature (244)..(244): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacacgggtcctgggcccagtctgccctgactcacgcctgtccctccgtagtctagggtcgaccgtgacaggttccgtacaaccatccgtcctgacctacgtgggaacnccgtaaggtaccggttaattacctttacgttacgtttacttttaacgttttacgtccttaccgtagttactactaaactagttacctaacgtaaccgtaacgggttaaaaccaccccctaaaacttaccgtactacctaattacgtagtaacggtaaccggtaccgttaaacgtaaacggtcggttaccccgttacgggttaacggggttttaacctttaacgttcggttaccgttaccgtaacgtcgtacccgttaaccgtaaccggtaccggtaaaccaccggtacccgtacccgttacccccgtagtaaccttaaccgttcccgttaccgggttaccgggtaccgtacccggacggtaccggtaacgggaaccgggtaacgggtaaccggttaccgtaggtttaaacttttacgtttaaccggttttacggttacgttaaccggttaccgtaacggtttaccttaccgggtttacggttaccgtaaccttaaccctaccgtttaacgttttagttacggttaacgggtttacgggtaaacggtaacgggttaacccgtaccgggttacccgtacccgttacggttaccggaccgtaacccgggtaaacccgtaacccgggaaacccccttaccgtaacccggtagtttaccccgttaacgtttccccggttaccccggg

SEQ ID NO: 270684 - DNA, 765 bp, Homo sapiens
  misc_feature: GYAE6OF01EXSX4.44.27.C05.1.454.CMB.1.raw
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (736)..(736): a, c, t, g, unknown or other
  misc_feature (736)..(736): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcnctgacngtcgcacntctctgcatgcncagcgtaatcttctagttcttaacttgtcctctagtacacactctctactacgtaacaccccgaacctatactactactactacgtagacggacgtactaaggtcggaccttcgtagggttacgttactaccttcgttacctacttccgtacctaccgtaacgtcccggtaccgaaccgaacccggtccctacccgtacgtaacgttaaaccttccggttccgtcggggtaccgttaccccgtacggggtaccgtacgggtaagggggtaacccgtacgggtacggttattaacgtttaactttttaggttccgtttaggtacccgtacgtaagtttagggttccgtttacgacggttacttaaccttacggtttacgtttaccgtttacgttccgggtttacggggaacgggttaacggtcccgggtaaacccgtccggttaaccccgttacgggttaccgttaacgaccggttaaacccgacccccggtaaaacccaccccgttacgttacgttacccncccgtttacccgtccggtttaaccccccc

SEQ ID NO: 270685 - DNA, 1008 bp, Homo sapiens
  misc_feature: GYAE6OF01CP75T.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccgaggacacgacgggtcctcgggccctaggttcctcgccctgaaccttcacgtcccttgcccttccggtgtcgtcgggtccgacccgttggacctaggttaccggtccaacctacttccttcccgtggcctaacggttcgggaaccgcccgtaaggtacgggttaaacttttacgttttaccgtttaacggtttaaccctttttaaccgtttttcggttcccttacccggttttaggttaactttaaccgaaaaccttacgttaccctaaccgttaaaccccggtaaaacgggttaaaaaccccccgacccccccttaaaaacgttcctaaactactaaactttcgtaacgttaaccggggtaaccggttaaccttaaacggttaaaccgggaccggtttaccccgtttacggggttttaaaccggggtttttaaccttaaacggttcccggttaccctttaccggtaaccgtttccggttaaccccgttaaccccgggtaaaccggttaccccgggtaaaccaaaacccgggtccccggtaccccctttacccgtacgtaaaaccgttacttcccggttacggtacccgggtaccctttcccgggaaggtccggtacgggaacccgggtaacggtacggttacgtttaagttaacgtttttaacgtttgggtttaccggtcgtacgttaacttaaggggttacttttccgggttaccgtcgttaccgtactttaccgttacgtttacgttaccggttacggtacggttagggacccggttaaccgtaccgggtccttaccggtaccgtacggttaccgaacccggtaccgaaccccgaccctaaccccgtagtcctacccgtctttcccgtaccccg

SEQ ID NO: 270686 - DNA, 772 bp, Homo sapiens
  misc_feature: GYAE6OF01EE5DL.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctcgccctgactcagcctgcctcgtgtcgtggtcgcctggacagtccggtcacctactcctcctgcacgtggacgccgagtacggttaattactttcgttagttaccttttaacttttcggttccttaccgttaggtaactacctaaacacttcctaacttaccgaaacgggtaaaaccccaaccccccgtaaaactcctaactactaacttacttagtacggacggtacctaaagtaacggaaccggtcccgtacggtttacgggtttactaacgtccgtcttcctactcgtaccctaacgtaaccggtccgaccaacccggtaccgtcccctccctagaactaactccgttcgtacggtcctacggcgtcgtagggacggtacggacgtgttagttatttaatttgtttcgttcgtcctagtaagttgttcgttaccgtgtaccttacgttacgttaagtttcgttaccgggtttcggtaacgggtaacggtacggggtaaccgtaacgggttcccgtaccggttccggttaacggtacccgaaccggaaccccgtaacccgtaaccccgtaacccgttacctaccgttacccttccgttacccgttaccccccg

SEQ ID NO: 270687 - DNA, 813 bp, Homo sapiens
  misc_feature: GYAE6OF01B4CU6.44.27.C05.1.454.CMB.1.raw
  modified_base (202)..(202): a, c, t, g, unknown or other
  misc_feature (202)..(202): n is a, c, g, or t
  modified_base (560)..(560): a, c, t, g, unknown or other
  misc_feature (560)..(560): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacgacgggtcccgggcccagtctgccctgactcagcctcgcctccgtgtctgggtcgcctggacngtcggtcacatcctctgcactggacgccagtacggtaattactttcttagttacctttaactttcgtccttcgtaggttatactaactacgttctactacccgtaaacggttaaacccgaaccccctaaacctcactactaacttctaatcggtaacgtactaacgtaaacggaccggtcccgtacggttacggggtttacctaacgttccgtccttacgaacgtcgtccctaaccgacggttaccggaccaaccgtaccgtccctcccgtacgaactacgtcctacgtcgggacctcggcgtacgtcggacggacgtaggtacttaggtttaactttaagtttcgtttacggttacncccgttaaggtacggttttacgttccgggtttcccgtacggtaccgttaacttaccggttaaccgttttacgtcggttttacccggttaacggggtaaacggtttcgggaaacccgttaaacgggttccccgtaccccggtttacgggttaccggttaccaaccccggggacccgaaaacccccggtcccccgtaaacccccgtggtttaccccttacgacccttttccccggttaccccgttaacccccccc

SEQ ID NO: 270688 - DNA, 924 bp, Homo sapiens
  misc_feature: GYAE6OF01EQ2FV.44.27.C05.1.454.CMB.1.raw
tcagacagtatatacacgaccggtgctcgatttagacgcgatcgaagggtttgggggggggtcacaagaggcagcgctctcgggacgtctccaccatggcctgggctctgctgctcctcactctcctcacccaggacacaggtcctcgggcccagtctcgtccctgactcacgtcctcgtcctccggtgtcgtcgggtccgccgtaggactacggtccggtaccacctactcctccgtgcctacgtacggacgaccgacggtaccggttaaattactttactttacggtttaccttttaacgttttcgttccgttccgttacggtacttaccaaactacgttacctaacctaaccggtaaaccgtaaacccggtaacccccctaaacgtacctaacttcgtaacttaccgttacgtacggtaacggtaccttaaggtaaccggaccggtaccgtttacgggtttacgggttaaccttaacggttcgttccttacgaccttccggtacccttaaccggaaccggttacccggaaaccgtaaaccccgggtcccggtacccttacccgtagtaaacccttaaccggttccgttaccggggttccgggtacccgttaccgggtaacggtacggtaagggaccgggggacggtaccgggtacgtttaagttaacttttagtttacggttttataccggttacttaacggtagtttaccgggtttacgggttaccgtcgtaaccttacttaacgtttacgttacgggtttacgttaccggttaaggggttaaccgggtaacggtaaccggttaaaccgggtaccccgttacccggttacgggtaaccggtaccgaacccggaaccccggtaacccaacccccggtaccctacggttaacccgttcccttaacccttcccgttaaccccc

SEQ ID NO: 270689 - DNA, 702 bp, Homo sapiens
  misc_feature: GYAE6OF01AQ7IM.44.27.C05.1.454.CMB.1.raw
  modified_base (208)..(208): a, c, t, g, unknown or other
  misc_feature (208)..(208): n is a, c, g, or t
  modified_base (429)..(429): a, c, t, g, unknown or other
  misc_feature (429)..(429): n is a, c, g, or t
  modified_base (479)..(479): a, c, t, g, unknown or other
  misc_feature (479)..(479): n is a, c, g, or t
  modified_base (550)..(550): a, c, t, g, unknown or other
  misc_feature (550)..(550): n is a, c, g, or t
  modified_base (658)..(658): a, c, t, g, unknown or other
  misc_feature (658)..(658): n is a, c, g, or t
tcagacagtatatacacgaccggtgctcgatttagacgcgatcgaagggtttggggggggtcacaagaggcagcgctctcgggacgtctccaccagtggcctgggctctgctgctcctcactctcctcacccaggacacgacgggtcctgggcccagtctgccctgacctcacgcctgtcctcgtgtcgtgggtccgaccgtggacgngtccggtccacctatcctcctgctacgtggacgccaggtcgtaaattacttcttacttctttacgttgtcttccgttagtactccaacactcaactaccgaacggtaacccacccctaatcactaccattcctatcgacggtactaagtacggaccgtaccttaggtagggtttactaacggtctcgttaccacgtcgacctaccggaacggtacccgaanaacccgtccgtccctaccagtaacctactccgtccggtacggtccacggnggtctagggacgacggacgtacgttgttaacttacttcgtttgccgtcttagtcttagttcgttcgtaccngttacctactacgtttatcggtttcgtaacggggtgtaccggtaccgttacgtaccctacggttaccgttacgtacgaacccggtcccggaaaccggtaaaccccccnccgtaactttaccggacccttaccgtttcccggttaacccccgg

SEQ ID NO: 270690 - DNA, 696 bp, Homo sapiens
  misc_feature: GYAE6OF01A3IIE.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccagacacaggtcctgggcccagtctgccctgactcagcctgcctccgtgtctgggtcgcctggacagtcggtcaccatctcctgcactggacgccagcggtaatattcttagtctttaactttgtctcctggtatcaacatcactccgaaggtaaacacccccaaactcatcatctatgacgctaagtaacggacggccctacgtagggttttacctaagtccgtacttcacgtcgaccctaccctaacggtcccggaccaaacgacccggtcccctcccgtacgaacctaacttccgtcggtcgggaccctcccgaaggtccgttaggaacggggaccgagggtctaggttaactttaagtttacgtttggtttctacgtacgtagttacgttcgtttcgtaccgactacgttaccttaactttagttccggttaccgtttacgggaacggttacgggtaacccgtaaaccggtaccgtacccggttaccgtacggtaccgacccgtaccccgaacccggtacccccaaacccctacgtaccgtccctccgttccgttacccccg

SEQ ID NO: 270691 - DNA, 820 bp, Homo sapiens
  misc_feature: GYAE6OF01D4B4L.44.27.C05.1.454.CMB.1.raw
  modified_base (324)..(324): a, c, t, g, unknown or other
  misc_feature (324)..(324): n is a, c, g, or t
tcagacagtatatacacgaccggtgctcgatttagacgcgatcgaagggtttggggagctctgagagaggagcccagccctgggattttcaggttgttttcatttggtgatcaggactgaacagagagaactcaccagtggtagtttgggctggtaggtggttctttttcgtgtagtacttaagttttaaaaggtcgtctagtgtgaggtcgtccgtggtggtagtcggtgggggagtgttggacacgacggtccgggtcgggggtcctggacgtacctccgtccgtgtcgcacgtccttcgtcgttaccctttcccgttaggngtctagtctaccgtataccggtccgtcggtcccgccggacggtccggtaccgggaacgggggtacggggcgttacgggtacgggttcggtcgtaaccggtacgtacggttcgaccgtcgtacggtacgtactaacgtacaacgtaacgtacgtaacggttaacggacggtaaccggtcggtaacggtaacggtccctacgttaccgacctacttcccgacaacggaacgttaacccgtaaacggtaaccctaacgttacctttaacgtttacggtaaagtaacgtacgaaacgtccgtacgtaaggaacggaaccggttacgaaaccgttccggtacccgttttacgttttacttacggtaggaccgggtaagggtaaacgggggtacgggtaactacgggttaacgtcccgtaagggttcggggttcgggtttcgggtacccgtacggtacccggtcggggttaccggaccgggtcgggacccggttaccccggg

SEQ ID NO: 270692 - DNA, 152 bp, Homo sapiens
  misc_feature: GYAE6OF02HR94E.44.27.C05.1.454.CMB.1.raw
  modified_base (152)..(152): a, c, t, g, unknown or other
  misc_feature (152)..(152): n is a, c, g, or t
tcagacagtatatacacgaccggtgctcgatttagacgcgatcgaagggtttgggaagaggaagactgacggtcctgccacagcggccctgggctgcctggtcaaggactacttcctatatactgtctgagcgggctggcaaggcgcatagn

SEQ ID NO: 270693 - DNA, 154 bp, Homo sapiens
  misc_feature: GYAE6OF02HI2VP.44.27.C05.1.454.CMB.1.raw
  modified_base (153)..(154): a, c, t, g, unknown or other
  misc_feature (153)..(154): n is a, c, g, or t
tcagacagtatatacacgaccggtgctcgatttagacgcgatcgaagggtttggggaagaggaagactgacggtcctgccacagcggccctgggctgcctggtcaaggactacttcctatatactgtctgagcgggctggcaaggcgcatagnn

SEQ ID NO: 270694 - DNA, 157 bp, Homo sapiens
  misc_feature: GYAE6OF02HUID6.44.27.C05.1.454.CMB.1.raw
  modified_base (154)..(157): a, c, t, g, unknown or other
  misc_feature (154)..(157): n is a, c, g, or t
tcagacagtatatacacgaccggtgctcgatttagacgcgatcgaagggtttgggggaagaggaagactgacggtcctgccacagcggccctgggctgcctggtcaaggactacttcctatatactgtctgagcgggctggcaaggcgcatagnnnn

SEQ ID NO: 270695 - DNA, 169 bp, Homo sapiens
  misc_feature: GYAE6OF02F9E9S.44.27.C05.1.454.CMB.1.raw
  modified_base (168)..(169): a, c, t, g, unknown or other
  misc_feature (168)..(169): n is a, c, g, or t
tcagacagtatatacacgaccggtgctcgatttagacgcgatcgaaggtttgggtgttcggcggagggaccaagctgaccgtcctaggtcagcccaaggctgcccctcggtcactctgttcccgccctcctctatatactgtctgagcgggctggcaaggcgcatagnn

SEQ ID NO: 270696 - DNA, 154 bp, Homo sapiens
  misc_feature: GYAE6OF02F3EAH.44.27.C05.1.454.CMB.1.raw
  modified_base (153)..(154): a, c, t, g, unknown or other
  misc_feature (153)..(154): n is a, c, g, or t
tcagacagtatatacacgaccggtgctcgatttagacgcgatcgaagggtttgggggaagaggaagactgacggtcctgccacagcggccctgggctgcctggtcaagactacttcctatatactgtctgagcgggctggcaaggcgcatagnn

SEQ ID NO: 270697 - DNA, 161 bp, Homo sapiens
  misc_feature: GYAE6OF02IFBA4.44.27.C05.1.454.CMB.1.raw
  modified_base (159)..(161): a, c, t, g, unknown or other
  misc_feature (159)..(161): n is a, c, g, or t
tcagacagtatatacacgaccggtgctcgatttagacgcgatcgaagggtttgggctgaccaaggtcaccgtcctaggtcagcccaaggccaaccccactgtcactctgttcccgccctcctctatatactgtctgagcgggctggcaaggcgcatagnnn

SEQ ID NO: 270698 - DNA, 154 bp, Homo sapiens
  misc_feature: GYAE6OF02GTL23.44.27.C05.1.454.CMB.1.raw
  modified_base (154)..(154): a, c, t, g, unknown or other
  misc_feature (154)..(154): n is a, c, g, or t
tcagacagtatatacacgaccggtgctcgatttagacgcgatcgaagggtttgggggaagaggaagactgacggtcctgccacagcggccctgggctgcctggtcaaggactacttccacgtctactgctgagcgggctggcaaggcgcatagn

SEQ ID NO: 270699 - DNA, 530 bp, Homo sapiens
  misc_feature: GYAE6OF02FQUXB.44.27.C05.1.454.CMB.1.raw
  modified_base (279)..(279): a, c, t, g, unknown or other
  misc_feature (279)..(279): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (383)..(384): a, c, t, g, unknown or other
  misc_feature (383)..(384): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (392)..(393): a, c, t, g, unknown or other
  misc_feature (392)..(393): n is a, c, g, or t
  modified_base (397)..(397): a, c, t, g, unknown or other
  misc_feature (397)..(397): n is a, c, g, or t
  modified_base (401)..(405): a, c, t, g, unknown or other
  misc_feature (401)..(405): n is a, c, g, or t
  modified_base (407)..(410): a, c, t, g, unknown or other
  misc_feature (407)..(410): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (419)..(421): a, c, t, g, unknown or other
  misc_feature (419)..(421): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (431)..(432): a, c, t, g, unknown or other
  misc_feature (431)..(432): n is a, c, g, or t
  modified_base (450)..(450): a, c, t, g, unknown or other
  misc_feature (450)..(450): n is a, c, g, or t
tcagacagtatatacacgaccggtgctcgatttagacgcgatcgaagggtttgggggggggttcggacgaaagaggcagcgtcgtcctcgggacggtacctccaccgaatcggcccgggctctgctgcttcctcactctcctcacccgaggaccacagggtcctgggcccagtctgtccctgtactcagcctgcctccgtcgtcctgggtcgtcctggaccaggtacggtcaccactctcctgcacgtggagccagcggtcagcctaaggccaaccccngtgtccaacctctaacgttcccgcccgtcctacgtactaccgtacctcgtcctgacgcgggtctgggccaacgggccgcgactagngcgtgngacngtnagtgnngngngtgnnctcnctcnnnnncnnnngngcntntnnntntntntntnntgtgttcgtctctctctntctctcgttcgtcgtcgtcgtcgtcgtgtagtacgtacgacgtacgtacgtcgtcgcgtcgtcgacctacgtctcgtctc

SEQ ID NO: 270700 - DNA, 514 bp, Homo sapiens
  misc_feature: GYAE6OF02HFXRQ.44.27.C05.1.454.CMB.1.raw
  modified_base (502)..(502): a, c, t, g, unknown or other
  misc_feature (502)..(502): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcactgcctccaagtccggcaacacggcctccctgacaatctctgggctccaggctgaggacgaggctgattattattgttgctcagatgttcgtcgcatcactttatgttcttcggaagtgggaccaggtcaccgtctaggtcagcccaaggcccaacccntcgtcactctcg

SEQ ID NO: 270701 - DNA, 525 bp, Homo sapiens
  misc_feature: GYAE6OF02GXTWH.44.27.C05.1.454.CMB.1.raw
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaatcatcatctatgaggcctataagaggccctcgagggtttctaatcgcttcactgcctccaagtccggcaacacggcctccctgacaatctctgggctcaggctgaggacgaggctgattattattgttgctcagattgttcgtcgcatcactttatgttcttcggaaagttgggaacctagggtccaaccggttcctaggtcagcccaaggcccaacccatcgtacactctccg

SEQ ID NO: 270702 - DNA, 517 bp, Homo sapiens
  misc_feature: GYAE6OF02I3GC7.44.27.C05.1.454.CMB.1.raw
  modified_base (501)..(501): a, c, t, g, unknown or other
  misc_feature (501)..(501): n is a, c, g, or t
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcactgcctccaagtccggcaacacggcctccctgacaatctctgggctccaggctgaggacgaggctgattattattgttgctcagtatgttcgtcgctatcacttatgtcttcggaagtgggacctaggtaccgtcgtaggtcagcccaaggccaacccnctgtcactctgtcccc

SEQ ID NO: 270703 - DNA, 158 bp, Homo sapiens
  misc_feature: GYAE6OF02F3L7C.44.27.C05.1.454.CMB.1.raw
  modified_base (154)..(158): a, c, t, g, unknown or other
  misc_feature (154)..(158): n is a, c, g, or t
tcagacagtatatacacgaccggtgctcgatttagacgcgatcgaagggtttgggggaagaggaagactgacggtcctgccacagcggccctgggctgcctggtcaaggactacttccacgtctactgctgagcgggctggcaaggcgcatagnnnnn

SEQ ID NO: 270704 - DNA, 528 bp, Homo sapiens
  misc_feature: GYAE6OF02GNQXT.44.27.C05.1.454.CMB.1.raw
  modified_base (511)..(511): a, c, t, g, unknown or other
  misc_feature (511)..(511): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaatcatcatctatgaggcctataagaggccctcaggggtttctaatcgcttcactgcctcaagtccgcaacacggcctccctgacaatctctgggctccaggctgaggacgaggctgattattattgttgcttcagtatgttcgtcgcatcactttatgttcttcggaagttgggacctaggtccaccggttcctaggtcacgcccaaggcccaaccccgntcgtcctacgtctccgg

SEQ ID NO: 270705 - DNA, 257 bp, Homo sapiens
  misc_feature: GYAE6OF02JBNVD.44.27.C05.1.454.CMB.1.raw
  modified_base (252)..(257): a, c, t, g, unknown or other
  misc_feature (252)..(257): n is a, c, g, or t
tcagacagtatatacacgaccggtgctcgatttagacgcgatcgaagggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaactacttccacgtctactgctgagcgggctggcaaggcgcatagnnnnnn

SEQ ID NO: 270706 - DNA, 516 bp, Homo sapiens
  misc_feature: GYAE6OF02HHB5P.44.27.C05.1.454.CMB.1.raw
  modified_base (437)..(437): a, c, t, g, unknown or other
  misc_feature (437)..(437): n is a, c, g, or t
  modified_base (503)..(503): a, c, t, g, unknown or other
  misc_feature (503)..(503): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcactgcctccaagtccggacaacacggcctccctgacaatctctgggctcaggctgaggacgaggctgattatattgttgctcagtatgttcgtcnctatcactttatgttcttcggaagtggaccaggtcaccgtctaggtcaagcccaaggcccaacccntcgtcactctccg

SEQ ID NO: 270707 - DNA, 537 bp, Homo sapiens
  misc_feature: GYAE6OF02IZT59.44.27.C05.1.454.CMB.1.raw
  modified_base (224)..(224): a, c, t, g, unknown or other
  misc_feature (224)..(224): n is a, c, g, or t
  modified_base (325)..(325): a, c, t, g, unknown or other
  misc_feature (325)..(325): n is a, c, g, or t
  modified_base (520)..(520): a, c, t, g, unknown or other
  misc_feature (520)..(520): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaggtaaacgcccccaaactcatcatctatgaggcctataagaggccctnagggttttcaatcgcttcactgcctccaagtccggcaacacggcctcctgacaatctctgggctccaggctgaggcgagctgattattattgttgcttcagtattgttcgcgcatcactttatgttcttacggaagtcgggaaccaagggttcctaaccggtccttaaggccaagccccaaggcccaaccccgtnttcgtaccactcttccg

SEQ ID NO: 270708 - DNA, 213 bp, Homo sapiens
  misc_feature: GYAE6OF02GN4E4.44.27.C05.1.454.CMB.1.raw
  modified_base (174)..(174): a, c, t, g, unknown or other
  misc_feature (174)..(174): n is a, c, g, or t
  modified_base (176)..(213): a, c, t, g, unknown or other
  misc_feature (176)..(213): n is a, c, g, or t
tcagacagtatatacacgaccggtgctcgatttagacgcgatcgaagggtttgggtgttcggcggagggacctaagctgaccgtcctagggtcagcccaaggctgccccctcggtcactctgttcccacccgtcctctatatactggtctgagcgggctggcaaggcgcatagncnnnnnnnnnnnnnnnnnnnnnnnnnnnnnnnnnnnnnn

SEQ ID NO: 270709 - DNA, 554 bp, Homo sapiens
  misc_feature: GYAE6OF02GAPPO.44.27.C05.1.454.CMB.1.raw
  modified_base (190)..(190): a, c, t, g, unknown or other
  misc_feature (190)..(190): n is a, c, g, or t
  modified_base (285)..(285): a, c, t, g, unknown or other
  misc_feature (285)..(285): n is a, c, g, or t
  modified_base (361)..(361): a, c, t, g, unknown or other
  misc_feature (361)..(361): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccaggtaaacncccccaaatcatcatctatgagcctataagacggcctgagggtttctaatcgcttcactgcctcaagtccgcaacncggcctcctgacaatctctgggctccaggctggaggacgaggctgacttattattgttgcttcgagtattgttcgtgctatctactttagtgttcgttcggaaggttcgggaacctaagggtccaacccggttcgtacggtcaccgaccccgaaggcccctaacccctcgttcgtaccctacgtccttcccgg

SEQ ID NO: 270710 - DNA, 497 bp, Homo sapiens
  misc_feature: GYAE6OF02HCQIC.44.27.C05.1.454.CMB.1.raw
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccagtaaagcccccaaatcatcatctatgaggcctataagaggcctcagggtttcaatcgcttcactgcctcaagtccgcaacacggcctcctgacaatctctggctcagctgagcgaggctgattatactgcagctcatatacaagtggaactactttactattcggcgcagggaccaagctagaccgtctgggtcacgccaaggctcgcccctggtcactctcg

SEQ ID NO: 270711 - DNA, 316 bp, Homo sapiens
  misc_feature: GYAE6OF02GJZ40.44.27.C05.1.454.CMB.1.raw
  modified_base (312)..(316): a, c, t, g, unknown or other
  misc_feature (312)..(316): n is a, c, g, or t
tcagacagtatatacacgaccggtgctcgatttagacgcgatcgaagggtttgggggggtcgacgaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggcccaacccactgtccactctgttcccacctcctctatatactgtctgagcggctggcaaggcgcatagnnnnn

SEQ ID NO: 270712 - DNA, 317 bp, Homo sapiens
  misc_feature: GYAE6OF02ISF08.44.27.C05.1.454.CMB.1.raw
  modified_base (311)..(317): a, c, t, g, unknown or other
  misc_feature (311)..(317): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccactgtcactctgttcccacctcctctatatactgtctgagcgggctggcaaggcgcatagnnnnnnn

SEQ ID NO: 270713 - DNA, 154 bp, Homo sapiens; identical to SEQ ID NO: 270531
  misc_feature: GYAE6OF02GKG9H.44.27.C05.1.454.CMB.1.raw
  modified_base (154)..(154): a, c, t, g, unknown or other
  misc_feature (154)..(154): n is a, c, g, or t

SEQ ID NO: 270714 - DNA, 165 bp, Homo sapiens
  misc_feature: GYAE6OF02IJBAC.44.27.C05.1.454.CMB.1.raw
  modified_base (163)..(165): a, c, t, g, unknown or other
  misc_feature (163)..(165): n is a, c, g, or t
tcagacagtatatacacgaccggtgctcgatttagacgcgatcgaagggtttggtggtctccactcccgccttgacggggctgccatctgccttccaggccactgtcactctgttcccgccctcctctatatactgtctgagcgggctggcaaggcgcatagnnn

SEQ ID NO: 270715 - DNA, 312 bp, Homo sapiens
  misc_feature: GYAE6OF02JEK0R.44.27.C05.1.454.CMB.1.raw
  modified_base (309)..(312): a, c, t, g, unknown or other
  misc_feature (309)..(312): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccatgtcactctgttcccacctcctctatatactgtctgagcgggctggcaaggcgcatagnnnn

SEQ ID NO: 270716 - DNA, 638 bp, Homo sapiens
  misc_feature: GYAE6OF02G72MP.44.27.C05.1.454.CMB.1.raw
  modified_base (228)..(228): a, c, t, g, unknown or other
  misc_feature (228)..(228): n is a, c, g, or t
tcagacagtatatacacgaccggtgctcgatttagacgcgatcgaagggtttgggggggggtcacaagaggcagcactcaggacaatctccagcatggcctggtctcctctcctcctcactctcctcgctcactgcacagggtcctgggcccactctgtgctgacgcagccgccctcagtgtctgggggcccccggggcaggagggtcaccatctcctgcactgggancagactccaacagtcgggacagattctgatgtccactggtaccaacaccttccaggaacacgacccccaaactcctcatctttaggtaacaactatcggccctcgacgggtccctgaccgattctctggctccaagtctggcacctcacgccctccctcgcctactcacgtcgggcctccgaggcctaggaaacgagttcggaggggttagtaatttacgtttactacgaccctagttcccttagtcgaccgagccgtacgtccgttacgtagggtttgggttgggtcgggtttccgggacgggtacgggacccgtaaggtccgtacggtaccccgggttccgttcggggttacccgaacgggtaccccgtaagggtccccgttccggtcccccccgttacggtaccccg

SEQ ID NO: 270717 - DNA, 516 bp, Homo sapiens
  misc_feature: GYAE6OF02JBG7Q.44.27.C05.1.454.CMB.1.raw
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaatcaatcatctatgaggcctataagaggccctcagggtttctaatcgcttcactgcctcaagtccggcaacacggcctcctgacatctctggctccagctgaggacaggctgattattattgttgctcagtatgttctcgcatcacttatgttctcggaagtggacctaggtcaccgtctaaggtcacgtcccaaggtcccaaccccgtatgtacctactccttccg

SEQ ID NO: 270718 - DNA, 191 bp, Homo sapiens
  misc_feature: GYAE6OF02I79OF.44.27.C05.1.454.CMB.1.raw
  modified_base (156)..(191): a, c, t, g, unknown or other
  misc_feature (156)..(191): n is a, c, g, or t
tcagacagtatatacacgaccggtgctcgatttagacgcgatcgaagggtttggggggaagaggaagactgacggtcctgccactagcggccctgggctgcctggtcaaggactacttccacgtctactgctgagcgggctggcaaggcgcatagnnnnnnnnnnnnnnnnnnnnnnnnnnnnnnnnnnnn

SEQ ID NO: 270719 - DNA, 566 bp, Homo sapiens
  misc_feature: GYAE6OF02IR9V7.44.27.C05.1.454.CMB.1.raw
tcagacagtatatacacgaccggtgctcgatttagacgcgatcgaagggtttgggggggggtcacaagaggcagcgctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgttcggtcgttttgaccgtgtctcctggtaccagcacgaccccagaaacacgacccccaaactcatttatttatgcggtcaatcgttccgcccttccggtcgtccctgacgcgtcttctcgtgggtccaagtctggcaacgacggcctcccgtgaccatcctcgtcgggcctccgaggctgaggacgaggctgtattattactgcagtctcatatacgagtcgggaacttactttactagttccggcgtacgagggaccaagctcgaccgtccgtaggtcaaccgccgaaggcctccgcccctcggtccacttcctccgttcccctaccc

SEQ ID NO: 270720 - DNA, 631 bp, Homo sapiens
  misc_feature: GYAE6OF02JVESV.44.27.C05.1.454.CMB.1.raw
  modified_base (446)..(446): a, c, t, g, unknown or other
  misc_feature (446)..(446): n is a, c, g, or t
tcagacagtatatacacgaccggtgctcgatttagacgcgatcgaagggtttgggggggtcacaagaggcagcgctctcgggacgtctccaccatggcctgggctctgctgctcctcactctcctcactcagggcacaggatcctgggctcagtctgccctggctcagcctccctcgtgtccgggtctcctggacagtcagtcaccatctcctgcactcggaaccaacagtgacgtcggttcgtttgaccgtgtctcctggtaccagcacgacccagaaaccacgacccccaaactctattattactcgcggtacaatcgttccgtcccttccggtcgtcccctgacgcgtcttcgtcgtcggtccctaaacgtcgtacggaccaaacgaccggtcccttccgtcgacctacttccgtcgtcgggtctccgaggctggacggacgnggctagtattactactgctacgtctactaatactaacgaaggtacggtaaactacgtttaactacggttccggacgtacgaacggaacctagcctacgtacccggttacgtaacggtccacgggtaccctaacggtccgttccgacccccgttccggtacctaccgttccgttccgttacccccg

SEQ ID NO: 270721 - DNA, 676 bp, Homo sapiens
  misc_feature: GYAE6OF02J0JLG.44.27.C05.1.454.CMB.1.raw
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (557)..(557): a, c, t, g, unknown or other
  misc_feature (557)..(557): n is a, c, g, or t
tcagacagtatatacacgaccggtgctcgatttagacgcgatcgaagggtttggggggggtcgacgaagaggcagcgctctcgggacgtctccaccatggcctgggctctgctgctcctcactctcctcacccaggacacagggtcctgggcccagtctgccctgactcagcctgcctccgtgtctgggtcncctggacngtcggtcaccatcctcctgcactgganccagcggtaatnttcttagtcttaatttgctctggtatcaacntcatcaggtaacnccccaactcatcatctatgacgcctaataagacgtccctacgtaggggtttctaagttccgtacctttccaccgttcgtacccttaccgtaaacggtcccgggtaccaaaccgaccggtcccttacccctacggaaccctaaacttcccgttacgtcggggtaccttccgaacgggtccttacgggaacggtacggaacggtcttaggacttttaatgtttcgttgcttcgagtacgttcggtttcgcgtatacttacctagtttagttcgttnttaccgggtaagttacgggaactacgggttctacccgggttcttaaccggtcgtaacccgcccgtaaaccggtaccccaacccgtacgtttacgaccttacccgttaccgtttccccgg

SEQ ID NO: 270722 - DNA, 534 bp, Homo sapiens
  misc_feature: GYAE6OF02HD3TS.44.27.C05.1.454.CMB.1.raw
tcagacagtatatacacgaccggtgctcgatttagacgcgatcgaagggtttgggggtcacaagaggcagcgctctcgggacgtctccaccatggcctgggctctgctgctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtgtccggccgagcccccaaagtcctctttacgacgtcctttcgcggcttcggcagtccctggccgtttttcggcctccagttctgaccacgcggcctccctgaccatcaccaaactccggcctgagatgaggctgactacttttgttgtgcatatttcgattcactcaaatatgtcttcggaagtgggacccgcgtcagcgtcctgcgttcagcccaaggccacccactcgtcactctgttccccacctcctctatatactgtctcgg

SEQ ID NO: 270723 - DNA, 533 bp, Homo sapiens
  misc_feature: GYAE6OF02H4HV0.44.27.C05.1.454.CMB.1.raw
  modified_base (244)..(244): a, c, t, g, unknown or other
  misc_feature (244)..(244): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcgatcaccatctcctgcactgggtccagcaatgacattggganatataaccttgtctcctggtatcaacaacatccaggcaaagcccccaaactcatactttttgagtccagtgagcggccgtcgaggtgtttctaatcgcttctctggctcaagtctggccacacggcctccctgacatctctcgggctccgaggctgaggacgaggatgatttattattgttgctcagatgttcgtcgctatctacttatgttcgttacggtaggttcgggaacctaaggtccaaccggttcctaggtcacgcccgaacggcccaaccctacgtcgtacc

SEQ ID NO: 270724 - DNA, 669 bp, Homo sapiens
  misc_feature: GYAE6OF02HW481.44.27.C05.1.454.CMB.1.raw
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagccccccaaacctcactactactactagtaggacggtaccttaagtaacggaccggtccctacgggttacgggttttactaacgtccgttacctactacgtcgtaccctaccgtaacggtcccggaactaacgacccggtccccttaccgtacgtaactaacttccgtcggtcggtccctaccggacggtcgtagggacggacggacggtctagtaatttatttagttgttcgctagtagtattcggttcgtcgactactcttaacttgttcgttacggtaggtaaggtaccgggaaccgtacggtaccgtaccgtacgtacggtacaacccggtacccgaaccggacccccaacccgtacgtaccgtacctcctaccgttccccgg

SEQ ID NO: 270725 - DNA, 530 bp, Homo sapiens
  misc_feature: GYAE6OF02ISXJD.44.27.C05.1.454.CMB.1.raw
  modified_base (514)..(514): a, c, t, g, unknown or other
  misc_feature (514)..(514): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcactgcctccagtccgcaacacggcctcctgacaatctctggctccaggctgaggacgaggctgattattattgttgctcagattgttcgtcgactatctactttatgttcgttcggaagttgggacctaaggtccaaccggtcctaggtcacggcccaaggcccaacccnctcgtacactctccgg

SEQ ID NO: 270726 - DNA, 338 bp, Homo sapiens
  misc_feature: GYAE6OF02GPH5X.44.27.C05.1.454.CMB.1.raw
  modified_base (316)..(338): a, c, t, g, unknown or other
  misc_feature (316)..(338): n is a, c, g, or t
tcagacagtatatacacgaccggtgctcgatttagacgcgatcgaagggtttgggggggggtcgacaagaggcagcgctctcggggacgtctccaccatggcctgggctctgctgcctcctcactctcctcacccaggacacagggtcctgggcccagtctgccctgactcagcctgcctccgtgtctgggtcgcctggacagtcggtcaccatctcctgcactggagccagcggtcagcccaaaggccaaacccatgtcactctgttcccacctctctatatactgtcctgagcgggctggcaaggcgacatagnnnnnnnnnnnnnnnnnnnnnnn

SEQ ID NO: 270727 - DNA, 504 bp, Homo sapiens
  misc_feature: GYAE6OF02FZB5W.44.27.C05.1.454.CMB.1.raw
  modified_base (282)..(282): a, c, t, g, unknown or other
  misc_feature (282)..(282): n is a, c, g, or t
  modified_base (321)..(321): a, c, t, g, unknown or other
  misc_feature (321)..(321): n is a, c, g, or t
  modified_base (359)..(359): a, c, t, g, unknown or other
  misc_feature (359)..(359): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaancccccaaatcatcatctatgaggcctataagaggccctnagggtttctaatcgcttcactgcctcaagtccgcaacncgcctcctgacatctctgggctcagctgaggacgagctgattattattgtnctcagatgttctcgnatctacttatcgttcttcggaagtgggaacctagtccacgtctaggtcaacgcccaaggcccaacccntcncactctcg

SEQ ID NO: 270728 - DNA, 530 bp, Homo sapiens
  misc_feature: GYAE6OF02H14XK.44.27.C05.1.454.CMB.1.raw
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
  modified_base (383)..(383): a, c, t, g, unknown or other
  misc_feature (383)..(383): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaaggtaaacncccccaaatcatcatctatgaggcctaanaagacggccctcgaggggtttctaatcgcttcactgcctaccaagtccggacaacacggtcttcccngacaatctctgggctccgaggctgaggacgnggctgattattacngcgctctattacactntgagtcgttggtgtcggcggaggactcgactcgaccgtcgtaggcacgccgaggcctcgcccctcggtccactcttcgtccctccc

SEQ ID NO: 270729 - DNA, 733 bp, Homo sapiens
  misc_feature: GYAE6OF02J04LV.44.27.C05.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (282)..(282): a, c, t, g, unknown or other
  misc_feature (282)..(282): n is a, c, g, or t
tcagacagtatatacacgaccggtgctcgatttagacgcgatcgaagggtttgggggggtcgacgaagaggcagcgctctcgggacgtctccaccatggcctgggctctgctgctcctcactctcctcacccaggacacagggtcctgggcccagtctgccctgactcagcctgcctccgtgtctgggtcncctggacngtcggtcacatctcctgcactggacgccagcggtaatnttcttagtcttaactttgtctctgtatcaacatcatccagtaacnccccaaatcatcatactatacgagacctaataacgacgtccctcgaacggggttttctaaagtccgtacctttcaacgttcgtcccgttccgaaacggttcccggtacctaaaccctaccgggtacctttccccgtagtaacctaaacttccgtcgttacggggccttaccgacgggtaccttacgggacgggaaccgtagggtaccttaggtaaacgtttacgttaacgttcggacggttccttaccgttaattttaaccgaacgtttcgttagtaacggttaccgttttaggggttcggtttaccgggagggttaacgggtacctaaccgtacccgttacggaccccgtttacggttacggttcccgaaccggtaccccgaagggtccccttaccggtccccccgttacgggcccttaccgtacccgtttccgtccccccggttacccc

SEQ ID NO: 270730 - DNA, 567 bp, Homo sapiens
  misc_feature: GYAE6OF02HT0SX.44.27.C05.1.454.CMB.1.raw
  modified_base (286)..(286): a, c, t, g, unknown or other
  misc_feature (286)..(286): n is a, c, g, or t
  modified_base (432)..(432): a, c, t, g, unknown or other
  misc_feature (432)..(432): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacncccccaaactcatcatctatgagcctatagacgcctagagggttcaatcgcttcactgcctcaagtccgacaacacggcctccagacactctcgtgggctccgaggctaggacggacgagctgtaactttattattgtttgcttanagtatgttcgtcgactatctaacttagtgttcgttaggaagtacgggaaccctaggtccaccggttccgtaggtaccacggtaccccgaaagggccccctaaaccccgacgttcgtacctaccgtcttaccccgg

SEQ ID NO: 270731 - DNA, 525 bp, Homo sapiens
  misc_feature: GYAE6OF02GC8TX.44.27.C05.1.454.CMB.1.raw
  modified_base (439)..(439): a, c, t, g, unknown or other
  misc_feature (439)..(439): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcactcagggcacagggtcctgggcccagtctgccctgactcagcctgcctccgtgtctgggtcacctggacagtcgatcaccatctcctgcattggaaccagcagtgacattggtggttataactatgtctcctggtaccaacaacacccaggacaaacgccccaaactcatgattcatgatgtcagtaatcggcctgtaggggtttctggtcgtcttctctggctcaagtctggcaacaccggcctccctgacccatctcgtcgggctccgagctgagggacgaggctagactattactgcagctacaatanaaaagagacaacacttagttatagttcggacggaaggaccaaggactacgaccgtacgtaggcaggcccaaggcctcgcccctcgg

SEQ ID NO: 270732 - DNA, 765 bp, Homo sapiens
  misc_feature: GYAE6OF02J2D83.44.27.C05.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
tcagacagtatatacacgaccggtgctcgatttagacgcgatcgaagggtttgggggggtcgacgaagaggcagcgctctcgggacgtctccaccatggcctgggctctgctgctcctcactctcctcacccaggacacacgggtcctgggcccagtctcgccctgacctcagcctgcctccgtgtctgggtcncctggacngtcgtcacntcncctgcactggacnccagcgtaatnttcttagtcttaacttgtctcctgtatcaactntcatcagtaaacgccccaatcatcatctatgaggtcctaataacgacgtccctagtacggggtttactaacgtcgtactttaccgacttcgtaccctaccgtaacggttcccggactaaaccgtaccggtaccccttccccgtaacgtaaccctaaccgttccgttccgttccggggaccttacccggacgggtccgttacggggacggtaaccggtacggtaccgttacggtaactttttaacgtttaacggttcggttttcgactttaccgaaagtttcgtttaccgggttttcggtaccgtacgttactttaccgtaaccgtttttacgtttcggttaccgttttaacgggaacggtttaccggggtaaccctagggttacccttacccgggtaccgtttaacgggcctaacccggaaccccggtaaaccggtaccccgtaaacccccgtacgttaccggttacccgtaaccgtttcccgttaaccccggg

SEQ ID NO: 270733 - DNA, 611 bp, Homo sapiens
  misc_feature: GYAE6OF02GB2DH.44.27.C05.1.454.CMB.1.raw
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaacgcccccaaactcatcatctatgaggcctataagaggccctcgagggtttctaatcgcttcactcgcctccaagtccggcaacacggcctccctgacatctctgggctccgaggctaggacggacgaggcttagatttattatttgttcgtctcagtattcggttacgtcgactattcctaacgttttatcgtttaccgttacggggaaaggttcggggaacccctagggttaccctaacccggttcccgttaacgggttaccaacccggaccccgtaacggaccccctaaccccgtacgttcccgtacctaccgttccgttccccgg

SEQ ID NO: 270734 - DNA, 154 bp, Homo sapiens; identical to SEQ ID NO: 270531
  misc_feature: GYAE6OF02FORIK.44.27.C05.1.454.CMB.1.raw
  modified_base (154)..(154): a, c, t, g, unknown or other
  misc_feature (154)..(154): n is a, c, g, or t

SEQ ID NO: 270735 - DNA, 546 bp, Homo sapiens
  misc_feature: GYAE6OF02GVWM9.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccagtaaagcccccaaatcatcatctatgaggcctataagaggccctcagggtttctaatcgcttcactgcctcaagtccggcaacacggcctccctgacaatctctgggctcgagctgagacgagctgattattattgtgctcagtatgttcgtcgactatctactttatgttcgttcggaaagtcgggaacctaagggttccaacccggttccgtaaggtccaacgccccgaaggaccccaaaccctacttcgtaccaccgttctacccg

SEQ ID NO: 270736 - DNA, 537 bp, Homo sapiens
  misc_feature: GYAE6OF02GURZ5.44.27.C05.1.454.CMB.1.raw
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcactgcctccaagtccggcaacacggccctccctgacaatctctgggctccaggctgaggacgaggctgattattatttgttgtctcagtattgtttcgtcgcatctatttatcgttcttacggaagtgggaccaggtccaccggtcgtaggtccagacccaaggccccaacccgctcgtacctacttctcccg

SEQ ID NO: 270737 - DNA, 766 bp, Homo sapiens
  misc_feature: GYAE6OF02HSO3E.44.27.C05.1.454.CMB.1.raw
  modified_base (218)..(218): a, c, t, g, unknown or other
  misc_feature (218)..(218): n is a, c, g, or t
tcagacagtatatacacgaccggtgctcgatttagacgcgatcgaagggttagggggggtcacaaaggacggaacagccgctcgtcgggacgtcctccaccatggcctgggcctctcgctggcgtcctcgactctcctctaccctagggacacagggtcctgggcccagtcgtgcccctgacctcgacgcctggcctccgtgtctgggcgcctggacngtcggtcacgatcctcgtcgcacgtggacgtccgagtcggttaatacttcgttagtctttaactttggtactccttggttactaccaaacgtattcacttccgtaaggtaaaaccgccccccaaaagtcccgaatcgtaattcgtaagtggaacgtcctaagtaacggacggtccctacgtacggggttttacctaaacgtacgtaccgttacgaacgttcggacccgttaacgaaacggttcccggaacgaaaccgtaccgggtccctacccgtagaactaactccgtacggtcgggacctaccgaggtccgtaggaacgggtacgacgggtaccttaggtaatttacgttaagttcgggttacgaccgtacgtagtacgtacggtttcgacgactacgtaccttacgtttactagttcccgttagggaacgttacgggaacctaacgggttccttaaccggtccgtaacggtaccgtaccggtaacccccgaacgggtacccctaaaccccgacgttacggtaccgttaccgttccgttaccccgg

SEQ ID NO: 270738 - DNA, 170 bp, Homo sapiens; identical to SEQ ID NO: 270535
  misc_feature: GYAE6OF02HB2CK.44.27.C05.1.454.CMB.1.raw
  modified_base (170)..(170): a, c, t, g, unknown or other
  misc_feature (170)..(170): n is a, c, g, or t

SEQ ID NO: 270739 - DNA, 596 bp, Homo sapiens
  misc_feature: GYAE6OF02GM9HJ.44.27.C05.1.454.CMB.1.raw
  modified_base (225)..(225): a, c, t, g, unknown or other
  misc_feature (225)..(225): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaaggtaaacgcccccaaactcatcatctatgagacctataagacgccctcgtagggtttactaagtcgtcttcactcgcctccaacgtcccggacaaccgaccggccctccctagactaactctcgtcggcctccgaggctacggaggacgacggctagtatttattagttgttcgctnagtnttgttcgtcgactactctactttagtcgttcgttacggaaggtcggaaccgtacggtcctaccggttccgtacggtccgaccgtacccgaacggaccccaacccgtacctacgtacctaccgttccgttaccccgg

SEQ ID NO: 270740 - DNA, 527 bp, Homo sapiens
  misc_feature: GYAE6OF02FT3SA.44.27.C05.1.454.CMB.1.raw
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (511)..(511): a, c, t, g, unknown or other
  misc_feature (511)..(511): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgagcctataagngccctnagggtttctaatcgcttcactgcctccaagtccggcaacacggcctcctgacatctctggctcaggctgaggacgaggctgattattattgttgcttcagtattgttcgtcgctatctacttatgttccttcggaagtgggacctaaggtccaaccggttctaggttccagcccaaggcccaacccgtntcgcctactcttcccg

SEQ ID NO: 270741 - DNA, 514 bp, Homo sapiens
  misc_feature: GYAE6OF02F9FO3.44.27.C05.1.454.CMB.1.raw
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgagcctataagaggcctcaggggtttctaatcgcttcactgcctcaagtccggcaacacggcctccctgacaatctctgggctccaggctgaggcgaggctgattatattgtgctcagatgttcgcgcatcactttatgttcttcggaagtgggaccaggtccaccgtcctaggtcacgcccaaggcccaacccgtatcgtcactctccg

SEQ ID NO: 270742 - DNA, 543 bp, Homo sapiens
  misc_feature: GYAE6OF02I0ZSZ.44.27.C05.1.454.CMB.1.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (454)..(454): a, c, t, g, unknown or other
  misc_feature (454)..(454): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaacttgtctcctggtatcaacatcatccaggtaaagcccccaaactcatcatctatgaggcctagtaagaggccctcgaggggtttcaatccgcttcactcgcctcaacgtccggcaacacggcctccctgacaatctctgggctccagctgaggacgaggctgattattattgttnctcngattgttcgtcgtctatcaactttncgtttcgtggaaagtggaacctaggttcacccgttcgtacgtcgtacgacccgaaggaccccaacccctagtcgcctactccttcccgg

SEQ ID NO: 270743 - DNA, 315 bp, Homo sapiens
  misc_feature: GYAE6OF02HE41U.44.27.C05.1.454.CMB.1.raw
  modified_base (310)..(315): a, c, t, g, unknown or other
  misc_feature (310)..(315): n is a, c, g, or t
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccactgtcactctgttcccaccctcctctatatactgtctgagcgggctggcaaggcgcatagnnnnnn

SEQ ID NO: 270744 - DNA, 166 bp, Homo sapiens
  misc_feature: GYAE6OF02HVCC2.44.27.C05.1.454.CMB.1.raw
  modified_base (155)..(166): a, c, t, g, unknown or other
  misc_feature (155)..(166): n is a, c, g, or t
tcagacagtatatacacgaccggtgctcgatttagacgcgatcgaagggtttggggggaagaggaagactgacggtcctgccacagcggccctgggctgcctggtcaaggactacttccacgtctactgctgagcgggctggcaaggcgcatagnnnnnnnnnnnn

SEQ ID NO: 270745 - DNA, 574 bp, Homo sapiens
  misc_feature: GYAE6OF02GWEWU.44.27.C05.1.454.CMB.1.raw
  modified_base (225)..(225): a, c, t, g, unknown or other
  misc_feature (225)..(225): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcactgganccagcggtaatattcttagtcttaactttgtctcctggtatcaacatcatccaggtaaacgcccccaaatcatcatctatgagcctataagcggccctcgaggggtttctaagtcgcttcactcgcctccaagtccggcaacaccggcctccctgacaactcctcgtgggcctccgagggcctggaacgggacgaggtctagtatttattatttggttcgcttcgagtattgttcgtcgctattcctactttatcgttcttacgggaagtcgggacctagggttccaccggttctaggtaccacggacccgaaggaccccaacccgtatccgtacaccttcttaccccg

SEQ ID NO: 270746 - DNA, 712 bp, Homo sapiens
  misc_feature: GYAE6OF02IQ92E.44.27.C05.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (284)..(284): a, c, t, g, unknown or other
  misc_feature (284)..(284): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtcctgggtcncctggacngtcggtcaccatctcctgcactgganccagcggtaatnttcttagtcttaacttgctcctggtatcaacatcatcaaggtaaacncccccaaaactcactcatctaatgaggcctaataagacggtccctacaggggtttactaactcgcttcgacttcgcctccaagtccgactaacaccggtcctcctcgacgtaaactcctcgtcggtctacccgaggtcgtaggacggacggtacggctacgttaagttagtttaacgtttggttacgccttagtacgtaacgtttcggttaccgttcggtacctaacgtttaccgtaaccgttttaacgttcggtttacccgtttacgggtaaacggttacggggttaaacccggtaaacgggtttacccgtaacccgggtttacccgttaacgggttacccgtaaccggtaaccccgggtaaacccgaacccccgtaaaccccgtaccgtttacccggtacctaacccgttcccgtttaacccccgg

SEQ ID NO: 270747 - DNA, 683 bp, Homo sapiens
  misc_feature: GYAE6OF02H7PPU.44.27.C05.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacngtcggtcacatctcctgcacgtggacnccagcgtaatnttcttagtcttaacttgtcctctaggtatcaacatcactcgaaggtaaaccacccccaaactcatctatctatgacgtacctaagtaacggacgtcctacgtacgggttttactaacgtccgtcttacactcgtacctaccgaacgtcccggacaaaccgaccggtccctacctacgtacctaactcgttacgtcgggtctaccgacggctaggacggtacgacggtcttagtactttaattacgtttgttacgtctacgtagtagttcgttcgtacgtactacttactacgtttacgttacgttaccgttacgggaaacggttacgggaccctaacgggttcctaacccgggttccgtaacgggtaccaacccggtaacccgtaaacccggtaccccctaaacccggtaccgttacccgtaccgttacccttccgttaacccccg

SEQ ID NO: 270748 - DNA, 588 bp, Homo sapiens
  misc_feature: GYAE6OF02JLI19.44.27.C05.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagacagtatatacacgaccggtgctcgatttagacgcgatcgaagggtttgggggggtcgacgaagaggcagcgctctcgggacgtctccaccatggcctgggctctgctgctcctcactctcctcacccaggacacagggtcctgggcccagtctgccctgactcagcctgcctccgtgtctgggtcncctggacngtcggtcaccatctcctgcactggacnccagcggtaatattcttagtctttaactttgtccttcctggtactcaactattacattccgaaggtaaacacccccctaaatcactcatctatgacgtcctaagtaagcggtccctacgtaggggttttactaagtccgtcttcactgcctaccaagtccggacaacgcggccctccctagacatctcgtcgggcctccgaggctggaggacgaggctgatttattagttgtgtctcgagtattcgttcgcgtatactctacttgttcgttcgttacggaaggtcggacctaggttccaccgttctaggtaccacggtacccaacggtaccccaacccgtcgttagcctacgttcctacccg

SEQ ID NO: 270749 - DNA, 536 bp, Homo sapiens
  misc_feature: GYAE6OF02F3T1Q.44.27.C05.1.454.CMB.1.raw
  modified_base (362)..(362): a, c, t, g, unknown or other
  misc_feature (362)..(362): n is a, c, g, or t
  modified_base (421)..(421): a, c, t, g, unknown or other
  misc_feature (421)..(421): n is a, c, g, or t
tcagacagtatatacacgaccggtgctcgatttagacgcgatcgaagggtttgggggggggtcacaagaggcagcgctctcgggacgtctccaccgatggcctgggctctgctgctcctcactctcctcacccaggacacagggtcctgggcccagtctgccctgactcagcctgcctccgtgtctgggtcgcctggacagtcggtcaccatctcctgcactggagccagcgtaatattcttagtcttaacttgtctcctggtatcaacatcatccaggtaaagcccccaaatcatcatctatgaggcctataagaggcctcaggggtttctaatcgcttcactgcctcaagtccggcaacncggcctcctgacaatctctgggctccaggctgaggacgagctgattattattgttgctnagtattgttccgtcgcactcgtacttagtcgttcttcggaagtcgggaccaaggttccaccggttcctaggtcccagcccaaggcccaaacccgtctacgtcctactcttacccg

SEQ ID NO: 270750 - DNA, 571 bp, Homo sapiens
  misc_feature: GYAE6OF02JCZ12.44.27.C05.1.454.CMB.1.raw
  modified_base (286)..(286): a, c, t, g, unknown or other
  misc_feature (286)..(286): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (424)..(424): a, c, t, g, unknown or other
  misc_feature (424)..(424): n is a, c, g, or t
  modified_base (454)..(454): a, c, t, g, unknown or other
  misc_feature (454)..(454): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacncccccaaactcatcatctatgaggcctataagagccctcagggtttctaatcgcttcactgcctccaagtccggacacncgcctccngacatctctgggctccagctgaggacgaggctgatttattattgttgcttnagtattcggttcgtcgctactctaactttntcgttcttacgggtaacgttcgggaacctagggttccaacccggttcgtacgggtccaacggcccctaaagggccccctaaaccccgtacgttacgtcccgtaccttcgttaccccg

SEQ ID NO: 270751 - DNA, 652 bp, Homo sapiens
  misc_feature: GYAE6OF02H4UK8.44.27.C05.1.454.CMB.1.raw
  modified_base (191)..(191): a, c, t, g, unknown or other
  misc_feature (191)..(191): n is a, c, g, or t
  modified_base (308)..(308): a, c, t, g, unknown or other
  misc_feature (308)..(308): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaacttgtctctggtatcaacatcatccaggtaacgccccaaatcatcatctatgagctanagagcctgagggtttcaatcgcttcactcgcctcaagtccgacaacgacgcctcctgacaatctacgtcgggtctccgaggcctagacggacgaggtctaggtaatttatttattcggttgacttacgtagtaacgtgtttaccggtcgtacctaactccgttaaacttttaacgttcgttaccggtttaacgggtaaacggttcgggggaaaccctaacgggggttccctacccggtttaacccgtaacgggttacccgtaaccgggacccccgtaaacggggacccccctaaacccccgtaccggttacccggtttaacctcccgtttacccttaaccccgg

SEQ ID NO: 270752 - DNA, 587 bp, Homo sapiens
  misc_feature: GYAE6OF02HSWAV.44.27.C05.1.454.CMB.1.raw
  modified_base (286)..(286): a, c, t, g, unknown or other
  misc_feature (286)..(286): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacncccccaaactcatcatctatgaggcctaataagacggccctcgtagggtttctaatcgcttcactcgcctaccgaacgtccggacaacgaccggtccctccctcgaactactctcgtgggcctaccgagggctggacggacggaggtctgtaatttagttattgttncttcagtnttcggttcgtcgctatctactttatcgttcgtacggtaaggtcgggaaccgaggtccacccggttcgtacggtcaccgtcccgaacggccccaaccccgacttcggtacctaccgttccgttcccg

SEQ ID NO: 270753 - DNA, 258 bp, Homo sapiens
  misc_feature: GYAE6OF02F81FJ.44.27.C05.1.454.CMB.1.raw
  modified_base (255)..(258): a, c, t, g, unknown or other
  misc_feature (255)..(258): n is a, c, g, or t
tcagacagtatatacacgaccggtgctcgatttagacgcgatcgaagggtttggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnn

SEQ ID NO: 270754 - DNA, 513 bp, Homo sapiens
  misc_feature: GYAE6OF02FY79E.44.27.C05.1.454.CMB.1.raw
  modified_base (365)..(365): a, c, t, g, unknown or other
  misc_feature (365)..(365): n is a, c, g, or t
  modified_base (501)..(501): a, c, t, g, unknown or other
  misc_feature (501)..(501): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcactgcctcaagtccggcaacncggcctccctgacatctctgggctcaggctgaggacgagctgattattattgttgctcagtatgttcgtcgctatcacttatgtcttcggaagtcgggacctaggtcaccgtctaggtcagcccaaggcccacccntcgcactctccg

SEQ ID NO: 270755 - DNA, 588 bp, Homo sapiens
  misc_feature: GYAE6OF02HNLNM.44.27.C05.1.454.CMB.1.raw
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
tcagacagtatatacacgaccggtgctcgatttagacgcgatcgaagggtttggggggggtcacaagaggcagcgctctcgggacgtctccaccatggcctgggctctgctgctcctcaccctcctcactcagggcacaggatccctgggctcagtctgccctggctcagcctccctccgtgtccggtctcctggacagtcgatcaccatctcctgcattggaaccagcagtgacattggtgttataactatgtctcctgtaccaacaacaccaggacaaacgccccaaaatcatgacttcatgatgtcagtaatcgccctgagggtttcnggtcncttcntggctccagtctggccacacggcccttcccgtgtccgatccttcgtcggtccgtcggcctggacggacgaggtcgtgacttacttacgtgccggtctactaacgtttaacctacgttacgttgtacgtacgtttcgggttgtttccgggacggagggtacctcgtaccgtacggtaccgttccgtacggtccgacgtacccgaaggtcctaccggtcccccgttcgggtaccaccttcgttaccccg

SEQ ID NO: 270756 - DNA, 565 bp, Homo sapiens
  misc_feature: GYAE6OF02H957P.44.27.C05.1.454.CMB.1.raw
  modified_base (191)..(191): a, c, t, g, unknown or other
  misc_feature (191)..(191): n is a, c, g, or t
  modified_base (403)..(403): a, c, t, g, unknown or other
  misc_feature (403)..(403): n is a, c, g, or t
  modified_base (557)..(557): a, c, t, g, unknown or other
  misc_feature (557)..(557): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggacgccaggcggtaatattcttagtcttaactttgtctctggtatcaacatcatccaaggtaaacgcccccaaactcatcatctatgagcctatagacgcctcgtagggtttacatcgcttcactcgcctcaagtctacgccaacgccgtcctcctcgacctatccgtcgtcggctaccgngtctgaggacgaggctgtattattactgacagtctctataagtacgaaggtacggtaaacttactttacgttagttccggcgtacgagggaccacgtcgtacggaacccggttcctacggtccacgcccgaaggcccgtccgccccgtcgtccnccttcccg

SEQ ID NO: 270757 - DNA, 767 bp, Homo sapiens
  misc_feature: GYAE6OF02J16KL.44.27.C05.1.454.CMB.1.raw
  modified_base (179)..(179): a, c, t, g, unknown or other
  misc_feature (179)..(179): n is a, c, g, or t
  modified_base (188)..(188): a, c, t, g, unknown or other
  misc_feature (188)..(188): n is a, c, g, or t
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (282)..(282): a, c, t, g, unknown or other
  misc_feature (282)..(282): n is a, c, g, or t
tcagacagtatatacacgaccggtgctcgatttagacgcgatcgaagggtttgggggggtcacgaagaggcagcgctctcgggacgtctccaccatggcctgggctctgctgctcctcactctcctcacccaggacacaggtcctgggcccagtctgccctgactcagcctgcctcgtntctgggtcncctggacngtcggtcaccatcctcctgcactggagccagcggtaatnttcttagtcttaactttgctccttggtatcaacatcatcaggtaacncccaactcatacatctatgacgtctaataagacgcctacgtagggtttacaagtccgtcgttacactcgcctacctaacgtccggtacaaccgtaccggtccctacccgtacgtaaccctaaacctcgtaccgttacggggccctttacccggaacgggtccgttacgggaacgggtaacccgggtaggtaccggtttacggttaaacttttaccgttttaaggtttttaacggtttcgtaccgtttaccgtaaggttacgttttcggtttaaccgttcggtaccttaacgtttaccttaacgttttaacgttccggtttaccgttaacggggttaacggtttaccggggaaccccttaaggggttaccccgtttaacccggttcccgggtttaacggttaccgaacccgggttaccccggaaacggtaccccctaaccccggtaccttaacggtacccggtaccctttaccggtttacccccgg

SEQ ID NO: 270758 - DNA, 589 bp, Homo sapiens
  misc_feature: GYAE6OF02HSIU4.44.27.C05.1.454.CMB.1.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (319)..(319): a, c, t, g, unknown or other
  misc_feature (319)..(319): n is a, c, g, or t
  modified_base (476)..(476): a, c, t, g, unknown or other
  misc_feature (476)..(476): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatntttctagtcttaactttgctcctggtatcaacatcatccaagtaaacgcccccaaatcatcatctatgagtctatagagcctnagggtttcaatcgcttcactcgcctccaaagtccggacaaccaccggccctcccgtagactaaactctcgtcgggccttcgaggctggacggacgaggtctaggtacttattagtttaggtttgactcgagtagttgttcgtcgctatcctaacttnttgttcttacggaagttcgggaaccaggttcccgaaccggtcctaaggtcaccggacccctaaacgggcccccaaaccccgtagttccggtacctaccgtccctttaacccgg

SEQ ID NO: 270759 - DNA, 345 bp, Homo sapiens
  misc_feature: GYAE6OF02GGGKB.44.27.C05.1.454.CMB.1.raw
  modified_base (311)..(311): a, c, t, g, unknown or other
  misc_feature (311)..(311): n is a, c, g, or t
  modified_base (316)..(345): a, c, t, g, unknown or other
  misc_feature (316)..(345): n is a, c, g, or t
tcagacagtatatacacgaccggtgctcgatttagacgcgatcgaagggtttgggggggggtcacaagaggcagcgctctcgggacgtctccaccatggcctgggctctgctgctcctcacgtctcctcacccaggacacgagggtcctgggcccagtctgccctgactcagcctgcctccgtgtctgggtcgcctggacagtcggtcaccatctcctgcactggagccagcggtcagcccaaggcccaaccccactgtcactctgttccccgccctctctatactactgtctgagcgggctggcaaggcnatagnnnnnnnnnnnnnnnnnnnnnnnnnnnnnn

SEQ ID NO: 270760 - DNA, 561 bp, Homo sapiens
  misc_feature: GYAE6OF02GEHOB.44.27.C05.1.454.CMB.1.raw
  modified_base (244)..(244): a, c, t, g, unknown or other
  misc_feature (244)..(244): n is a, c, g, or t
  modified_base (398)..(398): a, c, t, g, unknown or other
  misc_feature (398)..(398): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgggtccagcaatgacattggganatataaccttgtctctggtatcaacaacatccaggacaaacgcccccaaactcatcatctatgagcctataagagccctgtagggtttctaagtcgtcttcactcgcctacacgtccgacaacaccgcctcctagacaatctcgtggcctccgnggtctggacggacgaggcctagtactttatttattggttgtctacagtacttggttctcgctatctactttgtcgttcgttaggaggttacggaccgtaaggtccgtacgttaccgtacggtccgaacgcccgaacgccccaaccccgtacgttcgacctccg

SEQ ID NO: 270761 - DNA, 828 bp, Homo sapiens
  misc_feature: GYAE6OF02IY6PH.44.27.C05.1.454.CMB.1.raw
tcagacagtatatacacgaccggtgctcgatttagacgcgatcgaagggtttggggagctctgagagaggagcccagccctgggattttcaggtgttttcatttggtgatcaggactgaacagagagaactcaccatggagtttgggctgaggtgggtctttttcttgtgactattttaaaaggtgtccagtgtgaggtggccctgttggagtctgggggaggattggcacagcctggggggtccctggagacgtctcctgtgcagcctctgcttcccttaggagtctatgccatgacctgggtccactaggcctccgaggggaacgggctcggagtcgggtctcgacaagttggcgtccgtagtcgactaaacgtggaacaccgtataaccgtacggtagaacggttccccgtaggaaaccgggggtcccacttttacccgaaccgtacttacccgtacccgaaggaacgtaaacctaacgttaaccccggaaaaccgtaccttaacccgttttttactaacgggtaaaactttacggaaacctaacggtacccttaggtaaccgtaacggttaaccgaaacgggtaaccgtaacccgggttaaccccgtttttaacgttttaccgttacggttacggtaacccggtaaaagggggtaccgggggggggttaacgtaccggggtaacggttaacccccggtaaagggtacgggggtttaacggggggttaacgggggtttcggggttttaaaccccgttaacccgggtttaccccgggttaccgggggggtaacccggttaaccgggggaccgggttacccccgggg

SEQ ID NO: 270762 - DNA, 523 bp, Homo sapiens
  misc_feature: GYAE6OF02GRCG1.44.27.C05.1.454.CMB.1.raw
  modified_base (363)..(363): a, c, t, g, unknown or other
  misc_feature (363)..(363): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (449)..(449): a, c, t, g, unknown or other
  misc_feature (449)..(449): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcactgcctcagtccgcaacncggctccctgacaatctctgggctccngctgaggacgnggctgattattattgttagctcagtattgttcgtcgctatcctatttntgttcgttcggaagtgggacctaggtcaccggttctaggtcacgcccgagcccacccatcgtcactcttacccg

SEQ ID NO: 270763 - DNA, 321 bp, Homo sapiens
  misc_feature: GYAE6OF02IYUW7.44.27.C05.1.454.CMB.1.raw
  modified_base (316)..(321): a, c, t, g, unknown or other
  misc_feature (316)..(321): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcacgtggagccagcggtcagcccaaggccaaccccatgtccactctgttccccgccctcctctatatactgtctgacgcggctggcaaggcgacatagnnnnnn

SEQ ID NO: 270764 - DNA, 623 bp, Homo sapiens
  misc_feature: GYAE6OF02GJJ2Z.44.27.C05.1.454.CMB.1.raw
  modified_base (184)..(184): a, c, t, g, unknown or other
  misc_feature (184)..(184): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
tcagacagtatatacacgaccggtgctcgattagacgcgatcgaagggtttgggttcacaagagcagcgctctcggacgtctccaccatggcctgggctctgctgctcctcactctcctcacccagtaccacagggttcctgggcccagtctgccctgactcagcctgcctccgtgtctggtcncctggacagtcggtcaccntcctccngccactggacgcccagcgtatcttctagtccttaacttgtctcctgtatcaacntcatccaggtaacncccccaactcatcatctatgagcctatacgacgtccctacgaggttcctaatccgctttcacttcgccctccaacgttcccggacaaacgccggccctcccctagacctactcctcgtgggcctccgaggctagaggacgagtccttgtactttagtatttcgtcgcctcagtactcgttacgcgtctaattcctaacgtttattcggtacctttacggggaacttcggggaaccctaacgggttaaccctccggtaaacggtccaaaccggaccccgtaaacgggccccctaaaacccccgtgttaccggtacccaaccgtttcccgtccggtttacccccccg

SEQ ID NO: 270765 - DNA, 160 bp, Homo sapiens
  misc_feature: GYAE6OF02H70RD.44.27.C05.1.454.CMB.1.raw
  modified_base (159)..(160): a, c, t, g, unknown or other
  misc_feature (159)..(160): n is a, c, g, or t
tcagacagtatatacacgaccggtgctcgatttagacgcgatcgaagggtttgggctgaccaaggtcaccgtcctaggtcagcccaaggccaaccccactgtcactctgttcccaccctcctctatatactgtctgagcgggctggcaaggcgcatagnn

SEQ ID NO: 270766 - DNA, 170 bp, Homo sapiens; identical to SEQ ID NO: 270535
  misc_feature: GYAE6OF02G3MC8.44.27.C05.1.454.CMB.1.raw
  modified_base (170)..(170): a, c, t, g, unknown or other
  misc_feature (170)..(170): n is a, c, g, or t

SEQ ID NO: 270767 - DNA, 559 bp, Homo sapiens
  misc_feature: GYAE6OF02HSJ6W.44.27.C05.1.454.CMB.1.raw
  modified_base (271)..(271): a, c, t, g, unknown or other
  misc_feature (271)..(271): n is a, c, g, or t
  modified_base (434)..(434): a, c, t, g, unknown or other
  misc_feature (434)..(434): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacntcatccaggtaacgcccccaaactcatcatctatgaggcctataagacggccctgagggtttctaatcgcttcactgcctcaacggtccgacaacgacggcctcctgacactctcgtgggcctccgaggctggaggacgaggctagtatttattagtttgttncttacagtacttggttcgtcgactatcctattatcgttcgttggaaggttgggacctaggttcaccggtcgtacggacacgacccaaggaccccaacccgcgttacgtcctaccgtcttacccgg

SEQ ID NO: 270768 - DNA, 579 bp, Homo sapiens
  misc_feature: GYAE6OF02IDHN4.44.27.C05.1.454.CMB.1.raw
  modified_base (231)..(231): a, c, t, g, unknown or other
  misc_feature (231)..(231): n is a, c, g, or t
  modified_base (304)..(304): a, c, t, g, unknown or other
  misc_feature (304)..(304): n is a, c, g, or t
  modified_base (446)..(446): a, c, t, g, unknown or other
  misc_feature (446)..(446): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
tcagacagtatatacacgaccggtgctcgatttagacgcgatcgaagggtttgggggggggtcacaagaggcagcgctctcgggacgtctccaccatggcctgggctctgctcctcctcaccctcctcactcagggcacaggatcctgggctcagtctgccctggctcagcctccctccgtgtcccgggtctcctggacagtcagtcaccatctcctgcactggaaccaanagtgacgtcggtcttttgaccgtgtctcctggtaccagcagaccccagaaacacgccccaaatcattatttangcggtcaatcgttcgccctttccggtctccctgagccgtcttctcgtcgggtaccaagtctggaccaaacgaccggtcccttccctagaccctatcttcgtcgggctcccgaggctgaggacgaggctagattattactgcngctacataatacaagtggaactacttactnttcgcganacgggaacagctagaccgtcgtaacgtcgacgacccgaaggacctccgtcccccgtacggtcctaccgttccgttccgttcccccgcccttaccc

SEQ ID NO: 270769 - DNA, 696 bp, Homo sapiens
  misc_feature: GYAE6OF02JBKF5.44.27.C05.1.454.CMB.1.raw
  modified_base (190)..(190): a, c, t, g, unknown or other
  misc_feature (190)..(190): n is a, c, g, or t
  modified_base (272)..(272): a, c, t, g, unknown or other
  misc_feature (272)..(272): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatcctcctgcacgtggacgccagccggtaatattctagtcttaactttgcttctggtatcaacntcatccagtaacgcccccaaatcatcatctatgagcctataagcgcctgtagggtttactaatcgtcttcacttcgcctaccgaagtcccggacaacgaccggtccctccctagaacctacttcctcgtcgggcctaccgaggtcgtggacggtacggaggtctagggttaactttagtttagttcggtttcgaccgttacgaaggttaacttggttttaacccgggtccgtacctacgtttccttaaaccgtttagtttccgtttaccggttacgggtaaagggttcccggggtaacccgttaacgggttaccgtaaccccgggttccgtttaaacgggtaccgaacccggttacccccgaaacgggaacccccctaaccccgtacgttaccgttaaccctaccgttcccgtttaacccccgg

SEQ ID NO: 270770 - DNA, 518 bp, Homo sapiens
  misc_feature: GYAE6OF02G32CS.44.27.C05.1.454.CMB.1.raw
  modified_base (191)..(191): a, c, t, g, unknown or other
  misc_feature (191)..(191): n is a, c, g, or t
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (424)..(424): a, c, t, g, unknown or other
  misc_feature (424)..(424): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccaggtaaacgcccccaaactcatcatctatgaggcctataagagccctcgagggtttctaagtcgcttcactgcctcaagtccgnaacatgcctcctnacatctcnggctcaggctgaggacgaggctgattattatgttgctcagtnttgtcgtcgcattcactttatgttcttcggagtcgggactaggtccacccgttctaggtcacgacccaacggcccaaccctctcgtcacttccg

SEQ ID NO: 270771 - DNA, 361 bp, Homo sapiens
  misc_feature: GYAE6OF02FT4R9.44.27.C05.1.454.CMB.1.raw
  modified_base (195)..(195): a, c, t, g, unknown or other
  misc_feature (195)..(195): n is a, c, g, or t
  modified_base (257)..(257): a, c, t, g, unknown or other
  misc_feature (257)..(257): n is a, c, g, or t
  modified_base (323)..(361): a, c, t, g, unknown or other
  misc_feature (323)..(361): n is a, c, g, or t
tcagacagtatatacacgaccggtgctcgatttagacgcgatcgaagggtttggggggggggtcacaagaggcagcgctctcgggacgtctccaccatggcctgggctctgctgctcctcactctcctcacccaggacacagggtcctgggcccagtctgccctgactcacgcctgcctccgtgtcgtggggtcncctggacagtcggtcaccatctcctgcactggagccagcggtcagcccaaggcccaaacccntgtcactctcgttaccccgccctcctctatatactgtctgagcgggctaggcaaggcgcaataggnnnnnnnnnnnnnnnnnnnnnnnnnnnnnnnnnnnnnnn

SEQ ID NO: 270772 - DNA, 321 bp, Homo sapiens
  misc_feature: GYAE6OF02J2FHV.44.27.C05.1.454.CMB.1.raw
  modified_base (190)..(190): a, c, t, g, unknown or other
  misc_feature (190)..(190): n is a, c, g, or t
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (311)..(321): a, c, t, g, unknown or other
  misc_feature (311)..(321): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacngtcggtcaccatctcctgcactgganccagcggtcacgcccaaggcccaacccntgtcactctcgtccccgcctctctatatactgtctgacgcgggctggcaaggcgcatgnnnnnnnnnnn

SEQ ID NO: 270773 - DNA, 323 bp, Homo sapiens
  misc_feature: GYAE6OF02F27QI.44.27.C05.1.454.CMB.1.raw
  modified_base (309)..(309): a, c, t, g, unknown or other
  misc_feature (309)..(309): n is a, c, g, or t
  modified_base (315)..(323): a, c, t, g, unknown or other
  misc_feature (315)..(323): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggcccaaccccatgtccacctctgttccccgcctcctctatatactgtctgagcgggctggcaaggcncatagnnnnnnnnn

SEQ ID NO: 270774 - DNA, 599 bp, Homo sapiens
  misc_feature: GYAE6OF02FYU1G.44.27.C05.1.454.CMB.1.raw
  modified_base (192)..(192): a, c, t, g, unknown or other
  misc_feature (192)..(192): n is a, c, g, or t
  modified_base (238)..(238): a, c, t, g, unknown or other
  misc_feature (238)..(238): n is a, c, g, or t
  modified_base (289)..(289): a, c, t, g, unknown or other
  misc_feature (289)..(289): n is a, c, g, or t
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
tcagacagtatatacacgaccggtgctcgatttagacgcgatcgaagggtttggggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggacgccagcgtaatnttcttagtcttaactttgtctcctggtatcaactatcatccaaggtaaacncccccaaatcatcatactatgagtcctataaggacgccctagtacgggttactagtcgtactcactcncctacacgtccgacacgcggcctccngacatctacgtggcctcgnggtctggacggacgtggctagtattattgttgttcgcttcgagttattcggttcgtccgtactcgttctactttagtcgtttacgttacgggtaagtaccgggtacctaagggttccccgacggtttccgaggttacccgacgtacccgtaaccgaccctaaccccgtgtaccggtaccctaccttccgttccccgg

SEQ ID NO: 270775 - DNA, 754 bp, Homo sapiens
  misc_feature: GYAE6OF02J2ZGM.44.27.C05.1.454.CMB.1.raw
  modified_base (191)..(191): a, c, t, g, unknown or other
  misc_feature (191)..(191): n is a, c, g, or t
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
tcagacagtatatacacgaccggtgctcgatttagacgcgatcgaagggtttgggggggtcgacgaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcacgtggacgccagtccggtaatattcgttagtcctttaactttgtcctcctggttactctaactactcactcctaaggtaaaccncccctaaatcaattcatctaatcgacgacctaanaacgcggtcctacgtaacgggtttctaagtccgcttaccactcgtaccctacgaaacggttcccgacaaaccgtaccggtccctacccgttagaacctaacttccttcggttacggccttaccgaggtcccttaacgggacggtacccgggtaagtcgttaacggtaacttttaacgttcgtttacggttacgttaccgtacgtaaacgttcgtttccggttttcggtaccgtacttaccgttccttaaccttttacgtttcggttaccgtttaaccggggaggttaccgggaacccgtttaggacccgttacccggttaaccgttaaggacccgtaacccggttaacccgtaaaccggtacccccttaaacccggtacctttaccggtacccttaccggtttccccttaaccccggg

SEQ ID NO: 270776 - DNA, 608 bp, Homo sapiens
  misc_feature: GYAE6OF02HYH8H.44.27.C05.1.454.CMB.1.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaactttgtctccttggtatcaacatcatccaggtaaacgcccccaaatcatcatctatgacgcctataagacgccctgagggtttactaatcgcttcactcgcctcaacgtccgacaacgcgcctcctgacactctctcggctcgagctgagcgagctagtattattattgttagcttacgtagtattcgttcgtccgactacgtactactttagttcgttaccgtttagggaacggttcggggaaaccctagggttacccgtaacccggttccgtaacgggtacctaaccggaccccgaaacgggtaccccctaaaccccgtaccgttcggtacccttacccgttaccgtttacccccg

SEQ ID NO: 270777 - DNA, 550 bp, Homo sapiens
  misc_feature: GYAE6OF02G8D4L.44.27.C05.1.454.CMB.1.raw
  modified_base (238)..(238): a, c, t, g, unknown or other
  misc_feature (238)..(238): n is a, c, g, or t
  modified_base (286)..(286): a, c, t, g, unknown or other
  misc_feature (286)..(286): n is a, c, g, or t
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcactggagccagcggtaatnttcttagtcttaactttgctcctggtatcaacatcatccaggtaaacncccccaaactcatcatctatgagctataagacgcctcgtagggttactaatcgcttcactcgcctcacgtccgcaacgacggcctcccgtgaaaaaacnctctcgtcgggctaccnggctgaggacgagctgtattattagttgttcgtctacagtatgttcgtcgctatctacttatgttcttacggaagtggaacctaggtctaccggtcgtacgtacaccgtcccgaacggacccaacccgactcgtactacctctacccg

SEQ ID NO: 270778 - DNA, 344 bp, Homo sapiens
  misc_feature: GYAE6OF02FMTGZ.44.27.C05.1.454.CMB.1.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
  modified_base (324)..(344): a, c, t, g, unknown or other
  misc_feature (324)..(344): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatcctcctgcactgganccagccggtcagcccaaggcccaaaccccatgtccaactctgttccccgaccctcctctatatacctgtctgacgcggntggcaaggcnctatagntnnnnnnnnnnnnnnnnnnnnn

SEQ ID NO: 270779 - DNA, 171 bp, Homo sapiens
  misc_feature: GYAE6OF02HADWC.44.27.C05.1.454.CMB.1.raw
  modified_base (154)..(171): a, c, t, g, unknown or other
  misc_feature (154)..(171): n is a, c, g, or t
tcagacagtatatacacgaccggtgctcgatttagacgcgatcgaagggtttgggggaagaggaagactgacggtcctgccacagcggccctgggctgcctggtcaaggactacttcctatatactgtctgagcgggctggcaaggcgcatagnnnnnnnnnnnnnnnnnn

SEQ ID NO: 270780 - DNA, 856 bp, Homo sapiens
  misc_feature: GYAE6OF02IWHA3.44.27.C05.1.454.CMB.1.raw
  modified_base (225)..(225): a, c, t, g, unknown or other
  misc_feature (225)..(225): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcatcctgcctccgtgtcgtggtcgcctggacagtcgtcaccatctcctgcactggacnccagcggtaattacttcttagtctttaactttcgtcctccttggtactacaacatcactacgaacggtaaaccgacccccctaaactcaactactattactagtaggacggtacctaaagtaacggtaccggtccccgttacggttaacggggttttaccttaacgttccgtaccttacctaccgtccgtacccttacccgaaacggtccccggtaaccgtaaacccgtacccggtcccctacccgtacgtaacctaacttcccgttaccggtccggggtacccttcccgggaacgggtccggttaacggggaacggggtaaccgggtaacggtaccgttaagttaacgtttttaagttttacggttttcggtttaccgtaccgttaacgttaaggttacgttttaccgggtttacccggtaccggttaccttaacctttactttaaccgttttacgtttaccggtttaaccggttaaccgggtaaacgggttaccggggtaaacccgtaccgggttacccgtacccgggttaccgtaaccggtaccgtaacccggtaaccccgtaaacccggacccccttaaaccccgtacgttacccgtacccgttacccgttaccccggttcccccgg

SEQ ID NO: 270781 - DNA, 561 bp, Homo sapiens
  misc_feature: GYAE6OF02IJUHN.44.27.C05.1.454.CMB.1.raw
  modified_base (410)..(410): a, c, t, g, unknown or other
  misc_feature (410)..(410): n is a, c, g, or t
tcagacagtatatacacgaccggtgctcgatttagacgcgatcgaagggtttggggtggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggacctgtcaccagtggtctacttttccctactggctccaacagaagcctggccaacgccccccaggacactaatttatgatataactattagacagtcctggacacctgcccgcttctcacgtcctccctccgttcggggaacaaacgcccgccctcgtaccctttcgagtcgcgcagcctgaggntgaggctgacttattactgtcttgcttctcctatagttggtatggatggttcggcggaggaccagtctacggaccgtccgtagtccacgcccgaaggcctccggccccgtcggtccacgttcctacgttccccacccgttcctctattacc

SEQ ID NO: 270782 - DNA, 652 bp, Homo sapiens
  misc_feature: GYAE6OF02IPONN.44.27.C05.1.454.CMB.1.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaacttgctctgtntcaacatcatccgaggtaacnccccctaaactcactcatctagtgacgcctaataacgacgccctgtacgggtttctaatcgcttcactcgcctaccacgtccgacaacaccggtcctccgcgaacactcncgtcggctccgagctggacggacgnggtctagtactttattagttgttctcttacgaagttatttcgggttaccgtcgattacttaccgttaacttttacgtacggtttacgttaacgggtaacgggtacgggtaacccgtaacgggttaccctaacccggttacccggttaacggtacccgaaccggtaaccccggaaaccggtacccccctaaaccccggtacgttacggtaccccttacccgttcgtttacccccgg

SEQ ID NO: 270783 - DNA, 646 bp, Homo sapiens
  misc_feature: GYAE6OF02G4I54.44.27.C05.1.454.CMB.1.raw
  modified_base (224)..(224): a, c, t, g, unknown or other
  misc_feature (224)..(224): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaggtaaacgcccccaaactcatcatctatgaggcctataagacgccctcgaggggtttctaagtcgtcttcactgcctccaagtccgcaacacgcctccctgaccaatctacgtggctccaggctggacggacgacggctaggtatttagttaagttgtttcgacttcgagtacgtttggtttaccgtccgtactacttaccgtaaccttttagtcggtttaccgtttacgggtaaaggttcggggaacccgtaacgggttcccgtaaccccggttccgttaccgggttacccgaaccggtacccccgtaaacggtaccccgtaaccccccgtacgtttacccggtacccgtaccttccgtttacccccg

SEQ ID NO: 270784 - DNA, 585 bp, Homo sapiens
  misc_feature: GYAE6OF02IAHQL.44.27.C05.1.454.CMB.1.raw
  modified_base (225)..(225): a, c, t, g, unknown or other
  misc_feature (225)..(225): n is a, c, g, or t
tcagacagtatatacacgaccggtgctcgatttagacgcgatcgaagggtttgggggggggtcacaagaggcagcgctctcgggacgtctccaccatggcatgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtactcaacatcatccaaggtaaacgcccccaaatcatcatctatgaggcctaataacgacggtccctgtagggtttctaactcgcttcacttgccctaccgaagtcccggacaaccgaccggtccctccctagacctaatccgtacgtgggccttccgaggcgtaggacggacgaggctagtaactttattatttgtgtactcgagtagttcggttcgcgctatctatttgtcgttcgttacggagtcggaccgtaacggtccgtaaccgttcctaggtccacgtacccgacgaccccaacccgtctcgtacctagttcccg

SEQ ID NO: 270785 - DNA, 548 bp, Homo sapiens
  misc_feature: GYAE6OF02ILFMO.44.27.C05.1.454.CMB.1.raw
  modified_base (192)..(192): a, c, t, g, unknown or other
  misc_feature (192)..(192): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
  modified_base (463)..(463): a, c, t, g, unknown or other
  misc_feature (463)..(463): n is a, c, g, or t
  modified_base (530)..(530): a, c, t, g, unknown or other
  misc_feature (530)..(530): n is a, c, g, or t
tcagacagtatatacacgaccggtgctcgatttagacgcgatcgaagggtttggggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctctggtatcaacntcatccagtaacnccccaaatcatcatctatgaggcctaataagcgccctgtagggtttctaatcgtcttcactgcctcaagtccgacaacacgcctccagactactctcgtcggctccgaggctggacggacgnggtctagtatttntttagttgttacgcttacagtattgttcgtctctatctaacttntgttcttaggaaggtcgaacctaggttccaccggttctacggtcacggacccaacggcccaaccctntcgtacctactcctcccg

SEQ ID NO: 270786 - DNA, 611 bp, Homo sapiens
  misc_feature: GYAE6OF02HCXRL.44.27.C05.1.454.CMB.1.raw
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (457)..(457): a, c, t, g, unknown or other
  misc_feature (457)..(457): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggaccacgagggtcctgggcccagtctgccctgactcagcctgcctccgtgtctgggtcgcctggacagtcggtcaccatcctcctgcactggagccagcggtaaatnttctagtcttaacttgctctgtatcaantcatcaggtaaacnccccaaatcatcatctatgagctanaacgagcctgagggtttcaagtcgtcttcacttgcctacaacgtcccggacaaaccgcggtcctaccgtagaaccaacttcctcgtaggcctccgaagtcgtaggagggacgtacggtcttagaatttacttagttcgttgctacagtnttacgttcgtcgactagttacctatttacgttgttacgtttaccggaaaggttccgggaaccgtaaggttcctaacccggttccgtaacggttcaacccggacccgtaacggccccaaacccgtcgttacgtaccttacgttcccttacccggg

SEQ ID NO: 270787 - DNA, 632 bp, Homo sapiens
  misc_feature: GYAE6OF02HIMXJ.44.27.C05.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
  modified_base (488)..(488): a, c, t, g, unknown or other
  misc_feature (488)..(488): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctcgtgtctgggtcgcctggacngtcggtcaccatcctcctgcactggacnccagcggtaatattcttagtcttaactttgtccttcctggttatcaacatcactccgaaggtaaaccacccccaaactcactcatctatgacggcctagtaagcggtcctacgtagggtttactaatcgcttcactcgcctccaagtccgacaacgcgtccctcctgacactctcgacgggcctccgaggtctgacgggacgcggtctaggatttactattggttnctgagtnttcgttcgtccgtactacttctacgtttnttcggttaccgttacgggaacgttcgggaaccgtaccgggttccgtaaccccggttccgttaacgggttaccaacccggtaaccccgaaccggacccctaaaccccgtccgttacggttacccctacggttaccccttaccccg

SEQ ID NO: 270788 - DNA, 522 bp, Homo sapiens
  misc_feature: GYAE6OF02HX6MD.44.27.C05.1.454.CMB.1.raw
  modified_base (285)..(285): a, c, t, g, unknown or other
  misc_feature (285)..(285): n is a, c, g, or t
  modified_base (505)..(505): a, c, t, g, unknown or other
  misc_feature (505)..(505): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaancccccaaatcatcatctatgaggcctaataagagccctcgagggtttctaatcgcttcactgcctcaagtccggacaacacggcctccctgacaatctctggctccgagctgaggacgagctgattattattgttgctcagtattcgttcgtcgcatcattatgttcttaggaagtcggacctaggtccaccgtctaggcacgcccaaggcccaaccctntcgtacctactcgtccg

SEQ ID NO: 270789 - DNA, 573 bp, Homo sapiens
  misc_feature: GYAE6OF02FW5JY.44.27.C05.1.454.CMB.1.raw
  modified_base (318)..(318): a, c, t, g, unknown or other
  misc_feature (318)..(318): n is a, c, g, or t
  modified_base (346)..(346): a, c, t, g, unknown or other
  misc_feature (346)..(346): n is a, c, g, or t
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
  modified_base (464)..(464): a, c, t, g, unknown or other
  misc_feature (464)..(464): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcactggacgccaggcgtaatattcttagtcttaactttgtcctcctggtatcaacatcatccaaggtaaacgcccccaaactcatcatctatgacgctanaagcgcctgtagggttctaatcgcttcnctgcctacgaagtccgacaacgccggcctccctagaactactcctcgtcggtcctaccgnggtctaggacggacgnggctagtattacttattgtgtactcgagtattcggttcgtcnctatctagttcttgtaccgttaggaaggtcgggaacctacggtccaccggttacgtaggtacaccgacccgaaggccccaacccgtctcggtacctccttccgtccccg

SEQ ID NO: 270790 - DNA, 607 bp, Homo sapiens
  misc_feature: GYAE6OF02JBKF9.44.27.C05.1.454.CMB.1.raw
  modified_base (232)..(232): a, c, t, g, unknown or other
  misc_feature (232)..(232): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcacgtcaccatcctcctgcactggaaccaanagtgacgttcggtcgtttgaccgtgtctcctgtacagcagaccccagaacacgacccccaaactctaattattatcgcgtacaattcgttccgtcccgttccggtcgttccctgtacgcgtcttctcgtcggtccaagtctggtacaacgacggcctccgtgaccatctcgtcggctccgagtctgaggacggacggtctagtattacgttacctgtactacgtctactatactacgaaggtacgtaaacctactttacgtacgtaccggacgccgacggtaacctaacgctagtacccgtacgtacggccgtacgacccgtaagccgtaccgcccccgttcggaccttacctccgttcgttaccccttaccccg

SEQ ID NO: 270791 - DNA, 720 bp, Homo sapiens
  misc_feature: GYAE6OF02G9WNL.44.27.C05.1.454.CMB.1.raw
  modified_base (290)..(290): a, c, t, g, unknown or other
  misc_feature (290)..(290): n is a, c, g, or t
tcagacagtatatacacgaccggtgctcgatttagacgcgatcgaagggtttggggggggtcacaagaggcagcgctcgtcgggacgtctccaccatggcctgggctctgctgctcctcaccctcctcactcagggcacaggatccgtgggctcagtctgccctggctcacgcctccctccgtgtccggtctcctgacagtcagtcacatctcctgcactagaaccacagtcgacgttcggttcgttttgccgttgtcctcctggtaccagcacgaaccccaagaaaccncgacccccaaactctaatttattaatcggtacggtactaagttcgttccgtcccgtttccggtacgtcccgtgacgtcgtcttacgtcgttggtcctaagtcgtaggaccaaccgtccggcccttacccgtcgtaaccctagtccttccgtcgtcccgtaccgacggtcctagggaacgggtaccgacggtaccgttagtaactttaacgttaccgtcgtcctacggtacttacgtattaaacgtaacgaaacggtacggtaaactttaaccgtttagttacgttaccggtaccgaccgtaaccgggtaacaaccggttacctaccggtacccgttacgtacgggttccaccggtacccgaacggtcccttcccgggacccccgttcgggtaccctacccgttccgtttaccccggttcccctacccccg

SEQ ID NO: 270792 - DNA, 571 bp, Homo sapiens
  misc_feature: GYAE6OF02JEO3L.44.27.C05.1.454.CMB.1.raw
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (318)..(318): a, c, t, g, unknown or other
  misc_feature (318)..(318): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattctagtcttaactttgctctgtatcacntcatccaggtaancccccaaatcatcatctatgaggcctataagcggccctntagggtttctaatcgcttcactgcctcaagtccggcaacncggcctccngacactctcgtcgggctccgaggcctggacggacgagggctaggtattagtttattggttcgccttcagtacttggtttccgtcgactactctacgtttagtcgttcgttacggaaggtcggaacctagggttccacccggttcgtacggttacacggacccctaaggaccccaaccctagtcgtaccctattcccgttcccgg

SEQ ID NO: 270793 - DNA, 323 bp, Homo sapiens
  misc_feature: GYAE6OF02FL2XI.44.27.C05.1.454.CMB.1.raw
  modified_base (312)..(312): a, c, t, g, unknown or other
  misc_feature (312)..(312): n is a, c, g, or t
  modified_base (319)..(323): a, c, t, g, unknown or other
  misc_feature (319)..(323): n is a, c, g, or t
tcagacagtatatacacgaccggtgctcgatttagacgcgatcgaagggtttggggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccaggcggtcacgcccaaggccccaaccccactgtccactctgttccccacctcctctatatactgtctgagcggctggcaaggcncagtagnnnnn

SEQ ID NO: 270794 - DNA, 626 bp, Homo sapiens
  misc_feature: GYAE6OF02HRE9U.44.27.C05.1.454.CMB.1.raw
  modified_base (311)..(311): a, c, t, g, unknown or other
  misc_feature (311)..(311): n is a, c, g, or t
  modified_base (468)..(468): a, c, t, g, unknown or other
  misc_feature (468)..(468): n is a, c, g, or t
tcagacagtatatacacgaccggtgctcgatttagacgcgatcgaagggtttggggagctctgagagaggagcccagcccctgggattttcaggtgttttcatttggtgatcaggactgaacagagagaactcaccatggagtttgggctgaggtggctttttcttgtgactattttaaaaggtgtccagtgtgaggtggccctgttggagtctgggggaggattggcacagccgtggggggtccctggagactctcctgtgcagcctctggcttcccccttttaggagctatgccatgacctgggtcccnccgaggctccaggggaggggctcggagtgggtctcgacaattggcgcctagtgcacgtcacgacatactacggaggacgtaccgtcggaagggccggctccacactcctccaagacgacaattaccggaaacactacttttctagtaagtacgaacngacctgagaggtaccgagaacgaccggacccttttactttagttcgtggacgagggtaacggggggggaggttcggacggtccgaacgtaggtacggggttggggtcggttcgtaacgttccccggtaggggtacccgggagggtacggtcccccggg

SEQ ID NO: 270795 - DNA, 804 bp, Homo sapiens
  misc_feature: GYAE6OF02F48CF.44.27.C05.1.454.CMB.1.raw
  modified_base (240)..(240): a, c, t, g, unknown or other
  misc_feature (240)..(240): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggaccagtcggtcaccatctcctgcacgtggacgccagccggtaatnttcttagtcttaatttgtcctcctggtactcaacattacattccaacggtaaaacgccccccaaactcactacactactatgaacggcctagtaaagacggccccttcgtaacggggttttactaagttccgtacttaccactcgaccctacctaaacggttcccggtaacaaaccgaccgggtaccccttaccccgtaggaacctaaaccgttcccttacggttacgggggtacccttcccggtaacgggtacccgttaggggaaaccgggtaaccgggtaacgggtccctttaagggtaaatttttaagtttaaccggttttacggttcggttaccttaccgtaaggttacgttcggtttaccggtcggtacctacgtttacctaacttttaggttaccgttacggtttacccggttaagggttaccggggtaaacccgtaacgggttccgtaaccccgggtttcccggttaagggtcccctaacgggacccccgtaaaccggggtccccctaaaccccggttacggtaccttacccgtacgtttccccgtttacccccggg

SEQ ID NO: 270796 - DNA, 797 bp, Homo sapiens
  misc_feature: GYAE6OF02HYK33.44.27.C05.1.454.CMB.1.raw
  modified_base (552)..(552): a, c, t, g, unknown or other
  misc_feature (552)..(552): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctcgccctgactcagcctgcctccgtgtcgtgggtccgcctggacaggtcggtcaccatcctcctgcacgtggacgccaggtacggtaattactttccttagttactttaacttttcgtcttccgttaggttactaccaaactacgttacactaccgtaaggtaaaacccgaccccccctaaaatccaacttacctaacttacctaagtcggacggtaccttaagtaacggaccggtccccgttaggttacggggttttactaacgttccgtcctttaccacttccgaccctaccgtaacggttcccggaccgaaaaccgccggtaccccttccgttaacgaaccttaacttccgtacgtcgggtacccttcgacggtcgtagggacggtaccggngtacttacgtaatttagttagttcgttcgacttagagtacgttcgtttcgacctacgttactcccgtttaatttacgttcgtttaaccgggttaagggtaacggttacggggtaaccccgttaacggttaccccgtaacccggtttaccgttaccggggttacctaacccggtaaccccgtaacccgggtaccccctaacccggttaccttaaccggttcctacccctttccgtttaaccccccg

SEQ ID NO: 270797 - DNA, 785 bp, Homo sapiens
  misc_feature: GYAE6OF02GS1HV.44.27.C05.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacngtcggtcacctatcctcctgacctacgtggacgcccaggtcggtaaattctttcgttagtacctttaacttttcggtccttccgttaggttaacttaccaaactactacctaacttaccgtaacgggtaaaacccgaccccccaaaacttcctaacttacctacttaccttagtacggtacggaccttaagtaaacgtacggtcccttacggtaacggggtttttacctaagttccgtactttaccgaccgttcgtacccttaccgtaacggttcccgaacgtaaaccgaccggaccccgttccctacgaacctaacgttccgtacgtcgggtcccttacccgacggtctacgggaagggtaccgtacggtacctaggttaacttaacgttacgtgtaccgtagtcccgtaccggtagtacggggacggtacctaacccgtttagtacgggttacttttacggtccggtttaccggtacggggacggtaaccgtacgtacggtcgtaacccggttccgtacggttccgaaccggaccccgtagtacccgtccgtccccgttggtacccttccgtcccgttaccccg

SEQ ID NO: 270798 - DNA, 950 bp, Homo sapiens
  misc_feature: GYAE6OF02IZUA6.44.27.C05.1.454.CMB.1.raw
tcagacagtatatacacgaccggtgctcgatttagacgcgatcgaagggtttggggagctctgagagaggagcccagccctgggattttcaggtgttttcatttggtgatcaggactgaacagagagaactcaccatggagtttgggctgaggtgtctttttcttgtgacttattttaaaaggtgtccagtgtgaggtggccctgttggagtcgtgggggaggattggcacagccgtcgggggtcccgtgagactctcctgtgcacgcctctcggtcctttccccgtttaggacgtcttagtcgaccatcgaccgtcgggtcccgcccgacggtccgtaccgagggggaacgggggtcgtaccgggtaacgggttcggggttccgtaccggtaacgtaaacgtttcgggccggtccgttaacggtacggaccctaaaccgttacggaaacccgtaaaccgtaaactttaaccggtaaacggggtaaacggtaaaccgggttacccgggttacggggaaaccggggtacccggttcccgtttacccgtaaacccctaccgttaccccgtttacccggaaacgggtaaacccggtaaacccgttaaaaccggtttaaccccgggaaaaaccctaaacccttttaaacccgtttttttaccgttaaacgggttaaaaacgttacggtaaaacccgtaacggtccccgttaggaaacggtaacggttaacggtaaaccggaaacccgttaaccgggttaccccgttttttaacttttacccgtttagggttaccgggtaacgggaaacgggggggtacgggggggggttaccggtacgggtaacggtaaccccggtaacggtagggggttcggggttagggggtttccggtttacgggtacccggtttccgggtaccgggggtacccgggtacggggtacccggttaccccggg

SEQ ID NO: 270799 - DNA, 322 bp, Homo sapiens
  misc_feature: GYAE6OF02HQI63.44.27.C05.1.454.CMB.1.raw
  modified_base (308)..(308): a, c, t, g, unknown or other
  misc_feature (308)..(308): n is a, c, g, or t
  modified_base (314)..(322): a, c, t, g, unknown or other
  misc_feature (314)..(322): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcactggagccagcggtcacgcccaaggccaaccccatgtcactctcgttccccacctcctctatatactgtctgagcgggctggcaggcncatagnnnnnnnnn

SEQ ID NO: 270800 - DNA, 608 bp, Homo sapiens
  misc_feature: GYAE6OF02GBU6Q.44.27.C05.1.454.CMB.1.raw
  modified_base (225)..(225): a, c, t, g, unknown or other
  misc_feature (225)..(225): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgctcctggtatcaacatcatccaggtaaacgcccccaaactcatcatctatgaggcctataagacgccctcgaggggtttctaatctcttcactcgcctccaagtccggcaaccacggccctccctagaccaatcctcgtcgggtcctccgaggtctggacggacggacggcttagtaatttatttagtttgttgcttacgagtatttcggttcgtcgactacttctaactttagtcgttacttacgggtaagttcgggtaaccgtaacgggttcctacccggttcgttacggtaccaccggtacccgtaacggaccccaaccccgtacgttcgtacctacctccgttaccccg

SEQ ID NO: 270801 - DNA, 560 bp, Homo sapiens
  misc_feature: GYAE6OF02FJKXP.44.27.C05.1.454.CMB.1.raw
  modified_base (325)..(325): a, c, t, g, unknown or other
  misc_feature (325)..(325): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggacgccagcggtaatattcttagtcttaactttgtctcctggtatcaacatcatccaggtaaacgcccccaaatcatcatctatgacgctataagcggccctnaggggtttctaagtcgcttcactgcctcaagtccggnaacncgcctccngacatctcgtggctccaggctggaggacgaggctgattagttattgtnctnagtatgttcgcntactctacttagttgtcgttacggtagtacgggaacctaggtaccgtaccgttacgtaggtccaacggtacccaacgggtaccccaacccgtaacgttccggacctaccttccgttaccccgg

SEQ ID NO: 270802 - DNA, 667 bp, Homo sapiens
  misc_feature: GYAE6OF02ITO0Z.44.27.C05.1.454.CMB.1.raw
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcactggacgccagcggtaatattcttagtacttaactttgtcctcctggtatcaacatcatccaaggtaaacgacccccaaactcatcatctatggacggtcctaataacggacgccctacgtacggggtttactaatcgtcttcactcgcctaccaagtcgtaggacaaccgaccggtccctccctcgacccattcctcgtcgggtccctccgaggtctagggacggaacggaggtcgttaggtaactttaacgttacgtacggtcctacggtccttactaagttaacgtaaacgtaacgggttacgggtaaaccttaacgttttaacgtaaccgtttccgggacgtacggtaccgggaacctacgtaccgtaccggtaccgttaccgtacggtaccgaccgacccgacggtccttacccggccccgtaacggtccacccgtttcccg

SEQ ID NO: 270803 - DNA, 570 bp, Homo sapiens
  misc_feature: GYAE6OF02F7XE6.44.27.C05.1.454.CMB.1.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (285)..(285): a, c, t, g, unknown or other
  misc_feature (285)..(285): n is a, c, g, or t
  modified_base (373)..(373): a, c, t, g, unknown or other
  misc_feature (373)..(373): n is a, c, g, or t
  modified_base (442)..(442): a, c, t, g, unknown or other
  misc_feature (442)..(442): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaactttgtctcctgtatcaacatcatccaaggtaaacncccccaaactcatcatctatgagcctataagcgcctcgtagggttctaatcgcttcactcgcctaccagtccgacaacgccgcctccngacatctcgtcggcctcgagtcgtaggacggacgaggctagtaatttattacgtttgttgcttcgagtnttcggttcgtcgctactctacttgttcgttcgttacggtaaggtcgggaacctaggtcctaccggttcgtacggtaccgaccgacccgaacggccccaaccctgtacgtacctacgttccgttccccg

SEQ ID NO: 270804 - DNA, 762 bp, Homo sapiens
  misc_feature: GYAE6OF02ILM7D.44.27.C05.1.454.CMB.1.raw
  modified_base (191)..(191): a, c, t, g, unknown or other
  misc_feature (191)..(191): n is a, c, g, or t
  modified_base (395)..(395): a, c, t, g, unknown or other
  misc_feature (395)..(395): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggacgccaggcggtaatattcttagtcttaactttgcttcctggtactacaacatcaatccgagtaaacgcccccaaatcatcatctatgaggtcctataagacgcctacgtagggtttctaatcgtctcgactgccttacgaacgtccgacaacgtaccggcccttacccgtntaacgaacttccgacgtcgggtacctaccgacggtaccgtaggtacgggacggtaacggtcgttacgttaattttagtttaacgtttcgtttacggtaccttccggttaaggtacgttttccgggtttaccggtcggtaacccttacgtttaacccgttaaggttttaccgtttacgggtttacccggttttaagggtaaaccgggttaccgggggttaaaccctaaaccggggttccgtttaaacccgggttccccggtttaaccgggtacccgttaaacccgggtaccccgtaaaacccggggacccccttaaaccccctagggtttacccgtaaccgttaccccttccggttttaaccccccgg

SEQ ID NO: 270805 - DNA, 666 bp, Homo sapiens
  misc_feature: GYAE6OF02JHXO6.44.27.C05.1.454.CMB.1.raw
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
tcagacagtatatacacgaccggtgctcgatttagacgcgatcgaagggtttggggggggtcacaagaggcagcgctctcgggacgtctccaccatggcctgggctctgctgctcctcactctcctcacccaggacacaggtcctggccagtctgacctgactcagtcctgcctcgtgtctgggtcnctgacngtcggtcacactcgtcctgcatggactccagtacggttaattacttcttagttacttaactttgacctctgtactcaacatccattcgaacggtaaacgaccccctaaactcagtcctattcctaatcgtacgacctaagtaacggacgcctgttaccgggtttactactccgtcttacacgtcgcctacgaacgttccggcaacgaccggtccgtccctacgaaccttaagtccgtttcgtcgggtactaccgacggtacgtcggacgggtacggacgtctagttaactaagtttcgttgttcgtactacgagtaagttcgttacgtcgtacacgttactattacgtcgtttaccggttaaacggacgggttacgggaacctaacggttcccgtaccggttaaccggtacgacggtacccaacccggtaaacgtccccaaacccgttcggtctaccctcgttacccttcccg

SEQ ID NO: 270806 - DNA, 426 bp, Homo sapiens
  misc_feature: GYAE6OF02H0UG8.44.27.C05.1.454.CMB.1.raw
  modified_base (264)..(264): a, c, t, g, unknown or other
  misc_feature (264)..(264): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
  modified_base (368)..(426): a, c, t, g, unknown or other
  misc_feature (368)..(426): n is a, c, g, or t
tcagacagtatatacacgaccggtgctcgatttagacgcgatcgaagggtttggggggggggtcacaagaggcagcgctctcgggacgtctccaccatggcctgggctctgctgctccctcactctcctcacccaggacacagggtcctgggcccagtctgccctgactcagcctgcctccgtgtctggtcgcctggacaggtcggtcaccatcctcctgcaccgtggacgccagtccggtcacgccccaaggccccaaccccngtcgtcacctctcgtttccccgccccttctcctaatactaccgttgtcccaggacgtccgggggcttggggacaaacgggtccgcaagtaagtgnacnacngcnnnnnnnnnnnnnnnnnnnnnnnnnnnnnnnnnnnnnnnnnnnnnnnnnnnnnnnnnnn

SEQ ID NO: 270807 - DNA, 687 bp, Homo sapiens
  misc_feature: GYAE6OF02FK986.44.27.C05.1.454.CMB.1.raw
tcagacagtatatacacgaccggtgctcgatttagacgcgatcgaagggtttggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtcgtgggggaggattggcacagccgtggggggtccctgacgactctcctgtgcagcctctcggtcctttccccgtttaggacgtctatcgccatcgaccgtcggggtcccgccgaggcctccgaggggaacggggctcggaggtgggtctcgacaagttggcgctagtgcaactgacacatacacggagacgtcgtaggaacgggccgtcttcaccatcctaccagacgactaacgttaccggaaactacttacctttttacgtaggtaaactacgaacgacgtccgtagacggtaacgtacggaaacgaccgtaccggttacccttttatttccgtagtcggacggtaagggggacgggggggtacgtacgggtacgtacccgaacggtacggggttgggggttacggggttacgggttaccgttaacccggttccggttacgggggacccggtacgggggtacccggtacccggg

SEQ ID NO: 270808 - DNA, 796 bp, Homo sapiens
  misc_feature: GYAE6OF02HYUD2.44.27.C05.1.454.CMB.1.raw
  modified_base (709)..(709): a, c, t, g, unknown or other
  misc_feature (709)..(709): n is a, c, g, or t
tcagacagtatatacacgaccggtgctcgatttagacgcgatcgaagggtttgggagcgtcgtgagacgaggagcccagacccgtgggagttttcgtacggtgtttttcgagtttggtgaagtccaaggactagaaaccaaggaaggaacgtaacctaccaacctaagtgggtaggtttcgggcgtggtagggtttcggtcttttttcgttgttacgttaagttaagtttttaaaaaggtcgtccgtagttgtaggaggtcggacccttggttgggagttcggtggggggaaggtagttgggccaacgacggtccgggtcgggggttccctaggagacgtcctccgtggtgacgacgtccttcgttcggtccgttttaccccgtttaaggtcgtacgttaacgttcggcctaagtccgaccgtcgggtcccgacccgacggtaccgtaccgaacgggggaagggcctacggaggttcggggtccgtacgggaaccgtaagttcggtcgtccgttaaggtgaccgtaacgtagacgtaactacgtaaacgttacggaagtacgtcccggtaaggaacccgggtccgtacgttaccgaccgtaacttccgaccgagtacgaacgtaacgtaccgaaactactacgttttacgagtaaactacgtaactacgtacgtagacgagtacaaagccgtaacgtcccttagttcgngtacgagtaacgaggggactggacgacgaggtacggtagggtaggtacggttacgaacgttccgtacgggcgtaggtaccgtaccgg

SEQ ID NO: 270809 - DNA, 757 bp, Homo sapiens
  misc_feature: GYAE6OF02JSA91.44.27.C05.1.454.CMB.1.raw
  modified_base (141)..(141): a, c, t, g, unknown or other
  misc_feature (141)..(141): n is a, c, g, or t
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
tcagacagtatatacacgaccggtgctcgatttagacgcgatcgaagggtttgggggggggtcgacgaagaggcgagcgctctcgggacgtctccaccatggcctgggctcgtgctgctcctcactctcctcacccagacncagggtcctgggcccagtctgccctgacctcagcctgccctccgtgtcgtcgggtcgccgtacggacacggtccggtccacctagtcctccgtagcacgtcggacgccagacggtaatacttcttaggttacttacgtttgtacttcctggtatcaactntacatacctaaggtaaacgaccccctaaactnaactactatacctatcgtaacgtaccgtaagtaacccgtaggacccggtttcaaacggggttttcaaacgtttcactttcgaaccttcgacctttccgaattaccgggcctaaccgtaccggtcctaccccgtaagtacccaacttcggtctaccggggactcccgtaacggtccggttaccgaaagggtcccgtaaaggcgtttaagtactttacgttaagtttcttcgtaacgtctaaaggttcgtaccgttcgttacggtaccaacgtttacccacgttttaattcgggttaacgttaccgggtaagtacggggaccctaagggtttaccctaaacggggttccctaaacgggttccaacgggtaaccccctaacgggcccttaaaccgtcccttaacggtcccgtacgttccccttaccg

SEQ ID NO: 270810 - DNA, 507 bp, Homo sapiens
  misc_feature: GYAE6OF02IAREM.44.27.C05.1.454.CMB.1.raw
  modified_base (237)..(237): a, c, t, g, unknown or other
  misc_feature (237)..(237): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (493)..(493): a, c, t, g, unknown or other
  misc_feature (493)..(493): n is a, c, g, or t
tcagacagtatatacacgaccggtgctcgatttagacgcgatcgaagggtttggggggggggtcacaagaggcagcgctctcgggacgtctccaccatggcctgggctctgctgctcctcactctcctcacccaggacacagggtcctgggcccagtctgccctgactcagcctgcctccgtgtctgggtcgctggacagtcggtcaccatctcctgcactggagccagcggtaatnttctagtcttaacttgtctctggtatcaacatcatccaggtaaacnccccaatcatcatctangagcctanaagacggcctgagggtttactaatcgtcttcactgcctacaacgtccgacaacncggcctccctagacaactctcgtggctcgagcngagacgngctagtattattattgtanctnagtntgttcncgctatcattangttcgtcgaagtcggacagtcacgtcaggcacgaccaagcccaaccntcgctacgtctccg

SEQ ID NO: 270811 - DNA, 552 bp, Homo sapiens
  misc_feature: GYAE6OF02GQZOZ.44.27.C05.1.454.CMB.1.raw
  modified_base (191)..(191): a, c, t, g, unknown or other
  misc_feature (191)..(191): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctctgcactggancagcggtaanttctagtcttaacttgtctctgtatcacatcatccgagtaacgccccaaactcatcatctangcgactanaagtacgcctcgtagggttctaagtcncttcnctcgcctcgaagtccgcaacncgcctcctnacatctcgtggctccnggctacgaggacgagctgtacttattgttagttctcgtacgagtcgtcttcgtcgtactactcgtacttagttcgttacgtacggtagtcgacccgtacgtccgtaccgtcgttacggtcgaacgtccccaaggtaacccctacccgacttacgtaccaccttcgtacccg

SEQ ID NO: 270812 - DNA, 724 bp, Homo sapiens
  misc_feature: GYAE6OF02GOGWC.44.27.C05.1.454.CMB.1.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (269)..(269): a, c, t, g, unknown or other
  misc_feature (269)..(269): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagccctgcctccgtgtctgggtcgcctggacagtcggtcaccatctcctgcactggacnccagcgtaatnttcttagtcttaacttgtctctgtatcaacntcatccaggtaaacgccccaaactcatacatactatgaacgacctaagtaaacggacggcccctaggtacggggttttacctaactccggtaccttacacgtcgtcccttaaccgaaggtcccggacctaaaccgtaccggtccccttacccgtagaacctaacgttccttacgtcgggacctcccggaaggtcgtaggacggggacgaggaccgttagttaacgtttatttagtttggtcgtcttacgaggtagtttcggtttaccgtcgtacgttacttaccgttaacgtttttacgtacggtttcgttacgggaaaacgggttcggggaaacctacggggtttaccctaacccgggtttccggttaacgggcctaaacccggggttccccaaaaccgggtccccccaaaccccttacggttaccgtaaccctacccggtttcccttaccccg

SEQ ID NO: 270813 - DNA, 636 bp, Homo sapiens
  misc_feature: GYAE6OF02FOIOY.44.27.C05.1.454.CMB.1.raw
  modified_base (225)..(225): a, c, t, g, unknown or other
  misc_feature (225)..(225): n is a, c, g, or t
tcagacagtatatacacgaccggtgctcgatttagacgcgatcgaagggtttgggggggggtcacaaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctctgcactgganccagcgtaatattctagtcttaactttgtctcctgtatcaacatcatccaggtaaacgcccccaaactcatcatctatgagcctaataagcgcctcgtacgggtttctaatccgcttcactcgcctaccaacgtcccggacaccgaccggtccctcccgtagaacctaattcctccgtcgggtcctcggaggccgttaggacgggacgaggtaccgttagaacttttagtttaatttggttcgacttcgtaacgtgtttgggttacgtcgtctaacgttcttaacctttagttccgttacgtttaccggaagggttaacggtaaccgtaacgtccgtacccggttccgtacggtcccaacggtaccccgaaggacccctaacccgtactcggtacctactcccttacccgg

SEQ ID NO: 270814 - DNA, 668 bp, Homo sapiens
  misc_feature: GYAE6OF02H8KR8.44.27.C05.1.454.CMB.1.raw
  modified_base (148)..(148): a, c, t, g, unknown or other
  misc_feature (148)..(148): n is a, c, g, or t
  modified_base (181)..(181): a, c, t, g, unknown or other
  misc_feature (181)..(181): n is a, c, g, or t
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (365)..(365): a, c, t, g, unknown or other
  misc_feature (365)..(365): n is a, c, g, or t
  modified_base (527)..(527): a, c, t, g, unknown or other
  misc_feature (527)..(527): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacgagggtccngggcccagtctgcctgactcagcctgcctccgngtcgtggtccnctgacnggtcgcacntcctctgcncgtagganccagcgtaatnttcttagtcttattgctctggtatacaacatacactacgtaagaaacaccccaaatcataccatactaagtcgaacgtcctaagaagaccggtccctaggtaaggtttaccaatccgtacttcaacgtcncgtactaacggccgaacaaaccgcggtccctcacgaaactacacgtcgtcgtacgtacgtagacgtaggaacggcggtagtacgttagtaatttataggttacgttgaccttataggttaatccggttactccggtaactacttaacgtacttaaccggttnttacccggtaaaggtaaacggttccgggaaacttaaccggttaacccacggtttaaccgtaaccgggttaccaacgttaaaccccggaaccggtcccctaaaaccgtaccgttacggacccttacgtacccgttaccccgg

SEQ ID NO: 270815 - DNA, 658 bp, Homo sapiens
  misc_feature: GYAE6OF02HELAT.44.27.C05.1.454.CMB.1.raw
  modified_base (216)..(216): a, c, t, g, unknown or other
  misc_feature (216)..(216): n is a, c, g, or t
  modified_base (352)..(352): a, c, t, g, unknown or other
  misc_feature (352)..(352): n is a, c, g, or t
tcagacagtatatacacgaccggtgctcgatttagacgcgatcgaagggtttgggggaagaggaagactgacggtcctcccaggagttcaggtgctgggcaccttgggcacgggggaggtgtgtcacaagatttgggctctgggcaccgtgggcatgggggagtgtgtcacaagatttggactcctgtgccccacatggacactctttgctacacnctcctgctgctgacccacccttctgggtcttgcccaggttcaccttgaaggtacgtctggtcctgtgctggtacgaacccacagacgaccctcacgcctgacctgccaccatcctctcgggttctctctcgaactntaattagaacttggggtagttcggagcgtacggtactccggtacgtacgcccccgtaaggggaaccggtcccgttagggacgtggccttcgccgtaacaccatccttacgtacgaagttcgaaacgtaaaacgtccctaacgtacgtaacactctactagtaagtacgacgttaagtttaacccagttaccgtaccgtaaacgggtacctaacccgtaccgtaaacggtaccggtaggtaccggtttacgttaagtacgttacgtaacctaacgtacgtaccggtacccgttacggccggtaaccg

SEQ ID NO: 270816 - DNA, 624 bp, Homo sapiens
  misc_feature: GYAE6OF02I2EO6.44.27.C05.1.454.CMB.1.raw
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (310)..(310): a, c, t, g, unknown or other
  misc_feature (310)..(310): n is a, c, g, or t
tcagacagtatatacacgaccggtgctcgatttagacgcgatcgaagggtttggggggggggtcacaagaggcagcgctctcgggacgtctccaccatggcctgggctctgctgctcctcactctcctcacccaggacacagggtcctgggcccagtctgccctgactcagcctgcctcgtgtctggtcncctggacagtcggtcaccatctcctgcactggacnccagcgtaatacttcttagtcttaactttgtctcctaggtatcaactatcatccaaggtaacgaccccaactcactacatactangacgtactataacgcgtccctagtacgggtttactaatcgtcttcactcgcctacaacgtccgaccaacaccggtcctacctcgaacaatcctcgtacggctccgaggctaggacggacgtaggcgtagtaactttagttagttgttacgcctagagttacttcggttacgtcgtacgtactacgttatttagttcgttaccgttacgggtaagtcgggtaaccgtacgtacccgttaccggtcgtacggttaccgaccgtacccgaaccgtacccctaacccgtattaccgtaccgtccttaccgttaccccg

SEQ ID NO: 270817 - DNA, 666 bp, Homo sapiens
  misc_feature: GYAE6OF02GPR7Z.44.27.C05.1.454.CMB.1.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgccactgganccagcggtaatnttcttagtcttaactttgtctcctggtactcaacatcatccagtaaacgcccccaaactcatcatctatgacgtcctataagcgccctgtacgggtttctaatcgcttccactcgcctccgaacgtccggacaacgacgtccctacccgtgaacctaacttcctcgtcgggcctaccgaggtccgtaggaacgggacgagggtcttaggtaacttttacgtttagtttcgttagcctttcgaagttacggttcgtttaccgtcgtactacttacctaactttagtttccgttacggtttacgggaagttaccgggaaccgtacggttacccgtaacccggttcgttaaccgggtaccaacccggtaaccccgaaccggtaccccaaccccctacgttaccgtacccttacccgttcctttaacccccg

SEQ ID NO: 270818 - DNA, 624 bp, Homo sapiens
  misc_feature: GYAE6OF02FOUZ4.44.27.C05.1.454.CMB.1.raw
  modified_base (192)..(192): a, c, t, g, unknown or other
  misc_feature (192)..(192): n is a, c, g, or t
  modified_base (287)..(287): a, c, t, g, unknown or other
  misc_feature (287)..(287): n is a, c, g, or t
tcagacagtatatacacgaccggtgctcgatttagacgcgatcgaagggtttggggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcagtggacgccagacgtaatattcttagtcttaactttgtctcctggtatcaacatcatccaggtaacncccaactcatcatctatgacgactaataagcgcctacgtacgggtttactacgtcgtcttcgcgtcgcctaccgaacgtcccgacgaaccgccgtcctccctagactacttctcgtcgggcctaccgaggctggacggacgacggtctagtattactttgtttagtcgtacttcgagttgttacggttcgtacgactattaccttaacgtttgtacgttcgttaaacgggacgtacggggtaactacggtacccgtacccggttacgtacgggtacccaacggtaccccgaaccggtaccccaaccctccgttacgtccctaccgttcgttaccccg

SEQ ID NO: 270819 - DNA, 660 bp, Homo sapiens
  misc_feature: GYAE6OF02FT9J3.44.27.C05.1.454.CMB.1.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (271)..(271): a, c, t, g, unknown or other
  misc_feature (271)..(271): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctctncactgganccagcggtaatattcttagtcttaactttgtcttcctggtatcaacntacactaccgaaggtaaacgacccccaaactcactcatctatgacgacctaagtaagacggtccgtggtagggtttactaagtcgtcttacactcgcctacgtacgtcccgacaaccgtaccggtcccttcccgtgttacgtacttcctcgtacgggtccgtcccgccgtggacggagacggtctacgtacttacgtacgtcggtccgcttactaactttactaccgtttgttacgtagttacggtttagggttcgggttcgggacgggtaacggtacctacgttacccgtggtacccgttacgtacgtccgaacggtacccggaaccggtccgttccccgccccgttcggtaccctccgtccgtttccccgttacccctacccgtacc

SEQ ID NO: 270820 - DNA, 702 bp, Homo sapiens
  misc_feature: GYAE6OF02G0KA9.44.27.C05.1.454.CMB.1.raw
tcagacagtatatacacgaccggtgctcgatttagacgcgatcgaagggtttggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtcgtgggggaggattggcacagccgtggggggtccctgagacgtctcctgtgcagcctctgtccgttccccttaggagctatgccatgacctcgggtccgccgaggctccgagggagggccgtcgaggtggtcgtcgacgaagttggcgcgtagcgcaactcgaacacaatacgaaggacgtacgtaccggtgaacgggtcccgtactttaccgaccactcctaccgaaggaacgaaccgtaacgttaacccggaaaacctaaccttaacccgttttttacgtaaacgggttaaatacggtaaacacggtacccgtaggacggtaacggtacgaaacggtaccgtaccggtacctttttacgttacgttgttacggacggtaagggggacggggggtacgtaggacggtacccgaaggtacgggttggggttacgggttcgggttaccgtacggttccggtacggggtaccggacggggtaccgtacccggg

SEQ ID NO: 270821 - DNA, 705 bp, Homo sapiens
  misc_feature: GYAE6OF02JSH95.44.27.C05.1.454.CMB.1.raw
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcactggagccagcgtaatattcttagtcttaactttgtctcctggtatcaacatcactcctaggtaacnccccaaactcatcatcttancgaggtacctaagtaaggacgcccttagtacggggtttactaactcgtctttcaacttcgtaccctccgaacgttcccggactaaaccgccggtccctccttacggaacctaacgttcccgtacgttcggggaccttacccggaggtccgttaggacgggtaccggtaggcgttagtaacttttaattggtttcgttgaccttacgaagttactttcggttcggttaccgtagttacccgttacgtaacttttcggttacgtttaacggtttaccgggaagtttaccggggaaccgtacgttaccggtaacccggtcggttaaccggacgtacccgacccgtaaacgggtccccttaacccgacgttcccggttaacctaccgttccgtttaccccgg

SEQ ID NO: 270822 - DNA, 971 bp, Homo sapiens
  misc_feature: GYAE6OF02HOT18.44.27.C05.1.454.CMB.1.raw
  modified_base (182)..(182): a, c, t, g, unknown or other
  misc_feature (182)..(182): n is a, c, g, or t
  modified_base (241)..(241): a, c, t, g, unknown or other
  misc_feature (241)..(241): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctcgccctgactcagcctgcctcgtntcgtggtcgcctgacagtcggtcaccatctctgctacgtggacgccaggtacggtaatntttaccgttagttactttaacgtttgtccttccgttaggtataccaactactcacgtaccgtaacggtaaacccaccccctaaactcactactacttactagtacgacgtacctaagtacggaccggtcccttaggttaacgggttttacctaacgttccggtaccttttacccgaaccgttcccggtaccccttaacccggtaaaccgggttccccggaaaccaaaaaccccggttccccggtacccccttaccccgtaacggaaacccgtttaacgttccccttttacggggttcccgggtaccccgtttacccgggtaaacggggttacccgttaacggggaaccggggtaaaccgggtacgggttaccgttagggtttaaacgtttttacgttttaacggtttcgggtttaccgttaccgttaacgggttaacgtttacgttttccgggtttaacccggttacccgttacttaaacccgtttaccttaacccgttttaacggtttccgggtttaaaccgggtttaaccgggttaaacggggtttaacccggggtaaacccgggttaaacccgggttaccccgggttttaccccgggttaacggttaacccgggtaaccccgtaaaccccggttaacccccgggtaaaacccgtaccccccgttaaacccccggttacgttaccccgggtaaccgtttaccccggtttccccgtttaaccccccggg

SEQ ID NO: 270823 - DNA, 706 bp, Homo sapiens
  misc_feature: GYAE6OF02HRWLG.44.27.C05.1.454.CMB.1.raw
  modified_base (217)..(217): a, c, t, g, unknown or other
  misc_feature (217)..(217): n is a, c, g, or t
  modified_base (262)..(262): a, c, t, g, unknown or other
  misc_feature (262)..(262): n is a, c, g, or t
  modified_base (288)..(288): a, c, t, g, unknown or other
  misc_feature (288)..(288): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
tcagacagtatatacacgaccggtgctcgatttagacgcgatcgaagggtttggggggggggtcacaagaggcagcgctctcgggacgtctccaccatggcctgggctctgctgctcctcactctcctcacccaggacacgagggtcctgggccccagtctcgccctgactcagcctgcctccgtgtcgtgggtcgcctggacaggtcggtcacctntcctcctgcacgtcggacgccaggacggttaatatttcttagttntttaacttgtctcctggtatacaatntacactcaacggtaaacaccccctaaactcctactctatactagtcgaacggtacctaagtaacggaccgtcctacggtagggttctaacgtctctcnctcncctacgacgtccgacaaccgaccgtcctaccgtacgaactacgtccgtcgtccggtacctccgtacggtacgtacggacgggaccggacggtcgttagtaaacttttgtttaacggtttcggttcttcgtaggttaacttcggttacggtttcgtaccgtacgtactaccttacgtttacgttcggttaaccggtttcgggaacgggttacgggtaccgaacgggttaccctacccgggttaacggtccggttaccgacccgacccggaaccgtaccccaacccgttcgtccgtaacctccgtccgtttacccccg

SEQ ID NO: 270824 - DNA, 852 bp, Homo sapiens
  misc_feature: GYAE6OF02I5WS6.44.27.C05.1.454.CMB.1.raw
  modified_base (246)..(246): a, c, t, g, unknown or other
  misc_feature (246)..(246): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacgagggtcctgggccccagtctgcccctagacctcgacgccttgcccttccgtgtccgtgggtcgcctaggacagtccggtcaaccatccttcctgacaccgtagganacccgagtacggttaaattagttccgttaacgttactttaaactttcgaccttcctaggttactaccaaactacttaccacgtacctaaacggtaaaccgaaccccctaaactcctaatacctaactactagtacgacggtactaagtaacggacgtacccgtaggttaacgggtttacctaagttaccgtacttaccactacgtacccgtaccaacggtacccgactaacgaacccggtccctacccgtaacgtaaccgtaacttccgtaccgttacggggtccctaacccgggaggtacctaacgggacgggttaaacgggacgaccgttaagtaaccgttttagtttaaccggtttagtacccgtaacgtttacgaacgtttacgtaccgttaccggttacctattaaaccgtcgtttaaacgtttacgtttaccgggttaacgtttaacgggtaaaccggttacgggtaaacccgtacgggttaacccttaaccgggttaccggtttaaccggtacccggtaaccctaaacccggttaaccccggaacccgaaacccgtttaacgtaccggtaaccccttaagttccccgtttaacccccgg

SEQ ID NO: 270825 - DNA, 713 bp, Homo sapiens
  misc_feature: GYAE6OF02HO0G4.44.27.C05.1.454.CMB.1.raw
  modified_base (224)..(224): a, c, t, g, unknown or other
  misc_feature (224)..(224): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtctggtcgcctggacagtcggtcaccatcctctgcactgganccagtcggtaatattcttagtcttaactttgtcttccgtggtatacaacatcatccgaaggtaacgacccccaaatcatcatctagtagacgtacctaagaagaccggcccttacgtagggtttactaacgtcgtcttactaccgtcgtaccgtaccgtaacgtcccggacgtaaaccgaccggtccctacccgtacgtaactacgttcgtccggtacgggccttaccgacgggtcgtaacggacgggtaacgtacggtacgttaggtaacttttaacgttagtttgttaccgtacgttacgtaagttacgttacgggtttccgtacgtacttacgtacctaacgtttacgttcgttacggttaacggaacgggttcgggaaccgttacggtaccgtacccggttaacgtacggttaccgaacccgtaccccgaaaccggtaccccctaaacccgtcgttaaccgtacctaccgttacccgttaccccg

SEQ ID NO: 270826 - DNA, 710 bp, Homo sapiens
  misc_feature: GYAE6OF02FS470.44.27.C05.1.454.CMB.1.raw
  modified_base (416)..(416): a, c, t, g, unknown or other
  misc_feature (416)..(416): n is a, c, g, or t
  modified_base (464)..(464): a, c, t, g, unknown or other
  misc_feature (464)..(464): n is a, c, g, or t
tcagacagtatatacacgaccggtgctcgatttagacgcgatcgaagggtttggggggggggtcacaagaggcagcgctctcgggacgtctccaccatggcctgggctctgctgctcctcactctcctccacccaggacacagggtcctgggcccagtctgccctgactcagcctgcctccgtgtctgggtcgcctggacagtcggtcaccatctctgcactggacgccagcggtaatattcttagtcttactttgtctcgtgtatcaactatcactaccgaaggtaaaccgacccccctaaactcataccattctaagtcggacgtacctaagtaagtaccgtccgttacggtacgggttttactaactcgtcttctactcgccttacgacgtccgacaccgaccggcctcctanacctactcctcgtgggccctacgaggtcgtaggacggacgacggtacngttactttaagttttcgttagttcgtacttcgtacgttattttccgggtacgttcgtaccttacgttacttacgttttacctcggtttaaccgtttacggggtaaaggttaccgggtaacccgttacgggttccccgaaccggtttccccgtaagggttacccaacccgggtaaccccgtaaaccggaccccccgttaaacccttccgtacggttccccggttaaccttcccggtttaccccccgg

SEQ ID NO: 270827 - DNA, 848 bp, Homo sapiens
  misc_feature: GYAE6OF02G8UWW.44.27.C05.1.454.CMB.1.raw
  modified_base (226)..(226): a, c, t, g, unknown or other
  misc_feature (226)..(226): n is a, c, g, or t
  modified_base (285)..(285): a, c, t, g, unknown or other
  misc_feature (285)..(285): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacgagggtcctgggcccagtctgccctgactcagcctcctccgcgtccggtctcttggacagtcagtcacatctcctgcactgaaccanagtgacgtcggttcgtttgaccgttgctccgtggtaccagtcacgaccccaagaaaccncgacccccaaagtcattattagtcgacggtactaatcgttccgacccgttcggtcgtccctgtacggtcgtcctttcgtcgtacgggtacctaaggttcctacgggtccaaaccgtccgggtacccctttccccgtacgtaaccctactttacccgtcgggttaccggtccctttacccggacgggttaccgttacgggaaccggtaacggtacgggttcccgttaaggttaacgttttaaccgtttacctaggtacccgtacgtaccgttacgttaacgttaaccgttaaacggaaaccgggttttacggtaaaaccttttacccgggtttaaactttaacccgggtttccggggtaacccgtaccgggtaaacccggggttaacctaaaccgggttaaccttacccgggttaaccccggttaaccgtttacgggaccctaaccgggaacccccgtaagggtaccccggtttacccggtacccccggtttacggttaaccccggtacctttaccccggtttccccgggttaaccccctacccccggttaacctttaacccgg

SEQ ID NO: 270828 - DNA, 787 bp, Homo sapiens
  misc_feature: GYAE6OF02GEZ8L.44.27.C05.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (256)..(256): a, c, t, g, unknown or other
  misc_feature (256)..(256): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacgagggtcctggcccagtctcgccctgactcagcctgccttccgtgtcctgggtcncctaggacacgtcggtccaacctatcttccngcacgtggacgaccgtaaggtcgttaaattntttacgtacgttacttttaacgttcgtactaccgtaggtaactacaactatacgactaccaaggttaaaaccaccccgtaatacaactactaatctaacgtgtaacggaccttaaagtaacgacgtacccttacggtaagggtttaacctatacgtaccgtttacaacgtacggcctaccggtaacggttaccggaacgaaccggtaacgccccgttacctaacgtaacgaattcccgtacgtacggtccaccggtgtaccgagacgggtactacgtgtataacgtttatttaggttaacgtcgtaactacggtaattacggttagggtttaccctacgtaaccttgtttaaccctaggtttttacgtaccgggtttaacgtacgggttaaacgggttacggaaaccccgggttatttaccccggacccgtttggaaccggtacccgaaacccgggttaccccggtaaacggaaccccctaaccccgggttaactaccgtttaccgtaacccggtttacccttacccccgg

SEQ ID NO: 270829 - DNA, 802 bp, Homo sapiens
  misc_feature: GYAE6OF02J3EEW.44.27.C05.1.454.CMB.1.raw
  modified_base (174)..(174): a, c, t, g, unknown or other
  misc_feature (174)..(174): n is a, c, g, or t
  modified_base (195)..(195): a, c, t, g, unknown or other
  misc_feature (195)..(195): n is a, c, g, or t
tcagacagtatatacacgaccggtgctcgatttagacgcgatcgaagggtttgggggggtcacaagaggcagcgctctcgggacgtctccgaccagtggcctgggctctgctgctcctcactctcctcacccaggacacgagggtccctgggccctagtctcgaccctgactcngcctgcctcgtgtcgtggtcncctggacagtcgtacaccgattcctcgtgacctacgtcggatcccaggtacggtaacttgtttaccgtttaggttcccttttaacttttcgacccgttccttaggtaacttacaacctacttacgaacctaccgtaaggtaaacccccgacccctaaatacctactctaacttcgtaagttcgaacggttactacgttaacgggcctcccgtaggttaccgtttactaacgttccgtacctttacgacctccgtacccgttaccggaaccgggttaccgaaccgtacccggtaccgccccttaccgttaaccgacttacgtccgacgttccggacctccgacgtcggtacgacggacggtacgtacgttagttacgttaagttcgttcgttcaacgttaacgttctacggtttcgtaccgtacggttactagtttaacctttaccgttacgtttaccggcggtttaaaccgggaacggttaccggggtaactaccccggttaccggtaccgttaaccgtacggtacccgtaaccccggtacccgaaccggttaccccccgaaaccgttcgttaacccgtccgttaacccgttccccgtttaaccccg

SEQ ID NO: 270830 - DNA, 755 bp, Homo sapiens
  misc_feature: GYAE6OF02HQYUP.44.27.C05.1.454.CMB.1.raw
  modified_base (232)..(232): a, c, t, g, unknown or other
  misc_feature (232)..(232): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacgaggtcctgggcccagtctgccctgactcagcctgccctccgtgtctgggtcgccgtggacagtcggtccacctatcctcctgcacgtggacnccagacggtaaattattcttagttactttaacttttgtccttccgttaggttactaccaactactacaactaccgaaggtaaacccgacccccctaaaatacctaactacctactacttaagtacggaacggtaccttaagtaaacggaccgggtacccttacggttaagggtttacctaacgttccgtacttactaccgttccgacccgtaccgaaccggtacccggaaccgaaaccgacccggtcccctccctagaacctaacttccgtcgtcgggacctaccggtaggccgtaaggacgggtacgacggtacttacgtagtttagttagttggttacacgttacgagtacgtttcgttcgtccgtacgtacttacctagtttacgtttacgttcggttacggaagggttccggaaccgtacggttccctaccggttaccgtaaggtaccaacccgggtaccccgaaccggtacccctaaccccgtacgttcccggtacccttacgttcccgttaccccgg

SEQ ID NO: 270831 - DNA, 703 bp, Homo sapiens
  misc_feature: GYAE6OF02HESTJ.44.27.C05.1.454.CMB.1.raw
tcagacagtatatacacgaccggtgctcgatttagacgcgatcgaagggtttggggagctctgagagaggagcccagccctgggattttcaggtgttttcatttggtgatcaggactgaacagagagaactcaccatggagtttgggctgaggtggtctttttcttgtgtacttaatttttaaaaggtgtccagtgtgaggtggccctgttggagtcgtgggggaggattggcgacgacgccgtgggggtccctgagactcctcctgtgcacgccgtcgtcggtccttccccgtttagggacgtctacgtcgacctatcgccgtcgggtcccgtaccgacggccgtaccggagggacggggtacgtcggtacggtcgggtcgtcgtacgtaagtttcggaccgtccgtaggtacgacgtaactcggaactacgtactacgtacggagtacgtccggtaaggtaccgggcctacgtttccaccgtacgtcctacgagaacgaactaacgttaccgaaacacgtttaactttacacggttaaactacgaactagtacctaggacggtaagtaaccggaaccgtacgtacccgttacctttaacgttcgtagttcgggaaacgtaggggtacggggtacacgggtacgtccgaagttcgggtaggttcggtcgtacgtacgtcggcggtacggaggtcgtacccgg

SEQ ID NO: 270832 - DNA, 823 bp, Homo sapiens
  misc_feature: GYAE6OF02IIXHU.44.27.C05.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (660)..(660): a, c, t, g, unknown or other
  misc_feature (660)..(660): n is a, c, g, or t
tcagacagtatatacacgaccggtgctcgatttagacgcgatcgaagggtttggggggggtcacaagaggcagcgctctcgggacgtctccacatggcctgggctctgctgctacctcactcgtccctcacccaggacacaggggtccctagggcccagtctgccctgactcgagtcctgcctccgtagtcctgggtcncctgggacctagtcgtccgtaccntctcctgactcgtaggacccgtagtaccggtaattcttcgtttactacctttaacttttcgcccttccgtggttactccgaaacctagttcgattacccgtaaggtaacccgtacccccctaaatctaacgttccctattacgttaacctcgggtaaccgtacctttaaacgaacgcccgggtaaccccgtttggtaaccggggtttttaccctaaacgttaccccggttcttaacgaccgttaccgtccccgtaacgtaacccggtcccggacctaaacgggtaccccggtcccttacccgggtataaccttacggttcccgttccgacgggttccctaccggtaacgggttccaacgggtaggaaccggtcgttacgtacgtactttagttagtttccggtatccgttaccggacttacgttccggttacccgtntacccgttaactccgttaagttccggtttaacgttcggtttaaccgggtaacggttggaaaccgtttaccgacggttacccgttaccggttagtaaccgttcccccggaaacgtttaccccgcccaacccgttcgtaccggttccaccgtttaccgttacccc

SEQ ID NO: 270833 - DNA, 852 bp, Homo sapiens
  misc_feature: GYAE6OF02I2D4F.44.27.C05.1.454.CMB.1.raw
  modified_base (223)..(223): a, c, t, g, unknown or other
  misc_feature (223)..(223): n is a, c, g, or t
tcagacagtatatacacgaccggtgctcgatttagacgcgatcgaagggtttggggggggggtcacaagaggcagcgctctcgggacgtctccaccatggcctgggctctgctgcctcctcactctcctcacccaggacacagggtcctgggcccagtctcgccctgacctcacgcctgcctcggtgtcgtgggtcgcctggacagtcggtcaccatcctccngccacgtggacaccgagacggtaattagttcttagttacttaactttcgtcctcgttggtactacaacatcactacgaacgtaaccgaccccaactcatacacttactagtaggacgtactaagtaacggtaccggtcccgttacggttacggggttttactaacgtccgttacttaccgtacgttcgtacccgttaaccgaaccggttcccggaaccgtaaccggtacccggtcccgttaccctacgaacctaaaccgtcccgttaccgggttcgggcccctaccggtacgggtaccgttaacggggacgggtaccggacgggtaccgttaaggttaacgttttaacgttttacggtttacggtttacccgtcgtttacgtaacggtttaccggtttacgggtttacccggttactaccgttaacgtttaccgttaaacgttttcgttaccggtttaaccgggttaccgggttaaacgggttaaccgggaaccccggttaacggttcccccggttaacgggttacccggttaaccgggtaccaaccccgggtaacccgtaaccccgggaaccccttaaaccccggtaccgttaccccggtacttacccccggtttccgttaacccccg

SEQ ID NO: 270834 - DNA, 647 bp, Homo sapiens
  misc_feature: GYAE6OF02GTWZ7.44.27.C05.1.454.CMB.1.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (272)..(272): a, c, t, g, unknown or other
  misc_feature (272)..(272): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggaccacagggtcctgggcccagtctgccctgacctcagcctgcctccgtgtctgggtcgcctggacagtcggtcaccatcctctgcactggacnccagcggtaatnttctagtcttaatttgcttcctgtactcaacntcataccaggtaaacgcccccaaatcatcatctatgacgctataacgcgtccctagtagggtttctaatccgcttcactcgcctcgacgtccgacaacgcgcctcctagacaattccacgtcgggacctcgaggtctaggacggacgacgtctaagtactttaagtttactttcgttacgtcctacgtaggttacgtttcgtttccggtacgtcctaacttacctaacgttttagtcgggtttaacctttacggggaaggttaccgggtaaccgtaacggttcccgacccggtttaccggtacggtaccgtaaccgtccccgaaaccggaccccttaaaccccgtcggttcctaccctacgttcccttaccccgg

SEQ ID NO: 270835 - DNA, 685 bp, Homo sapiens
  misc_feature: GYAE6OF02GO7X5.44.27.C05.1.454.CMB.1.raw
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (292)..(292): a, c, t, g, unknown or other
  misc_feature (292)..(292): n is a, c, g, or t
  modified_base (532)..(532): a, c, t, g, unknown or other
  misc_feature (532)..(532): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacagggtcctgggcccagtctgccctgactcagcctgcctccgtgtcgtgggtcncctggacngtccggtcaccatctccngccactggacnccagacgtaatnttcttagtcttattgctctgtatcaacatcatcgagtaacgcccaactcancatctatcgagacctatacgacgccctagtacgggtttactaacgtcgcttcacttcgacctaccaacgtccgacaacgaccggtcctccgtcgaactaactccttacgcggtccgtaccgacggtcgtacgggaacggtaccgggacggtacgttaggttaaccttttaagttttaagtttcggttcgtacttacgacgttaggtttcgttaccgtacgtactacgttacgtacttttnttacgtttcgttaacgggtaacgtaccggggtaacgtaaccggttaccctacccggttaacccgttacgggtaaccgtacccggttaacccgaaccggtaccccctaacccgtaaccgttaccgtacccgttaccgttaccgtttcccccggg

SEQ ID NO: 270836 - DNA, 812 bp, Homo sapiens
  misc_feature: GYAE6OF02IG0SX.44.27.C05.1.454.CMB.1.raw
  modified_base (141)..(141): a, c, t, g, unknown or other
  misc_feature (141)..(141): n is a, c, g, or t
  modified_base (194)..(194): a, c, t, g, unknown or other
  misc_feature (194)..(194): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacgngggtcctgggccctagtctgccctgactcagcctgcctccgtgtcgtgggtcnccgtggacaggtccggtcaccagtcctccgtgccacgtacggaaaccacgagtcggaccgttcggttcgttttcggaccgttgtcctcgtcggtaccagccacgaccccaagaaaccaccgaacccccaaactcctaatttactttagtcggtaccgttactaaagtttcgttccgtccccgtttccggtcgttcccgtgacgtccgttcgttcgtcgtacgggtcctaacggttcgtacggtaccaaccgtacccggtcccttacccgtcgaccgtacgtccgtcggtccgggtacctccggacggtacgtacgggaacggtaccggacggtcgtagttaaactttacgttaccgtcgtactaaccggttcctagtaacgttaaactaacggtaaacggtacggttaaacgttaacctttaaccgttacggtacgggtaccgtaacggtaaccgggtaaacccgtaacggtccgttaaccggtaacccggttaccgttaacgggtacccggtaaccgacccggtaaacggtccccggttaccccggtacccccggttccggtacccgttcccgttacccggtttaccccggtccccccgttaccccgtttaaccccg

SEQ ID NO: 270837 - DNA, 766 bp, Homo sapiens
  misc_feature: GYAE6OF02IC0OQ.44.27.C05.1.454.CMB.1.raw
tcagacagtatatacacgaccggtgctcgatttagacgcgatcgaaggggttgggggggggtcacaagaggcagcgctcgtcgggacgtctccaccatggcctgggctctgctgctcctcactctctcaccaggacacgacggtcctcgggccagtctcgcctgactcacgcctggcctccgtcgtcgtcgggtcgccgtagactacggtcggtcacctactccgtcctacgcaccggttacggacgtccgtaggtacggttaaacttacttagttacgttactttaaccgtttcgtcctttcgtcggttataccgaactatctactaccgtaaacggtaaaccgacccctaaaactcaactcgtaactctaacggtacgacggttactaacgtaacgacgtaccgtaggtacgggtttacaacgtcgtcttctaacgctctacgacgtaccgacaacgaccgtctccgtatacgatcctacgtgtacgaccgagcgtggacggacggtaggcctaagtacttagttagttcgtctacgtcgtaaagttcgttacgttcgtaccgtaccgttaccgttaacctttaaccgttggttaacggtttacgtaaccggggttaaacggtaaccggggtaaaccgtttacggtaaccccggtttaccggtaccggtttaaccggtaaacccggaacccgtaccccggaaaaccggtaccctaacccccggtacgtaccgtaacccgtttaccgttacccgtttaacccccg

SEQ ID NO: 270838 - DNA, 892 bp, Homo sapiens
  misc_feature: GYAE6OF02FFSMU.44.27.C05.1.454.CMB.1.raw
  modified_base (197)..(197): a, c, t, g, unknown or other
  misc_feature (197)..(197): n is a, c, g, or t
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggacacgagggtcctggacccagtctcgccctgactcgacgcctgcctccggtgtcgtgggtcnctggacaggtcgtacactatctccgtgctacgtggacgccagtacgtaatnttcttagtcctttaacttgtccttcgtggtactcaactntacgtactaccgaacggtaaaccgacccctaaagttctatacttaatttacgtatagttgtactaacggttacgtccggtaccgtacggtaccggggttccctggtaaccttccgtacgttccgtacggtcggtaccttaaccggtaacgtcccggtacggacctaaaccggtcccggtacccgttccgttacggtacccgtttcgtaccgggttacggtcccgtaccggtagggtacccgttaggggtaaaccggttacgtacgggtacggttacgttaacggttaccgttttaacgtttacccggttaccgtaccccgtttacgtaacgttaaccggttaacgtccgggtaacgtaaacccggggtaccgttttaaacgggtttaacgggtttttaccgacggttttaacccgggttaaccgggaaacggggtttaacccggtaaccggttaacccggttaccccgggttaacccgtttaacccggttaacccgggtaacccggttaacccgggttaaacccccggttaacccgggtaaacccccctttaaacccggttcccggttttaacccggtacccgttaccccggttttaaccccggg

SEQ ID NO: 270839 - DNA, 764 bp, Homo sapiens
  misc_feature: GYAE6OF02F1KRO.44.27.C05.1.454.CMB.1.raw
  modified_base (124)..(124): a, c, t, g, unknown or other
  misc_feature (124)..(124): n is a, c, g, or t
  modified_base (744)..(744): a, c, t, g, unknown or other
  misc_feature (744)..(744): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactcncctcacccgaggacacgacgggtcctgggcccagtcgtgccctagaactcgacgccttgcctaccggtgtacgtcgggtccactggacacggtccggtcaacctatccgtcctagacgtacgttcgggaccaggtacctaatggtaactaggttgggaataacttacgtaaccgttcggtactacgttaggtaactacgaaactactacgtaccgacgaacgaaccgaccccctaaagtaccactactactacgttacgacggtacgtacgtaagaaaccgtcggaccttacgggtacggtttactaactcggtcttacaacgttcaccgttaccggaagtacccgacgaaaccggtccgtaacccgtcccgtaacgtaacctaaccgttcgttccggtaccggtacgtacggaccggtttaggaccggggtaactagggaccgttacgtaacggttacttagggttacgttacttccggtaagtcgaaccgttagttccgggttaaccgctaacgtattaccggctttaacggtcgtacgggttatacgggtacgtaaccggtcgtaacccggtcttaccggtacggtcgtaaccgaccggaacgtaaccccgtaaccncggtttaccgaacttcccgg

SEQ ID NO: 270840 - DNA, 173 bp, Homo sapiens
  misc_feature: GYAE6OF02FVLP8.44.27.C05.1.454.CMB.1.raw
  modified_base (170)..(173): a, c, t, g, unknown or other
  misc_feature (170)..(173): n is a, c, g, or t
tcagacagtatatacacgaccggtgctcgatttagacgcgatcgaagggtttgggtgttcggcggagggaccaagctgaccgtcctgggtcagcccaaggctgccccctcggtcactctgttcccgccctcctctatatactgtctgagcgggctggcaaggcgcatagnnnn

SEQ ID NO: 270841 - DNA, 614 bp, Homo sapiens
  misc_feature: GYAE6OF02I76KX.44.27.C05.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
tcagacagtatatacacgaccggtgctcgatttagacgcgatcgaagggtttggggggggtcacaagaggcagcgtctctcgggacgtctccaccatggcctgggctctgctgactcctcactctcctcaccccaggaccacagggtcctgggcccagtctgccctgactcagccgtgccctccgtgtcgtgggtaccncctggacacggtcggtacacctatctcctgcactgganccagcgtaatnttctatcttaatttgctctgtatcaacntcatccaggtaacncccaatcatcatctangagtacctanaacgcgtcctaggtagggttcaacgtcgtccttcgactcgtcctaccgaacgtccgactaaccggaccgcctccagacctagtcgtcgacggcctacgagtccgtaggacggtaagtccgtagttacgttaatttactacggttcgtacgtccgtaagtacgttcgtcggtccgtactctactacttagttcgacggtttcgaacgttaacgggaccgtacgcgtaccgacgttccgtaaccgcctacccgaaccgacccgtacccgaccgtacgtactaccctacgtcccttacccg

SEQ ID NO: 270842 - DNA, 914 bp, Homo sapiens
  misc_feature: GYAE6OF02FNCD4.44.27.C05.1.454.CMB.1.raw
  modified_base (224)..(224): a, c, t, g, unknown or other
  misc_feature (224)..(224): n is a, c, g, or t
  modified_base (255)..(255): a, c, t, g, unknown or other
  misc_feature (255)..(255): n is a, c, g, or t
tcagacagtatatacacgaccggtgctcgatttagacgcgatcgaagggtttgggggggggtcacaagaggcagcgctctcgggacgtctccaccatggcctgggctctgctgctcctcactctcctcacccaggaccacgagggtcctgggcccaggtctcgccctgactcgagccctgccctcgtgtcgtcggggcctccgtggactcggtcggtcacctancctcgtgctacgtgacaccagtcggtaattnttcgttaacgttaccttttacgtttcgtccctttaccgttacggttactacctaaacacgttccctaacgttaccggaaaaccgggttaaacccctaaccccccctaaaaacgttcccgtaaacctaccttaccgttactaacgggttacgggtaaccgtaccgttaaacggttaacggaccccgggttaccccgtttaacggggtttaacggggttttacctaactttacccggtccttaccggacccttccgttaccccgtaacgtaacccggtccccggaacgtaaaccccggccggtacccctccgaacgtacctacgtttacccgtcgtccggtccgtaccggtacggtaccggtaagggtaccgggacggtaccggttacgtttacgttagtttacgttttacggtttaggttccgttacgttacgttacgtttacgttccgggttaccgtccgtaagttaccgtttacgttaaccgtttagggtttaaccggtttacgggttacggtaaaccggggttaaccggtaaccggttttaccgggaacccgttaccgggttacccggtaacgttacccgggacccgtaaccccgtaaccggttacccgtaccgttaacccgttacccgttacctacccgtttcccttacccccggg

SEQ ID NO: 270843 - DNA, 816 bp, Homo sapiens
  misc_feature: GYAE6OF02HXGZO.44.27.C05.1.454.CMB.1.raw
  modified_base (155)..(155): a, c, t, g, unknown or other
  misc_feature (155)..(155): n is a, c, g, or t
  modified_base (165)..(165): a, c, t, g, unknown or other
  misc_feature (165)..(165): n is a, c, g, or t
  modified_base (206)..(206): a, c, t, g, unknown or other
  misc_feature (206)..(206): n is a, c, g, or t
tcagacagtatatacacgaccggtgctcgatttagacgcgatcgaagggtttggggtggcaccaggggtcccttccaatatcagcaccatggcctggactcctctctttctgttcctcctcacttgctgcccaggtcaattcccaggctgtggtnactcaggacnccctcgactgactgtcgtaccccaggacggacagtcactcnctactgtcggcctccagcacgtgacctgtacactagtcgtcttactttcccatcggtacctaccgaacaggtaacccgtccgacccgaaccgccccccgaggaacctacgttaaacgttttactaggtaacttaaaccgttaacttaacggttaacgtaaccggtaccgttacgtaccggaacctacccgtcgtcccctagttccttacgaccgggtccttcccgtccggttagggaaaccctacggtccccgttacccgtaccgttacccgttaccggtacgtacggtcccgtaccggtaccgtccggttaacggacgggacgtacggaccggttcggtaccgttaacgtttccgttaacggcgttaaccgttccgtttacccgttacccgtttaccggttaacgtttaggttaaccgggtttacggtttaccggtagggttccggggttaacccgggtagggggaaacgttacccgtaacggttcgttacccgggttacccgtacggtacggtaccgacggtacccgtaacgcccggttacccgccccggttacggtaccgtaccttccggtacccttaccccgtcctttaccgtccttaaggttacc

SEQ ID NO: 270844 - DNA, 884 bp, Homo sapiens
  misc_feature: GYAE6OF02H2ANI.44.27.C05.1.454.CMB.1.raw
  modified_base (211)..(211): a, c, t, g, unknown or other
  misc_feature (211)..(211): n is a, c, g, or t
tcagacagtatatacacgaccggtgctcgatttagacgcgatcgaaggggtttgggggggggggtcacaagaggcagcgctctcgggacgtctccaccatggcctgggctctgctgctcctcactctcctcacccaggacacgacgggtccgtacgggccctagtctcgcccgtcgacctcacgcctcgcctccgtgtccgttcgggtccnccgtaggactcggtcggtaccacctactccgtccgtagctacgtggacgaccgtacgtacggttaaacttactttaccgttacgtttaccttttaacgtttcgttaccgttaccgttacgtaacttaccgtaaactacgttacctaaccgtaaccgtaaaaccgggtaaaccccgaaccccctaacctaccgtaactaccgtaacttacgttacggtaacggtaccgtaacccgttaaagtaaccggtacccggtacccgtttaacgggttacggttttactaaccgttacccgttacgttccgtacgttacccgtacccgtaccggtaaccgtaccggaacccgtaccggacccgttcctaaccgacgttacctacgtaccgtcgtaccgtacgtccggacgtacggtgaaccggagtacgtactagttttacgttattggttactcgaactttgaccgttgtcccggtttacccgttaattcccttattaacccggttagtttacggttacccgggttaagggtaacccgttacgaacccggggttaccctaaccggtttccgggtaaaccggtaccggtaacccggtaacccgaacccccgggaccctttaaacccggtaccccgttaagttccccgtttaacggttccccccgttagtttaaccccccc

SEQ ID NO: 270845 - DNA, 562 bp, Homo sapiens
  misc_feature: GYAE6OF01BX2TI.25.87.H10.1.454.CMB.1.raw
  modified_base (194)..(194): a, c, t, g, unknown or other
  misc_feature (194)..(194): n is a, c, g, or t
  modified_base (312)..(312): a, c, t, g, unknown or other
  misc_feature (312)..(312): n is a, c, g, or t
tcagactgtacagtcacgaccggtgctcgatttagcagtactgcgttgggtttggggtcagacccagtcaggacacagcatggacatgagggtccccgctcagctcctggggctcctgctgctctggctctcaggtgccagaggtgacatccacatgacccagtctccatcctccctgtctgcatctgtggganacagagtcaccatcacttgccaggcactcagaacatctactaacttttaatggtatcagacaaaaacctgggatcggccctaaactcctgatctaccgtgcatccagtttcggaaacngggtccatcaaggttcagtggaagtggatatggacatattttacttcacatcagcagcctgctagccgtaagtattttgactaacatattactcgttacaactactgttacctttactccttccctcgttacgggttttcgacccgttaacggggacccctacccgttaccgaaggtacttaccgaaaacggtactacggtggaccttcgacctaccacgttctcgttacctttcacgttccttaccccg

SEQ ID NO: 270846 - DNA, 716 bp, Homo sapiens
  misc_feature: GYAE6OF01D8IJJ.25.87.H10.1.454.CMB.1.raw
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtcctccttccaccctgtctgcatctagtaggggacagagtcaccatcacttcggccgggccaggtcggagtggttggggcggtcttttggccttggtatcagcaacaaaccgagggaaaccaccccaaactcctacctctagtggacgcgttacttactttacactacgtcggtaccgtcccctagtaacggttcacggccggactaaggtcggtaacgttccggtaggggaacctaaggtaaactttccaaccttcctacaaccatcgacggccggtcctgacctaaccgtgattcgttattttacgaaccttaaactttacttactcgacctaagtacttaaagtttaattttaaactttttactccgtttacggtttcccgttttacccgtttacggggacccggttaacgggggtacccggtagggggttacggaacggtacggtaacgaaaccgggtcgtaaacggttgggtacggtccgtacggaccctaaccgtacgttcccgttacggttaccctttaccgtaccttccccgttccccgtaacc

SEQ ID NO: 270847 - DNA, 608 bp, Homo sapiens
  misc_feature: GYAE6OF01A9LPE.25.87.H10.1.454.CMB.1.raw
  modified_base (228)..(228): a, c, t, g, unknown or other
  misc_feature (228)..(228): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggcctccgccacgcccccgagggacggcctggagtggacttgcgtagttgtcttcagtagtgggtagtgcctactacgacgtccctccctacaacgagtcgagtccacctagtttcggtacgacgaccgtccacgcagtctagttcgtactctcgactactcgacgttctcgtccaccggcccgaccgaccgaccggtccgtacttacgttacgtgtgcgagtacgtccaggtcccgggtaacgtaaaccccctaaccgtaacccccgttacgtttacgaacccgtacccgtcgggggacccctaaggggtaaccccgtgggtacccacccggtctacccgtaccg

SEQ ID NO: 270848 - DNA, 561 bp, Homo sapiens
  misc_feature: GYAE6OF01CGOMW.25.87.H10.1.454.CMB.1.raw
  modified_base (228)..(228): a, c, t, g, unknown or other
  misc_feature (228)..(228): n is a, c, g, or t
  modified_base (323)..(323): a, c, t, g, unknown or other
  misc_feature (323)..(323): n is a, c, g, or t
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
  modified_base (449)..(449): a, c, t, g, unknown or other
  misc_feature (449)..(449): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggcctccgccacgcccccgagggaacggccgtggagtggattgcgtattgtctttcatagngggatgcctactacacgtcccctcctcaagagtcgagtcacctagtttcggtnacacgtccacgcagctagttgtctntgacactgacgtctgtccacggccaccgacaccggccgtctattacgngtgcgagagtcgagcggttacgaaaccccctacaaccccgttacttcgaacctccggtacggggacccaacggggtaacccgttcggtacccgacccgttccacccgtaccg

SEQ ID NO: 270849 - DNA, 585 bp, Homo sapiens
  misc_feature: GYAE6OF01A6Z4V.25.87.H10.1.454.CMB.1.raw
  modified_base (264)..(264): a, c, t, g, unknown or other
  misc_feature (264)..(264): n is a, c, g, or t
  modified_base (325)..(325): a, c, t, g, unknown or other
  misc_feature (325)..(325): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgggcagtcggagtgttgggcgcttttggcctggtatcagcacaaaccntcggaaacgcccccaaatccctcctctatgaggcttctactttacacactggactcccctnaaggttcaggcggcagtggatcgtgggacagaacttcactctacacctatccgagccggctgcaacctgatgtattttgactaactttactactgtaccagtctagttaatttaactttttactcgttcgtccggtttcccgttttgggacccgtaggggacccgtaggggtacggtacggtacgaccgtaaggacgtaaccgttggtacggctcggacctactacgttcgtagttaccttctacgttccgttacccccg

SEQ ID NO: 270850 - DNA, 611 bp, Homo sapiens
  misc_feature: GYAE6OF01DZD76.25.87.H10.1.454.CMB.1.raw
  modified_base (277)..(277): a, c, t, g, unknown or other
  misc_feature (277)..(277): n is a, c, g, or t
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtcctccttcccaccctgtctgcatctagtaggggacagagtcaccatcacttgccgggcagtcggagtgttgggcggtctttggctggtatcagcaacaaaccgagggaaacnccccaaactcctcctctatgaggtcgtctactttacacacgtgactccctnaaggttcagcgcaggtgatcgtagggacagtaatcactcncacatcagcggctgcaactgatgtattttgactaactttatactcgacagactagttaatttaactttttacctcgttcggttcccgtttaccccgttttagggacccggttaacgggggtaccgtaggggttacgggacggaacggtaccggaaacggtccggtaaaccgttgggttcgggccttacggaccctaccgtattcccgttcgttacccttcgtaccttcccgtttccccgtacc

SEQ ID NO: 270851 - DNA, 573 bp, Homo sapiens
  misc_feature: GYAE6OF01DK2JQ.25.87.H10.1.454.CMB.1.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
  modified_base (372)..(372): a, c, t, g, unknown or other
  misc_feature (372)..(372): n is a, c, g, or t
  modified_base (393)..(393): a, c, t, g, unknown or other
  misc_feature (393)..(393): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (446)..(446): a, c, t, g, unknown or other
  misc_feature (446)..(446): n is a, c, g, or t
tcagactgtacagtcacgaccggtgctcgatttagcagtactgcgttggggtttgggggtcagacccagtcaggacacagcatggacatgagggtccccgctcagctccgtggggctcctgctgctctggctcccaggtcgcccaatgtgacatccgaggtgacccatcctccttccaccctgtctgcatctagaggggacagacgcacatcactgccgggcaggtcggagtggtggcgtntttggctggatnagcacaaacagggaacncccaactcctcctctagtgacggtctcttacttacactacgngaccgtccctanaaggttcaggcggnaggtggactcgagggacagtattcactcacacancacggtcgcctagccaacgtnattgtatttgacttaacttnttacncgacagtntaacttatttaactttttcncttcgtccgttttcccgtttggacccgtaacggggtaccgtaggggtaggacggaggacaaacggtccggaagttcggcggtcacggaccctactacttcggttctcttacaccttccgtcccgtac

SEQ ID NO: 270852 - DNA, 671 bp, Homo sapiens
  misc_feature: GYAE6OF01CHQWY.25.87.H10.1.454.CMB.1.raw
  modified_base (228)..(228): a, c, t, g, unknown or other
  misc_feature (228)..(228): n is a, c, g, or t
  modified_base (377)..(377): a, c, t, g, unknown or other
  misc_feature (377)..(377): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtgggctggcctccgccacgcccccgagggaaggcctggacgtggattgcgtattgtctttcataggtggagtcgacctacgtacctacgtcccctacctacaagcgtacgacgtcaaccgtntttcggtgaccacgtccacgcagtctagttcgtctctgactacgtgaccgtcgtgtacccgcggtcccgaccgacgacccggtccgttacttaacgttaccgtcgtcggaccggttaaggacggttaccgaacgggtacccgggttaacccggtaaaaccccccgttaccgtaaaccccccgtttacgttttaccggaacccggttaccccgggtacggggggtaacccctaaaccgggggtaacccggttaccgggtaccccgtaaccccggttcccgaaccccgttacccgg

SEQ ID NO: 270853 - DNA, 566 bp, Homo sapiens
  misc_feature: GYAE6OF01D23SR.25.87.H10.1.454.CMB.1.raw
  modified_base (272)..(272): a, c, t, g, unknown or other
  misc_feature (272)..(272): n is a, c, g, or t
  modified_base (323)..(323): a, c, t, g, unknown or other
  misc_feature (323)..(323): n is a, c, g, or t
  modified_base (410)..(410): a, c, t, g, unknown or other
  misc_feature (410)..(410): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgggccagtcggagtgttgggcgtctttggcctggtatcagcacaaacagggaaacnccccaaactcctcctctatgaggcgtctactttacacactggactcccctnaagttcagcggcagtggatcgtgggacagtaatcactctcaccatcagcgctgactaacctgactgtatttgactaacttattactncctagctaagttatttaatttttactcttcgtccgttttacccgtttgggcccgtaggggtaccgtagggtacggagacgacgaagacggtaacgtggtcggacttcgccctaaccattaccttgttaccttacgtaccttcccgttccccgtacc

SEQ ID NO: 270854 - DNA, 571 bp, Homo sapiens
  misc_feature: GYAE6OF01AQEP0.25.87.H10.1.454.CMB.1.raw
  modified_base (245)..(245): a, c, t, g, unknown or other
  misc_feature (245)..(245): n is a, c, g, or t
  modified_base (350)..(350): a, c, t, g, unknown or other
  misc_feature (350)..(350): n is a, c, g, or t
  modified_base (375)..(375): a, c, t, g, unknown or other
  misc_feature (375)..(375): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaangctcattactggggctggctccgccacgcccccgagggaacggcctggagtggattgcgattgtctttcatagtggagtgcctactacacgtccctcctacaagngtcgagtcacctagtttcggtgacncgtccacgcagctagttcgtctctgacactgacgtctgtccgaccgggcccnccgacgaccgggccctctacgttacngttcgacgagacgtcgaggccggtacggaaaccccctaccgaaccccgttcttacgacctacccggtcggggacccacggggtaacccgttcgggtacccaccgttccgacccgtccg

SEQ ID NO: 270855 - DNA, 691 bp, Homo sapiens
  misc_feature: GYAE6OF01AD9K7.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtgggctggctccgccacgcccccgagggaacggccgtggagtggattgcgtattgtctttcgagttaggtgggagtcgacccttacgtacgacgttcccctaccctacgaacgacgtcgacgtcctaaccgtacgttttcggttacgacctaccgttacccgacgtccaacggcctaaggtttcgtacctcgtacgactacgttcgaccgttctcggtacccgaccgggcccgaccgaccgaccgggtcccgttcgtaacgtttaccgtggttacgccggtagtaccgttcgacggtacccgggtaccgtaaaaccccccttaccgtaaacccccgtttacgtttacggaacccgtacccggttaccggggggacccctaacgggggtaaaccccgttcgggtaccccaccccggttaccgtaccccgttacccgg

SEQ ID NO: 270856 - DNA, 703 bp, Homo sapiens
  misc_feature: GYAE6OF01CM3QZ.25.87.H10.1.454.CMB.1.raw
  modified_base (254)..(254): a, c, t, g, unknown or other
  misc_feature (254)..(254): n is a, c, g, or t
  modified_base (357)..(357): a, c, t, g, unknown or other
  misc_feature (357)..(357): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtgactccatcacagtaatgctcattacgngggctggcctccgccacgcccccgagggaacggccgtaggagtggattgcgtattgtctttcagtaggtggagtgacctactacacgtccctcctacgaacgngtcgagtcaccttaagtttcggttacgactaccgtacccgacgcgaacgtctacggtttcgtccttacgttacgaacctaaccgttggaccgttccgttcggtacccgaccgggccccgacccggaaccgaacccgggtcccgttacttaacgtttaccgtcgggttacggaccggtaaggtacggttaccgaacgggtacccgggttaacccggaaaaccccccttaccgtaaaccccccgtttaccgtttaccggaacccgtacccgggttccgggggaaccccgtaacgggggtaacccccggttagggtaccccgtaacccggtcccgtaacccgtacccgg

SEQ ID NO: 270857 - DNA, 564 bp, Homo sapiens
  misc_feature: GYAE6OF01ESHKX.25.87.H10.1.454.CMB.1.raw
  modified_base (329)..(329): a, c, t, g, unknown or other
  misc_feature (329)..(329): n is a, c, g, or t
  modified_base (377)..(377): a, c, t, g, unknown or other
  misc_feature (377)..(377): n is a, c, g, or t
  modified_base (548)..(548): a, c, t, g, unknown or other
  misc_feature (548)..(548): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctagtaggggacagagtcaccatcacttgccgggccagtcggagtgtgggcggtcttttggcctggtatcagcaacaaaccagggaaacgccccaaactcctcctctatgaggcgtctactttacactactggactcccctanaacggttcaggcggcaggtggatcgtgggacagaattcactctcaccntcagcgctgcaacctgatgtatttgactaattacttactgccagctagttatttaatttttactcttcgttccgttttcccgtttgggaccgtacggggtaccgtaggggtcggaggagacgtaacggcgtaacgtcggtcggcgtcgccactagttccttgttccttacncttcccgtcccgtacc

SEQ ID NO: 270858 - DNA, 627 bp, Homo sapiens
  misc_feature: GYAE6OF01A4TIU.25.87.H10.1.454.CMB.1.raw
  modified_base (272)..(272): a, c, t, g, unknown or other
  misc_feature (272)..(272): n is a, c, g, or t
  modified_base (314)..(314): a, c, t, g, unknown or other
  misc_feature (314)..(314): n is a, c, g, or t
  modified_base (482)..(482): a, c, t, g, unknown or other
  misc_feature (482)..(482): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgggccagtcggagtgttgggcggcttttggcctggtatcagcacaaacagggaaanccccaaactctctactatgacggtctacttactacactacgngtaccgtccctagtacgtcaggcgacgtaggagtactggacggacaagtacttacacgttcaccactatcgacggccgtctcgaacctaacgtgtatagttacgtttacaacctttaatttaacttaccgcgtactacgacgttaagttaactttttaacttttaccncgttcgtttaccccgtttttccggtttaccggacgggtaacggggtaccgtaggggtacggaagtacgaacgtaacgtaccgtaacgtggtcgacgtacgcctaaactcgttcgttacgttcttacgtaccttcccgtccctaac

SEQ ID NO: 270859 - DNA, 631 bp, Homo sapiens
  misc_feature: GYAE6OF01A4PS8.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccgagggaggcctggagtggattgcgattgtctttcatagtgggagtgcctactacacgtccctcctacaagacgtcgacgtcacctagtttcggttagaccacgtcccaacgcagctagttcgtcctgtacgacacgtcgaaccgttctagtccgaccgggcccgccggacaccgggtccctacttacttaccgtgtcgtaccggagtacgttccgaacgggtcccgggtaaaccgtaaaaccccccttccgtaaaaccccccctttcgtttacggaaccccgtaccccggtcgggggaaccccacgggggtaaaccccgttgggtaccccgacccgtccgtacccctacccgg

SEQ ID NO: 270860 - DNA, 582 bp, Homo sapiens
  misc_feature: GYAE6OF01DBO1K.25.87.H10.1.454.CMB.1.raw
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (515)..(515): a, c, t, g, unknown or other
  misc_feature (515)..(515): n is a, c, g, or t
  modified_base (537)..(537): a, c, t, g, unknown or other
  misc_feature (537)..(537): n is a, c, g, or t
  modified_base (577)..(577): a, c, t, g, unknown or other
  misc_feature (577)..(577): n is a, c, g, or t
tcagactgtacagtcacgaccggtgctcgatttagcagtactgcgttgggtttggggtcagacccagtcaggacacagcatggacatgagggtccccgctcagctcctggggctcctgctgctctggcctcccaggtgcccaatgtgacatccaggtcgacccagtccccttcctaccctgtctgcactctagtagggacgagagtcaccatcactcgccggccgagtcggtagtggttcgggtcggtgtttcggtcgtcggtatcacgacaacaaaccgaacggaaacgaccccaacctaccctcctctatcgacggcgtactacttacacactcggacgtccctntaagtcagcgacgngagntctggacagattcactctcacancgagcgcctacgacaacctgatcgtaatttcgataacttntacgtnccagtctagtatttaatttacgttgcgttcgtttacccgttggtaccgacgggggttacagggtaggactacggcgaacgnggaacccgttggaggtccgtanctacccgacttgcgtttactcctaagttcctttccccggnttaac

SEQ ID NO: 270861 - DNA, 605 bp, Homo sapiens
  misc_feature: GYAE6OF01DVAV5.25.87.H10.1.454.CMB.1.raw
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagacgtcaccatcacttgccgggcagtcggagtggtgggcggtctttggcctggtatcagcaacaaaccgaggggaaacaccccaaactcctcctctatgaggtcgtctactttacacacgtggactcccctagaaggttcagcggcaggtggatcgtgggaacaggtaacttcactctacaccatcacggccgcctgacctaacctgtatgttattttcgacttaacttattacctgtccagtctaagttaattttaactttttactcgttacgttccgttttcccgtttggacccggtaggggaccgtaggggtacggaaggtcggacgaaaggtccgtaaagtcgggtcgtacgtcggccctaccgattcccgttgttacctttctaccttcccgttccccgtac

SEQ ID NO: 270862 - DNA, 534 bp, Homo sapiens
  misc_feature: GYAE6OF01AETJR.25.87.H10.1.454.CMB.1.raw
  modified_base (434)..(434): a, c, t, g, unknown or other
  misc_feature (434)..(434): n is a, c, g, or t
  modified_base (489)..(489): a, c, t, g, unknown or other
  misc_feature (489)..(489): n is a, c, g, or t
  modified_base (497)..(497): a, c, t, g, unknown or other
  misc_feature (497)..(497): n is a, c, g, or t
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggcctccgccacgcccccgagggaacggcctggagtggattgcgattgtctttcatagtgggagtgcctactacacgtcccctccctcaacgagtcgagtcacctattttcggtgacacgtccacgcagctagttgtctctagacactgacgtctgccgacggcccgccgacnccggcctctattactgtgcgagacgtcagcggtacgaaacccctacgaacccctnttcgaccnccgtcgggccagggaccgtcggaccnccgtcncctcg

SEQ ID NO: 270863 - DNA, 682 bp, Homo sapiens
  misc_feature: GYAE6OF01EBMGP.25.87.H10.1.454.CMB.1.raw
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (562)..(562): a, c, t, g, unknown or other
  misc_feature (562)..(562): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgacgcccgagggcagggtgaagcccgttcggacgacccctcgtcccctcacctgcctctcgtctcgtggtnacctccatacacagtaancgctactagttacgtgggctcggcctccgccaccgaccccgagggacggccgtggaggtggtagtcggacgtatttcgttctttacgagtaggtagggtacgttacgtaccttaacgtaccgtacgttccccctaccgtacgaacgtacgtaccgtaacgtacctaaccgttacgtttaccggttacgaaccctaccgtacccgaaccgcgtacgtccgttagtttctaccttcgtacaacgtacgtcgtaccgttcgtacgacccgtaccggcccgaccgacgtccggtccgttatacgttcncggtgacgagacgtcgacggtaccgtaaccggtaaaccccctacgtaaccccgttcgtacgaaccgtccggtcggggaccctaacggggtaccgtcggtaccacccgtcacccgtacccg

SEQ ID NO: 270864 - DNA, 719 bp, Homo sapiens
  misc_feature: GYAE6OF01CACO4.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatccaccagtaatgctctattacgtggggctcggcctccgcccgacgcccccgaggggaacggccgtggagtggtattgcgtagttgttctttcagttaggtgggagtcgacctactaccacgtcccctccgtacgaacgtacgtcgacgtcctaaccgtagttttccggttcgaaccgtaccgttaccacgccgtaagtccgtaagtttcgtacctcgtacgaacctacgttcggacgttcgtcgtacccgacccgggcccgacccggaaccgtacccgggtcccttacttaacgtttaccgtcgggtacgccggtaacggtacggttaccgacgggacccgggttaacccgtaaaacccccctaacgtaaacccccccgtttgtttaacccggaccccgttaacccggggtacgggggtacccccgaaagggggttaccccgttacgggtacccctaaccccgggttcccaaccccgttacccg

SEQ ID NO: 270865 - DNA, 577 bp, Homo sapiens
  misc_feature: GYAE6OF01EUFV6.25.87.H10.1.454.CMB.1.raw
  modified_base (229)..(229): a, c, t, g, unknown or other
  misc_feature (229)..(229): n is a, c, g, or t
  modified_base (458)..(458): a, c, t, g, unknown or other
  misc_feature (458)..(458): n is a, c, g, or t
  modified_base (486)..(486): a, c, t, g, unknown or other
  misc_feature (486)..(486): n is a, c, g, or t
  modified_base (570)..(570): a, c, t, g, unknown or other
  misc_feature (570)..(570): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagacccctgtccctcacctgctctgtctctggtnacctccatcaccagtaatgctcattacgtggggctggcctccgccacgccccccgaggggaacgggccgtgggaggtggtagttggcgtattcgttctttcagttaggtgggagtcgcctactaccacgtcccctccctacaagagtcgacgtaccacctagtttcggttagaccgtacgtccacgcacgtcagttgtctctagacactgacgtctgtccgaccggccnccgacgaccgccttctattactgtgcgngagtcgagcggtaccgaaacccctacaaccccgttacttagaccaccgtcggggacccacgggaaccggttgacccaccgtccncgtaccg

SEQ ID NO: 270866 - DNA, 738 bp, Homo sapiens
  misc_feature: GYAE6OF01ARDUJ.25.87.H10.1.454.CMB.1.raw
  modified_base (276)..(276): a, c, t, g, unknown or other
  misc_feature (276)..(276): n is a, c, g, or t
  modified_base (557)..(557): a, c, t, g, unknown or other
  misc_feature (557)..(557): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccggccagtcggagtgttgggcggtcttttggcctggtatcagcaacaaaccgagggaaacnccccaaatcctcctctatgaggcctctactttacactactcggactcccctagtaacggttccaacggccgggtacaagggttcggaacttccggtagggggaacaaggtaaactttccaaccttcttacccaaccctataccgaacggcccggtcccttacggaccctaaacccgttgtaacgtttacggttaacttttttcgaacccttaaactttttacgttaaccgtcgtacccctaaaggttacctaaaggttttaattttaaacctttttttacnccgttttaccggtttacccgtttttccccggttttacgggacccgggtaacgggggtaccgttagggggtacgaacggtagacccgaaggtaccggtaacgttgggacggtacctcggtaccctaaccttagtttaccctggtttacccttaccgtaccgtttccccgttcccccgtaacc

SEQ ID NO: 270867 - DNA, 705 bp, Homo sapiens
  misc_feature: GYAE6OF01B8ONX.25.87.H10.1.454.CMB.1.raw
  modified_base (281)..(281): a, c, t, g, unknown or other
  misc_feature (281)..(281): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtcgacccagtcctccttccaccctgtctgctatctagtaggggacaggacgtcaccatcacttgccggcagtcggagtgtgggcggtcttttggcctggtatcagtcaacaaaccgagggaaacncccctaaactcctcctctaatggacggtcgtcttactttacacgctggacgtcccctagtaacggttcaggacgactaggtggactcgtagggaacagtaactttcacttctaccacctatccagccggcctgaccacgtcccgtagtacgttcgttacgttttcgaccgttaactttaacttaccgtacgtaaccctaaaactaatttaacttaaacttaacgttttaaccgttaccgtaacccgttacggtttttacgggacccggttaacgggggtaacccgtaaggggttacggtacgtaaacgttaaccggaaaacgttaaccgttagggtacgggtacccttacgggaaccctaacccgttagttcccgtttacggttacctttactaccgtttccccgttaccccgtacccttaacg

SEQ ID NO: 270868 - DNA, 678 bp, Homo sapiens
  misc_feature: GYAE6OF01B4K4Q.25.87.H10.1.454.CMB.1.raw
  modified_base (146)..(146): a, c, t, g, unknown or other
  misc_feature (146)..(146): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
tcagactgtacagtcacgaccggtgctcgatttagcagtactgcgttggggtttgggggtcagacccagtcaggacacagcatggacatgagggtccccgctcagctcctggggctcctgctgctctggctcccaggtgccaatgngacatccaggtgacccagtctccttccaccctgtctgcatctagtaggggacagagtcaccatcacttggccgggccaggtcggagtggttgggcggtctttggacctggtatcagcacaaacagggtaacncccaactcctcnctatgagcgtactacttacacnctggctcccctgaacgttcaggcggcaggtggactcgtagggacagtaacttcactacctcacctatccgacggccgccgttacgaccgtaaacctggtaacgttagttacttttacggaaccttaaacgttttacttaaccgttcgacccgtaaggtaaccttaaggttaactttttaacgttttttaacctccgttcggttttcccggtttttcccggtttttacccgggaccgggttaccggggggtaaccgtagggggttacggaacggtacggaaccgtacgaccgtaaaccggtcggtaggtcctacggcccgtactccttacggttcttacgttacctactttcccgtcccgttaaccc

SEQ ID NO: 270869 - DNA, 571 bp, Homo sapiens
  misc_feature: GYAE6OF01ALMU0.25.87.H10.1.454.CMB.1.raw
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (326)..(326): a, c, t, g, unknown or other
  misc_feature (326)..(326): n is a, c, g, or t
  modified_base (439)..(439): a, c, t, g, unknown or other
  misc_feature (439)..(439): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgggcagtcggagtgttgggcgcttttggcctggtatcagcacaaaccgngggaaacnccccaaatcctctctatcgaggtccgtactacttacacactggacgtcccctnaagttcagcggcagtggactcgtgggacagtaattcgactctcaccatcgagcggcctgactacgtgagtctatttcgactaacttatactcgcagctagttattattttacnttcgttaccttccgtttggcccgtagggtcgtacggggttgacggacgtacgaaggtcgtaaccgttggtacggtcgtacgtccgaaccttgttccgttcggttccttaacctcgttccccgtacccggtcc

SEQ ID NO: 270870 - DNA, 615 bp, Homo sapiens
  misc_feature: GYAE6OF01D1MDU.25.87.H10.1.454.CMB.1.raw
  modified_base (323)..(323): a, c, t, g, unknown or other
  misc_feature (323)..(323): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgggccagtcggagtgttgggcggctttggcctggtatcagcacaaaccagggaaacgccccaaactcctcctctatgagcgtctactttacacactggactcccctnaaggttcagcggcagtgatcgtggacagatcactctcacatcagcgcctgcaactgatgtatttgactaacttattactgaccagacctaagttaatttaacttttttacctctttacggttccgttttcccgttttcgggacccgttaacgggggtacccgtaagggggttacggtaggtaacggaccgtaaacgggccgtaaacgttcgggtacgggtcctacgggtcccaacccgtagttacccgttgttaccccgtttacttaccttccccgtttcccccgtaacccg

SEQ ID NO: 270871 - DNA, 771 bp, Homo sapiens
  misc_feature: GYAE6OF01CWYDC.25.87.H10.1.454.CMB.1.raw
  modified_base (164)..(164): a, c, t, g, unknown or other
  misc_feature (164)..(164): n is a, c, g, or t
  modified_base (287)..(287): a, c, t, g, unknown or other
  misc_feature (287)..(287): n is a, c, g, or t
  modified_base (762)..(762): a, c, t, g, unknown or other
  misc_feature (762)..(762): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcgcgcccagatggtcctgtcccagctgcgtctgcaggngtcgagcccgagggcaggtgaacgccgttcggacgaccctgtcccctctaccgtgccttcttcgtccttcgtcggtcgaaccttccaacttccaaccgagttaactcgcttactagttacggnggggtcctcggtccctcccgacccaccggacccccggaggggaaccggtccgtaggggtagtggtagtcggacgtagttttcgttcttttacgaagttagggtagggtacgtccgtaccttaaccgtacttaccggttccccctaccgtagaaacggtcgtaccgtacgtaccctaacgttacgttttccggtacgaacccgttaccgacccgtaacgacctaggtccgttaacggtttcttaccgtacgtacgaaccgtacgttcggttaaccgttcgtaccgtaccgacccgggtcccgaaccgaccgtaccgggtccctttacgttaacttcggtaggttccggaccggtagtaccgtcggtaaacccggtacccgggttaaacccccaaaccccttaacccgtaacccctttaacgggttccgacccgtccgggtacgggaccgtacgggtaacccgtcgtacaacccgtnaccctcccg

SEQ ID NO: 270872 - DNA, 794 bp, Homo sapiens
  misc_feature: GYAE6OF01A4RE2.25.87.H10.1.454.CMB.1.raw
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaacgccgttggacgacccttgtcccctcacctgctctgtctcgtaggtnacctccatcactagtatcgctactattacgngggctggcctccgccacgccccgagggaacggtccgtaggaacgtggtacttcggcgtagtttcgttctttacagtagggtgggtacgtcgtacccttaactaccgtacgttcccccgttaccgtacgaaaggtcggtacccgtaacgtaccctaaccgtttagttttccgggttacgaacctccggttaccacgtacgacggtacgttacggtttcgtccgttacgtacgactaccgtggtacccggttccttcggtacccggacccgggcccgtacccggaaccgtacccggtccgtttcttaaacgttccgtacgggtaccggacgttaacggtaccggtaccgaaccgggttaacccggggtaaccccgtaaaaacccccgttaaccccgtttaacccccggttcgtttaacccgggaaccccgggttaccgggtaccccgggggtaacccgttaaacccgggggttaccggttaccccggttaaccccggtaccccggttacccgtaaccccggtttaccccgg

SEQ ID NO: 270873 - DNA, 760 bp, Homo sapiens
  misc_feature: GYAE6OF01DI9DS.25.87.H10.1.454.CMB.1.raw
  modified_base (231)..(231): a, c, t, g, unknown or other
  misc_feature (231)..(231): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccgagggcaggtgaagccttcggacgaccctgtccctcacctgctctgtctcgtggtnactccatcaaccagtaatgctcattacgtgggctggcctccgccacgccccgagggacggctggagtgattgcgtatttgttctttacgagttaggtgggtacgtcgtacccgttaactacctaccggttccccctaccctaacgaaacggtacgttaccgtaacggttcctaaccgttacgttttaccgggttacgaacctacccggttcccgaaccgtcctaaggtcttaacggtttcgtaccttcgtacgtacctacgttacggaccgttcgtacggtccgacccgggacccgtccgaacccgaccgggtccgttacttaccggtttaacgtcgggtacgacggtaacgtacggtacgaaccggggtaccggtaacccggtaaaacccccccttaaccccgtaaaccccgtttaaccgtttacccgaaaccccggtacccgggttaaccgggggacccggtaaaccggggtaaccccggttaccgggttacccctacccccggtaaccgtaccccgttaaacccgg

SEQ ID NO: 270874 - DNA, 700 bp, Homo sapiens
  misc_feature: GYAE6OF01ATP3J.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctcacctgctctgtctctggtgactccatcaccagtatgctcattacgtgggctgctccgccacgcccccgagggacggccgtggagtggatgcgtagttgtctttacgagtaggtgggtagtcgtcctaactaccgtacgtcccctccctacgtaacggtacgtacggacgttcctaccttacgttttcggttacgtaaccgtaccgtaccaccgacaacgtccgtaaggtttcgtccttacgtacgacctaccgttagtaccgttcgtcggtacccgacccgggcccgacccggaaccgacccgggtcccgttacgttaacgttaccggttcgggtacgtaccggtaggtaccggtaccgacgggtacccggtaaccgtaaaaccccccgttaccgtaaacccccgtttacgttacccggaacccgtacccgggttcgggacccgtaaccggggtaaccgtccggtaccgacccgttccgacccgtaccgg

SEQ ID NO: 270875 - DNA, 626 bp, Homo sapiens
  misc_feature: GYAE6OF01D0RAJ.25.87.H10.1.454.CMB.1.raw
  modified_base (361)..(361): a, c, t, g, unknown or other
  misc_feature (361)..(361): n is a, c, g, or t
  modified_base (392)..(392): a, c, t, g, unknown or other
  misc_feature (392)..(392): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggcgaagccttcggacgaccctgtccctcacctgctctgtctctggtcactcatcaccagtatgctcattacgtgggctcggcctccgccacgccccgagggacggtctggagtggtagtgcgtatttcgttctttcgaagtggtgggagtcgtcctaactacctcgttcccctccgtanagtacgtcgacgtcctaacgtgtttcggtanaccgtacgtaccacgcacgtctagttcgttctcgtcgactacgtcgacgttcgtcgtccgaccggtcccgaccgacgtaccgggtccctacgttacttacgttggttcgtagacgtacgtcgacggtaccggtaacccgtaaacccctacctaaccccgttacgtttaccgacgtacccggtacggggacccgtaacggggtaccgtacggtcccaacccggtccaacgtcccg

SEQ ID NO: 270876 - DNA, 658 bp, Homo sapiens
  misc_feature: GYAE6OF01CSSZC.25.87.H10.1.454.CMB.1.raw
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (516)..(516): a, c, t, g, unknown or other
  misc_feature (516)..(516): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctcacctgctctgtctcnggtnactccatcaccagtaatgctcattacgtgggctggcctccgccgacgcccccgagggaacggccgtggagtggtatgcgtatttgtctttcagtaggtggacgtgaccctaactaccgtaccgttcccctacctacgaacgtacgtacgtacgtcctaaccgttagtttcggtacgaacctaccgtccacgcagtacgtagtttcgtcctcgtacgaactaccgtgaaccgttcgtcgtccgaccggtcccgaccgtacgtaccgggtcccttactaacgtttacgnggtcgacgagtacgtcgaacggtccggtaacccgaaacccccttacgtaaacccccgtttcgttacggaacctcccgggttacggggaccccgtaaacggggtaccccgtacggtaccccgacccggttccaacccgtcccg

SEQ ID NO: 270877 - DNA, 847 bp, Homo sapiens
  misc_feature: GYAE6OF01ECDYY.25.87.H10.1.454.CMB.1.raw
  modified_base (276)..(276): a, c, t, g, unknown or other
  misc_feature (276)..(276): n is a, c, g, or t
  modified_base (638)..(638): a, c, t, g, unknown or other
  misc_feature (638)..(638): n is a, c, g, or t
  modified_base (823)..(823): a, c, t, g, unknown or other
  misc_feature (823)..(823): n is a, c, g, or t
tcagactgtacagtcacgaccggtgctcgatttagcagtactgcgttgggtttgggggctttctgagagtcatggacctcctgtgcaagaacatgaagcacctgtgttcttcctcctgcgtggtggcgcgcccagatcgggtcctgtcccagctgcgtctgacgaggagtcgacgcccgagggcaggtgaacgtccgttcggacgtcccctcgtccctccacctcgtctcgtcgtctcgtggtcacctcatcactagtatcgctagtacgttacgnggggtcctcggtcctacccgaccgacccggaccccggaaggggacggtccggtaggtaggttcggtacgttcggcgtttacgtttcgttcttacgtaggttagggttcgggtacgttaccgtaccctaacgttaaccgtaacccggtttcccccttaccgtaaacgtaacggtaccgtaccggtaacttacccgttaaccgtttaacggttttccgggttaaccgaccgttacccgcccgtaacggcctaaggttccctagggttttctaccgttacgtacaaccgttcgttaaccggtcgtttccgtaccgtacccgggacccggccccggaccggtaacccggtcccggttaaccctttntttaaccggtcggtcgggtaccggtacgtaaggtccgttaaccggaccggttaacccgggtaaaacccccgttaaaccccctttaaacccctaacccggttttacggttaacccggaacccggttcccggggtaaacccggggtaccccggtaaccgggggtaaccctttcgggtaaaccccccncggtttaccgcccccgttaacccg

SEQ ID NO: 270878 - DNA, 570 bp, Homo sapiens
  misc_feature: GYAE6OF01CHYTV.25.87.H10.1.454.CMB.1.raw
  modified_base (563)..(563): a, c, t, g, unknown or other
  misc_feature (563)..(563): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtggggctggcctccgccacgcccccgagggaacgggcctggagtggattgcgtattgtctttcatagtgggagtgcctatacacgtccctccctacgaagagtcgagtcacctactttcggtgaccacgtcccagcagctagttgtctctacgacactgacgtctgtcgacggcccgccgacacggccgtctatacgtgtagcgagtacgtcgacggcggtacggaaaccccctacgtaaaccccgttactttacgaacctcccggtcggggaccctaacggggtaaccgtcggtaccacccgttccnccgtacc

SEQ ID NO: 270879 - DNA, 811 bp, Homo sapiens
  misc_feature: GYAE6OF01DRQB4.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgtaggagtcgagcccgagggcagggtgaacgtccgttcgggacgaccccgttgtcccctcaccctgccttctgtcctcgtggtcgacctccatcaaccgtagtaatgctctagttacgtggggtctcggcctaccgccacgacccccgagggacggccgtgggagtggattggcgtatttcgtctttcgagttaggtgggtacgtcgtacctacgtaccgtaccgttcccctaccgtacgaaacggtacgtcgtacgtaccgtaaccgttagttttaccgggtacaacccgttaccgtacccgaacggtaccgtaacggtaccgttaacggtttaccggttccttacgtaccgtaaccgtaaccggtttcggtaacccgtttccgttacgtaccccggtaacccgggccccgtaccccggtaaccggtacccgggtccgtttaacgttaacgtttaccggtcggttccggacggttacgaaccggttacgtaacggggtacccgggttaaaaccccggtaaaacccccttacccgtaaaaccccccgtttggtttaacccggaccccgtacccgggttaccgggggaccccgtaaacggggtacccgttcggtaacccctaccggttaccctacccgttccgaaaccccgg

SEQ ID NO: 270880 - DNA, 761 bp, Homo sapiens
  misc_feature: GYAE6OF01CZUGE.25.87.H10.1.454.CMB.1.raw
  modified_base (510)..(510): a, c, t, g, unknown or other
  misc_feature (510)..(510): n is a, c, g, or t
  modified_base (616)..(616): a, c, t, g, unknown or other
  misc_feature (616)..(616): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgcgtggtggcggcgcccagagtcggtcctgtcccagctgcgtctgcaggagtcgagcccgagggcaggtgaacgtccttcggactaccctgtccctcacctgcttctgtctgtgtcacctccatcaacctagtactcgtctacgtacgttacggcggggctcgggtcctacccggacccggaacccggacccccgggtaaagggggaaccgggtccggtaggggtaacggtacggtacgtttcggaccgttagttttcggtttacctttagtaaggttagggtgggtacgttcgtaacccttacgtaaccgtcccgttcccctacgtaagaacggtagaccgtaacgtacctaaccgtttgtttacggtcgtaacctaccgtccgtaaccgngacgtcgttacgttcgtctcgtacgactacgtcgtaccgttccgtaccgtccggaacccggtcccgtaccggaacgtcccgggttctttaccgtaacgtttccggnggtaccggacgtacggacgtacgaacgggtaccggtaaaccccgtaaacccctacctaaccccgtttacgtacccgtaaccggacccgggttacggggaaccgaaccgggtaccgtacggacccctacccgttccaacccgtccg

SEQ ID NO: 270881 - DNA, 723 bp, Homo sapiens
  misc_feature: GYAE6OF01D6UJG.25.87.H10.1.454.CMB.1.raw
tcagactgtacagtcacgaccggtgctcgatttagcagtactgcgttgggtttgggggtcagacccagtcaggacacagcatggacatgagggtccccgctcagctcctggggctcctgctgctctggcctcccaggtgcccaatgtgacatccaggtgacccagtcctccttccaccctgtctgcatctagtaggggacagacgtcaccatcacttggcccgggcaggtcggagtggttggggcggttcgttttggaccttggtactcgacgactaaccgaaaaccgaagggaaacccgacccctaaacctcctacctctagtcgacggtctaccttaacttaccactaccgtacggacctcccctacgaacgggttccaacggtccgtacgaaggttcggaacgtcggtaggggaactaacgtaacttacacctacctaccaaccactacggacgtccgtccgtacgtaccctaacgtgtaagtcgttaacttttacgaacttaaactttacgttaaccgtcgtaaccgtaagtaccttaaggtttaaacttttaaacgttttcttccggttacgttccccggttttacccggttcgggtaacccgggtaacggggtaccgtaagggtcggtaacgtacgaacgaacgtacgaacggttggtcgtactacgtacccgacttacgtccgttcgttaccttacgtccttcccgtcccggttac

SEQ ID NO: 270882 - DNA, 843 bp, Homo sapiens
  misc_feature: GYAE6OF01DUBLU.25.87.H10.1.454.CMB.1.raw
tcagactgtacagtcacgaccggtgctcgatttagcagtactgcgttgggtttgggggtcagacccagtcaggacacagcatggacatggagggtccccgctcagctccgtggggctcctgctgctctggcctcccgaggtcgacccaatgtgacactccgaggtcgacccagtcctcccttccacccgtgtctgacatcgtaaggtaggggaccaggtacgtccaaccactcgtacgttcgggcccgggccgtagggtcggaggttggttggggtcggttcgttttcgggccgttggtactcgacgaccaaaccgaaaccgaacgggtaaacccgacccctaaactcccctaccgtacgtagtcggtaacgggtccttaccgtttactttaccgactaccgtacggtaccgtacccctacggtaacggttcgacggcggtacgtaggtacggtactacggtacgggaacgtacgttagtttacccacttccgtaccaccgtactacgacggaccacgtccgtacgcgtacgaccgtaagacgttacgtttacaccgttaacctaaacgtttacgtttaacttaaccgttaaacgttaaaacgtttaacgttttaaacccgtacccttttaacccttcccgtttcccgtttaccgggtaccggggtaaccggggtaacgggttaacggaacggttaagggtaccgaacgttaaaaccggtaaaggtaccgtttgggaacccgtttcccggaacgttccccgtaactttacccgtaccgttttacccgtttaccgtacccgttttaacccgtttcccccggtcccgttaacccgtttaacccgg

SEQ ID NO: 270883 - DNA, 618 bp, Homo sapiens
  misc_feature: GYAE6OF01A1WPP.25.87.H10.1.454.CMB.1.raw
  modified_base (232)..(232): a, c, t, g, unknown or other
  misc_feature (232)..(232): n is a, c, g, or t
  modified_base (260)..(260): a, c, t, g, unknown or other
  misc_feature (260)..(260): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccaggggcaggtgaagccttcggacgacccctgtcccctcacctgctctgtctctggtnacctccatcaccagtatgctcattacgngggctggcctccgccacgccccgagggacggctggagtgatgcgtatttcgtcttcagtaggtgggagtcgaccttaacgtacaccgtcccctacctacaacgtacgtccgacgtccaccttacgtttcggtagacctaccgtccacgcacgtcgtagtttcgtctcgtacgactacgtcgtacgtcgttcgtccgaccgcccgccgacgccggtccgtcttacttacgtggtcgacgtaggacgtaccgacggtaccggtaacccgaaacccccgttaaccctaaccccgttcgttaccgaccgtacccggtcgggacccgaacgggtaccgtcggtaccacccgtccacccgtccg

SEQ ID NO: 270884 - DNA, 640 bp, Homo sapiens
  misc_feature: GYAE6OF01C2JNJ.25.87.H10.1.454.CMB.1.raw
  modified_base (184)..(184): a, c, t, g, unknown or other
  misc_feature (184)..(184): n is a, c, g, or t
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (309)..(309): a, c, t, g, unknown or other
  misc_feature (309)..(309): n is a, c, g, or t
  modified_base (526)..(526): a, c, t, g, unknown or other
  misc_feature (526)..(526): n is a, c, g, or t
  modified_base (625)..(625): a, c, t, g, unknown or other
  misc_feature (625)..(625): n is a, c, g, or t
  modified_base (637)..(637): a, c, t, g, unknown or other
  misc_feature (637)..(637): n is a, c, g, or t
tcagactgtacagtcacgaccggtgctcgatttagcagtactgcgttgggtttggggctttctgagagtcatggacctcctgtgcaagaacatgaagcacctgtgttcttcctcctgctggtggcggcgccagatcgggtcctgtcccagctgcgtctgcaggagtcgagcccgagggcaggtnaacgccttcgggactaccctgtccctnacctgctctgtcctgtggtacncctcatcacagtangctacattacgtgggctggcctccgccgacgccccgagggtaacggccgttaggagtaggtnttcgcgtatttcggttccttttagaatagggtggtacgtcggacccttaacgtacaaccggttcccctacccgtagaaagtacggttacggaacgtcctaaccttagttttcggtacgaacctaccggtaccaacgccgagctagttcgtacttcgagactcgtagtaccgtcgtgcgaccggccgtaccgacgaccgttcccgtatacgttaccgngtcgacggtagtacgacgacggtcgaaccggtaaaacccctacctaaacccgttcttacggaacctccgggttccggaccgtaacgggacgttcgaccnccgtctaacccnccg

SEQ ID NO: 270885 - DNA, 629 bp, Homo sapiens
  misc_feature: GYAE6OF01ESQR3.25.87.H10.1.454.CMB.1.raw
  modified_base (359)..(359): a, c, t, g, unknown or other
  misc_feature (359)..(359): n is a, c, g, or t
  modified_base (499)..(499): a, c, t, g, unknown or other
  misc_feature (499)..(499): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcacagtatgctcattacgtgggctggctccgccacgcccccgagggacggccgtggagtggattgcgtatttcgttctttcgataggtgggagtcgacctactacacgtcccctaccctcaagngtacgagtcaccgtagtttcggttagactacgtccacgcagtctagttcgtctcgtgactacgtcgacgttctcggtccgaccgggcccgccgaccgtccggccgttcttaacgttaccgtggtcgacggtagcgtacgnggtaccgaacgttaacccggaaacccccttaacgtaacccccctttaagtttacccggaaccctacccggtacggggtaccccgaaacgggggttaacccttcgggtacccacccggttccgtaaccccg

SEQ ID NO: 270886 - DNA, 834 bp, Homo sapiens
  misc_feature: GYAE6OF01AW5MA.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcagggtgaagtccttcggacgaccctgtccctcacctgctctgtctcgtggtcgacctccatccaacctagttaatcgctactattacggtggggctcggcctcccgaccgaccggacccccggaaggggaaccgggtccgtagggacgtcgggtagttcggtccggttattttcggtttaccttttacgtaaggttacgggttaggggtacgttacggtacccgttaacgttaccgtacccgttccccctacccgtacgaaacggtacggtaccgtaacgtaccctaaccgtttacggttttaccgggtacgtaaccgtacccggtacccgaccggtaccacggtacgttacgggtttcgttaccgttacgtacgtaaccgtacgtttacggtaccgttaccgttcggtaccccggaccgggtaccccgacccggtacccggtacccgggttccctttaccgttaacggtttcgtcgggttacggtggtaacgtcggtaccggacgggtacccggtaaaccccggtaaaacccccttaacccgtaaccccgtttacgttacggaaaccccggtaccgggtaccgggggtacccggtaaaccggggttacccggttacgggtaaccccgtacccggttccctaacccggtacccg

SEQ ID NO: 270887 - DNA, 674 bp, Homo sapiens
  misc_feature: GYAE6OF01ADK9D.25.87.H10.1.454.CMB.1.raw
tcagactgtacagtcacgaccggtgctcgatttagcagtactgcggttgggtttgggggctttctgagagtcatggacctcctgtgcaagaacatgaagcacctgtggttcttcctcctgctggtggcggcgcccagatgggtcctgtcccagctgcgtctgcgaggagtcgagcccaggggcaggtgaagccttcggacgaccctgtccctcacctgctctgtctctggtcgactccatcaccagtaactcgctcattacgtggggctcggctcccgccacgcccccgaggggaacggcccgtgggaacggtggacgttcggcgtagtttggtccttttacgtagttacgggtgggacgttcgtcccgtaccgttaccgaccgttcccctcctactaaggcgttcggacgttcctaaccgtacgttttcggtacgaccgtacgttcccacgtccagtcgtagttcgtcttcgtacgacctacgtcgaccgtcgtcgtaccgacggcccgtccgactaccgggtcttactacgttacgtcgtgccgagacgccgtacggtacggtaccgtaaaacccccgtgtaaacccccgttgtttaccggaaccgtcccggttacggggacccgaacggggtaccctacggtacccctacccggtcctacccgttaccccg

SEQ ID NO: 270888 - DNA, 692 bp, Homo sapiens
  misc_feature: GYAE6OF01D98NE.25.87.H10.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccggccagtcggagtggttggggcggtctttttggcctggtatcagcaccaaaaccaggggaaacnccccaaaactcctcctctatgagcgtctactttacacactgactcccctnaaggttcagcggcaggtgatctagggacagacttcaactctacacctatcgagtccggaccttggacctaaccgtgtaagtgttatttttacgacttaacctttaattacgttcgaccgtaactccgtaagtttaacttttaaattttttaccgtccttttcgggtccccgtttttccccggttttacgggtaccccggtacggggggtaaacccgttaggggggttacggaacggtacggtaaccgaaaacggggtcccgtaaaggttcgggttaaccgggacttcgggtaccctaacccttaaggttcccgtttacggtttcctttacctaaccgtttccccgttaccccccggtaaccg

SEQ ID NO: 270889 - DNA, 606 bp, Homo sapiens
  misc_feature: GYAE6OF01BJ0T5.25.87.H10.1.454.CMB.1.raw
  modified_base (249)..(249): a, c, t, g, unknown or other
  misc_feature (249)..(249): n is a, c, g, or t
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagacccctgtccctcacctgctctgtctcgtggtgacctccatcaccagttaangctcattacgtggggctggcctccgccacgcccccaggggaggccctggagtggattgcgatttntcttttcgagttaggtgggtagtgccctatacacgttccccnccctacgaagagtcgagtcacctatttcggtgaccncgtccacgnacgcagttnctctgacatgcttcgcgtcgacggccgccgacnccgggtcctcttacgttacgtgtcggacgagtacgtcgacgtccgggtaccgaaaaccccctaccgtaaaccccgttcgtttacgacccgttaaccgggtcccggggtaaccgtaacccgggggtaaccgtcggtacccgacccgttaccgccccgtaacccg

SEQ ID NO: 270890 - DNA, 744 bp, Homo sapiens
  misc_feature: GYAE6OF01D86QZ.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaacgtccttcgggacgaccccttgtcccctcaccgtgccttcgtcgtctcgtggtcgacctccatccaaccagtatgctactacttacggtgggctcggcctccgccgacggcccccgaggggacggccgtggaggtggattggcgtagtttcgtctttagagttggtgggacgttcgacctacgtaccgtcctccccgttactacgaagtacgtacggacgtacctacgttacgttttcgggtacgacgtacccgtaccgaacgtcgaacgtccgttaaggtttccgtaccttcgtacgaccttacgtacggtaccgttcgtaccgtccggacccgggaccccggaccgaccggtacccgggttcctaacgtttaacgttccggtgggttacggacgtacggtacggtaccgtacgggtacccggttaaccccgaaaacccccttacccggttaaaccccgttcgtttaccggaccccggtaaccgggtaccgggggtaacccgtaaccggggtaaccgtttccgggaccctaccccggtaccgaaccgttaccccgg

SEQ ID NO: 270891 - DNA, 832 bp, Homo sapiens
  misc_feature: GYAE6OF01EY42A.25.87.H10.1.454.CMB.1.raw
  modified_base (272)..(272): a, c, t, g, unknown or other
  misc_feature (272)..(272): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcgcgcccagatgggtcctgtcccagctgcgtctgcaggagtcgagcccgaggggcaggtgaacgtcccgttcggacgacccctcgtccctacacctgcctctgtctcgtggtcactccatcaccagtaatcgctactagttacggngggccttcggcctcccgaccacccggacccccggaaggggaaccgggtccgtagggtacggttacgggtagtacggcggttagtttccgtttcgtttaacgtaggttagggttacggggtacgttaccggtacccttaaaccgttaccgttacccggtttacccccctacccgtaacggaaacggtacggttacccggtacgttaccccttaaccgtttacgggttttaccggttaccgaaccgtacccgttacccgaacgtcgtaacgtcgttacgttacgtccctacgtaacgaccgtacggttcctaacgggttcctcgggtacccgacccgggtcccggtacccggtacccgtacccgggttcccgttacgttaaccgtttccggtgggtaccggtaggaacgggttaccgacggtaacccgggtacgggttaaacccccaaacccccgttaacccgtaacccgtttaccggttaacgaccccggttaccggggacgggtacccgaaccggggttacccgtacgtaccccgtaccccgtccgtaccgtaaccccgg

SEQ ID NO: 270892 - DNA, 718 bp, Homo sapiens
  misc_feature: GYAE6OF01DTXDV.25.87.H10.1.454.CMB.1.raw
  modified_base (137)..(137): a, c, t, g, unknown or other
  misc_feature (137)..(137): n is a, c, g, or t
  modified_base (218)..(218): a, c, t, g, unknown or other
  misc_feature (218)..(218): n is a, c, g, or t
  modified_base (266)..(266): a, c, t, g, unknown or other
  misc_feature (266)..(266): n is a, c, g, or t
  modified_base (626)..(626): a, c, t, g, unknown or other
  misc_feature (626)..(626): n is a, c, g, or t
tcagactgtacagtcacgaccggtgctcgatttagcagtactgcgttgggtttgggggctttctgagagtcatggacctcctgtgcaagaacatgaaacacctgtggttcctccctcctgctggtggcagctccagngtggtcctcgtccagtgcagctgcgaggacgtccgggcccaggtcgtggtagacgtccttcgaccgtacgccctcgtcccnctacctgcacgttcgtctcgtggtcgccttcactcgactagtgttacncgtactacgtggacgtcgtggtacctccggacacgaccgaaccggaggggaacgtccgtaggaggtcggtagttcggaactgtacgttacgtaccggaggtcacccttaccgttactaaccccgtaaccgttccaacgttaagtaccggttcgaacctttaccaactcctacgttacctaaacgtaacgtaacttacccgttaagttaaaaccacccgttaaccgttccgtaacccgttaggttaaaccgtttcaaccgttcgtacgttaccgtaccgtcgggacccgaggtacccgtcgggtacctttacgttacgttacgtggaccgacggtactaacgttccgaacttacgttacgnggttccggtaacctataccaccgtaactcgacctcggttaagttcttatttaacggtacgtaccggtacgggttaacggaccggaaaacggg

SEQ ID NO: 270893 - DNA, 785 bp, Homo sapiens
  misc_feature: GYAE6OF01A4POC.25.87.H10.1.454.CMB.1.raw
tcagactgtacagtcacgaccggtgctcgatttagcagtactgcgttgggtttgggggtcagacccagtcaggacacagcatggacatgagggtccccgctcagctcctggggctcctgctgctctggcctcccaggtcgcccaatgtgacatccaggtcgacccagtctccttccaccctgtctgcatctagtaggggacagagtccaccatcacgttcggccggccaggtcggaggttggttcgggcggttcgttttcggccgttggtactcgagacaaccgaaaaccgaagggaaaccgacccctaaacttccctccctactagtcggacggtccgttacttaacctttaccaccgtacgttacggtaccgtacccccttagtaacggttccgaacggccggtacgtaggtcggaacgttcgtacggggaacaacggttaacttcctaaccttcctaccaacccattaccgaacggtcccggtacctacgggtaccctaaccgttgtaacgttacgtttaacgttttacgaacccgtttaaacttttaacgttacccgttccggtaaccctaacgtaaccgttaagttttaacctttttaacgttttttaaccgccgttttacggtttcccgtttttcccgtttacgggacccggtaacgggggtaccgtaaggggttacggaacgtacggaccgtaacggaccgtaacgttcgggtcgtacgtacggaccctaccctaagttccgttacgtccttaccgacttttccccgtcccgttaccg

SEQ ID NO: 270894 - DNA, 844 bp, Homo sapiens
  misc_feature: GYAE6OF01CE4SK.25.87.H10.1.454.CMB.1.raw
  modified_base (216)..(216): a, c, t, g, unknown or other
  misc_feature (216)..(216): n is a, c, g, or t
tcagactgtacagtcacgaccggtgctcgatttagcagtactgcgttgggtttggggctttctgagagtcatggacctcctgtgcaaagaacatgaagcacctgtgttcttcctctgctggtggcgcgcccagatgggtcctgtcccagctgcgtctgcaggagtcgacgcccgaagggctaaggtgaacgtccgttcggacgtaccctcgtcccnctacctgctcgttgtcctcgtggtcgcctaccgactaccgaacctaagtaattcgacctataacgttacggtgggtcctcgccgtccgaccgaccgccccggaagggaacggtccgtagggacgtacggttagtcggacgttatttcgttcgttaacaagtttaggggtacggtaacgttccgtaacccgttaacgtaccgttacccgttccccttaccccgtaagtaaacggtacggttcgaaccggttacccttaaaccggttacggtttttccggaacgtaaacccgttccgtacccgaacgtcgacgttacgtagtttacgtacctagtaccgtaacgtagtccgttaacgtcgttcccgaacccgtcggacccccgacgtaaacccggtaccggttaccgttagtttaacccgtttaagccgggttaacgaccggtaaggtacccttacgggaaccggttaacccggttaaaccccggaaaaacccccttaaccccggttaaaccccccgtttagttaaccccgggaaccgttaccccggggtaacgggtaacccccggtaaacgggggtacccgttacggtttaaccccccgaaaccgtaccccgtcccttaaaaccccggg

SEQ ID NO: 270895 - DNA, 798 bp, Homo sapiens
  misc_feature: GYAE6OF01B3JDZ.25.87.H10.1.454.CMB.1.raw
tcagactgtacagtcacgaccggtgctcgatttagcagtactgcgttgggtttgggggtcagacccagtcaggacacagcatggacatgagggtccccgctcagctcctgggctcctgctgctctggctcccaggtcgcccaatgtgacatccgaggtcgacccagtcctcccttccaccctgtcctgctatctagtagggacagacgtacaccatacacgttcgccggaccagtcggagtggttcgggcgtcgtttggaccgttggtactcgagaccaacgaaaccgaagggaaaacccgccccctaaaactccccttacccttacctaagtcgtaacgggtccttacctttaacctttaccaaccgtaccggttacgggtacccgttaccccgtacgtaacggtttaccacggccggtacgtagtacgggtatccggtagggaactaggaaactttccgaacctcgtacctaccgaagtccgacggtcccgacctccgaacccgtaaccgtacgttaagtacgttaacgttttacgtaaccttaactttaaccttacgttccgtaccgtacgttacgtaagtttaacgttttaactttttactaccgtttacgtttccccggttttaccgtttacggggacccgggttaacggggtaccggtaacggggtacgggtaacggacggtaaccgtaacggtaccgtaaacggttgggttaccggtacgtaccggacctaccgttaacgttcgttaccgttaccttaccgtacccgttttcccgtaccccgttaacccgg

SEQ ID NO: 270896 - DNA, 818 bp, Homo sapiens
  misc_feature: GYAE6OF01B6YH8.25.87.H10.1.454.CMB.1.raw
  modified_base (207)..(207): a, c, t, g, unknown or other
  misc_feature (207)..(207): n is a, c, g, or t
  modified_base (275)..(275): a, c, t, g, unknown or other
  misc_feature (275)..(275): n is a, c, g, or t
  modified_base (309)..(309): a, c, t, g, unknown or other
  misc_feature (309)..(309): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgacgcccgaggggctaggtacgaacgccttaccggganacccctgtcccctcaccctgccttcgtcgtcgttcgtggtactacctccataccaaccgtagtaatcnccttacgtaacgttacggtgggccgttcggcccncccggaccaccggacccccggaaggggtaacgggccgtagggaggttggtacttcggacgttacgtttcggtttactttacgaagtttagggacgggtacgtaccgtacctaacgttaccgtacccggttccccctaccgttaacgaacggtacggttccgaaccgtaccgtaaccgttacggtttttaccgggtacgaaaccgtacccggttaccccgaacgtccgaaacgtttcgttacggtttaccgttcgttaaccgtacgttaaaccgtccgtaaaccggtcggtttaccgacccggttaaccggccccgggtaacccggacccgtaaccgtcccgggtacccttattaacggttccgtaggtacgacggtaacgtacggtacgacgggtaccgtaaacccggttaaccccctaaacctacccgtttagtaccggaccggtacccgggtacgggtaaccgaacccgggttcgttacgaccccgtccttaccgacccgttaaccg

SEQ ID NO: 270897 - DNA, 550 bp, Homo sapiens
  misc_feature: GYAE6OF01CTDBS.25.87.H10.1.454.CMB.1.raw
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (388)..(388): a, c, t, g, unknown or other
  misc_feature (388)..(388): n is a, c, g, or t
  modified_base (427)..(427): a, c, t, g, unknown or other
  misc_feature (427)..(427): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctagtaggggacagagtcaccatcacttgccgggccagtcggagtggttgggcggtctttggcctggtatcagcacaaacgaggaaacnccccaatcctctctangaggctctacttacacactggactcccctagtaaggtcagcgcagtgatcgtgganagtaattcactcncacatcagcgctgacactgatgtatttnactaattatctcgacagtctaagttatttaactttttcncgttcgttccgtttcccttttgggaccgtaggggtaccgaggggtgacgaggactaaaggcctaaggttgtacggctggaccaacctgttcctagttccttataccttcccgttcccgtaacc

SEQ ID NO: 270898 - DNA, 659 bp, Homo sapiens
  misc_feature: GYAE6OF01DVG80.25.87.H10.1.454.CMB.1.raw
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttcgccgggcaggtcggagtggttgggcggtcgttttggactggtatcgagtacaacgaaaccgacgggaaaccgccccaaactccctactctagtggacggtcttcttactttacactacgtggaccttcccctagtaacggttcacggcggacaggtggactcggtacgggaacaggtacttacgactctaccacactcgaggccggcctgacctacgtgattggttactttagaccttaactttacgtaccttacgaacctaaactaaataaattaaagtttaactttaacgttccgttaacccgttaacgttttcgggaacccggtaacgggggtaaccgtaagggttacggaacgtaacgtaacgtaaaccgtagtcggtgtaccgtcgacctaacgtcgttacttcggttacttccaccttcccgttaccgctcgttaaccg

SEQ ID NO: 270899 - DNA, 791 bp, Homo sapiens
  misc_feature: GYAE6OF01A69DL.25.87.H10.1.454.CMB.1.raw
  modified_base (130)..(130): a, c, t, g, unknown or other
  misc_feature (130)..(130): n is a, c, g, or t
tcagactgtacagtcacgaccggtgctcgatttagcagtactgcgttgggtttgggggctttctgagagtcatggacctctgtgcaagaacatgaagcacctgtggttcttcctcctgctggtggcggcncccagatgggtcctgtcccagctgcgtctgcaggagtcgagcccgagggcaggtgaacgccttcggacaccctgtccctcacctgctctgtctcgtggtacacctcatcacagtatgactctattacgtggggtctacggtcctcccgaccgaccggacccccggaggggaaccggtccgtaggaacggtggtacgttcggtcgttatttcggttcctttacgaggttacgggtgggtactacgtaccgtaccgtacgtaccttcccctacgtaactaacggtactccggactaccttaaccgttacgttttaccgggtaacgtaacccgtaccggtccctaacgacgtacgtccgttaaggttcgttcctaccgtaacgaccgtacgttaccggtacgttccggttaccgaacccggtcccggaccggtaacccggtaccggtacccgggttaccctatttaacccgttccggtagggtaccgtacgggacgtaaccgtaccggaaccgggttaaccgggttaaaacccgtaaacccccctaaaccggttaacccccgtttaacgtacccgggaccccgggttacccgggtaccggggaacccggttaaccgggtaccccggttacgtaccccgacccgtacccggtacctacccccggg

SEQ ID NO: 270900 - DNA, 897 bp, Homo sapiens
  misc_feature: GYAE6OF01BRL4A.25.87.H10.1.454.CMB.1.raw
tcagactgtacagtcacgaccggtgctcgatttagcagtactgcgttggggtttgggggtcagacccagtcaggacacagcatggacatgagggtccccgctcagctcctggggctcctgctgctctggctccaggtgcccaatgtgacatccaggtcgacccagtcctcccttcccaccctgtctgcatctagtaggggacagagtccaccatcactggccgggccagtcggagtggtgggtcggtcgtttcggccgtggtactcagccaacaaaccgagggaaaccgacccctaaactccctcctctacgtcggaacggtccgttaccttaactttaccgaactaccgtacggtaccgttacccccgtacgtaacgggttcgacggtccgggacgtaggttacgggtacgttaccggttacgggggaacaacggttaaacgtttcccgtaaaccttcccgtacccgaacccggtacggttacccggggacccggtacccgtaccggtacccgttaacccgttagtaaccgtttaggtttaaccgtttttccggaaaccctttaaacgtttaacttttaacccggtaccggaacccgttaacgggttaacctttaaaggtttttaaaccgtttttaaacctttttttacgtacccgttttacccgggtttccccggttttttaacccgttttacgggggaccccgggttaacggggggtaacccgggttaggggggtaccgtaagggaaccgggtaacgtaaccgggtaaccgggttaaacggttcggggttacggtacccggtttacggaccccgttaacccggtactttaccgtttaccggtttcccttacccgggtttaccctttcccccggttccccggtactttaacccgg

SEQ ID NO: 270901 - DNA, 760 bp, Homo sapiens
  misc_feature: GYAE6OF01BMBU9.25.87.H10.1.454.CMB.1.raw
  modified_base (164)..(164): a, c, t, g, unknown or other
  misc_feature (164)..(164): n is a, c, g, or t
  modified_base (466)..(466): a, c, t, g, unknown or other
  misc_feature (466)..(466): n is a, c, g, or t
  modified_base (482)..(482): a, c, t, g, unknown or other
  misc_feature (482)..(482): n is a, c, g, or t
tcagactgtacagtcacgaccggtgctcgatttagcagtactgcgtttgggtttgggggctttctgagagtcatggacctcctgtgcaagaacatgaagctacctgttggttcttcctcctgctggtcggcgcgcccagagtgggtcctgtcccagctgcgtcngacgaggagtccgacgcccgagggtaccgaggtagaaccgtccgtttaccgggacgtaccccttgtaccccctctcctgtccttcgttcgttacttcgttacggtccaccttaccactaccgtaacctaaggttaatcgtactacgttaacgtttacggcgggtctcggtcctcgtaccggaccccgaaccggaccccggtaaggggaccgtccggtaggtaacggtgttagtacgtacgttgtttcgtttctacgtagtaagggtcggtatccgtacctaacgctacccgtccctaacganaacggtcaacggtacncgttagttacggtttacgacgtaaccgacctaccgaacgtctacggtacttcggtttcactcgtaacgtactacgtcgtaactcgtccgtaccgacccggccgtaccggacttaccggtcttaagtttaccgagggttcaacggtacgacgtacggtccgaacggtaccccgttaaacccgaaaccccttacgttaacccgtttaggacccggtaccggtacccgggtggaacccggtttacggaaccccggttaatcccgaccgttccgaacccggg

SEQ ID NO: 270902 - DNA, 749 bp, Homo sapiens
  misc_feature: GYAE6OF01CF7ZV.25.87.H10.1.454.CMB.1.raw
  modified_base (256)..(256): a, c, t, g, unknown or other
  misc_feature (256)..(256): n is a, c, g, or t
tcagactgtacagtcacgaccggtgctcgatttagcagtactgcgttgggtttggggctttctgagagtcatggacctcctgtgcaagaacatgaagcacctgtggttcttcctcctgctggtggcgcgcccagatgggtcctgtcccagctgcgtctgcaggagtcgagcccagggcaggtgaagccttcggagaccctgtccctcacctgctctgtactcgtgtcgactccatccaccagtatgctcattacgnggctggctccgcacgccccgaggacggctggagtggtatgcgtagttcgttcttcagtaggtgggactcgcctactaccgtacgtcccctacctcgaacgacgtcaacgtctaaccgttaagtttccggttacgaccgtaccgaccccgtacgaccgtacggtaccgttacggtttacgtcccgttacgttacgaacccgtacgttagggtacccgttccgttaggtaccccgaacccggggccccgtaccgaccggtaacccgggtccgttacgttaacgtttcccggtagttacgggacgtaacggtacggtacccggtaggtaccccggggttaaacccgtaaaaccccccttaaaccccggtacccccccgttttaaaggtttcccggaaaccccggttccgggtaacccgggggtaccccgttaaaccgggggtaaacccgttccgggtaaccccgtaacccccggttcgtaccccgttaaccccggg

SEQ ID NO: 270903 - DNA, 723 bp, Homo sapiens
  misc_feature: GYAE6OF01B5BPN.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgagtccttcggacgacccctgtcccctcacctgtccttacgtcgtcttcgtaggtctacctccatccaacgtaggttaatcgctactacgttacggtgggtctcggcctcccgaccgccggacccccggaaggggacgggtccgtaggacggtgggtacttcggcggttagtttcgtttcttacgtagttagggtacgggtatccgtacctacctaccgtccgtccccacccgtagagtacgtcgacgtcctaacgttcgtttggtacaccgtacccgtccaacgtcacgtcgttaggttcgtccttacgacaccgttccgtagacccgttcgtcgaacccggtccggtaccccggccgtaacgcccgggttcctaacgtttacgtacgtgggttccgagtcgacgttcgaaccgggtcggtaaacccccgaaacccctaaccctaaccccgtttacgtacccgaacccggtccggtaccggggaaccccgtacggggtaccctttacgggaacccgtccctaaccgcccgtacccggg

SEQ ID NO: 270904 - DNA, 880 bp, Homo sapiens
  misc_feature: GYAE6OF01AWSYX.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtgttcttcctcctgctggtggcgcgcccagatgggtcctgtcccagctgcgtctgcaggagtcgacgcccgagggcagggtgaacgtccgttcggacgtaccctgtcccctcgacctcgcttcgtcgtcgttcgtcgtcgaccttccacttaccaaccgtaagttaacgtcgtaccgttacgttacgttacgggtcgggtccggtccgtcccgtacccgacccgtacccggaccccgggtaacggggtaccggtaccggttagggtacggtcgggttacggtcggtacggtttacgttttccgtttaccgtttacggtaagggttagggttacgggtaacgttaccgtaacccgttaacccgtaccgttacccgttccccgttaaccgtaacgtaacggtacgtaccggttaaccgtaccgttaaccgtttacgggtttacgtaccgacccgttacccgtacccgtacggtacgtacggtaccgttacggttaccgttaccgttaccgtacgtacgtacgtaccggtaccgttaccggttaccggtacccggacccggtacccggacccggtacccgtaccggtaccgttacgttaaccgttacggtacgtacggtacggtacgtacgtacccggtacgggtaacccggtaacccgtaaaccccgttaacccgtaacccgttaccgttaccgggtaaccggttacccgggtaccgggtaacccggttaaccgggtaaccgtacccggtaacccgtacccgtcccgtaacccgtccg

SEQ ID NO: 270905 - DNA, 814 bp, Homo sapiens
  misc_feature: GYAE6OF01AK1X5.25.87.H10.1.454.CMB.1.raw
  modified_base (130)..(130): a, c, t, g, unknown or other
  misc_feature (130)..(130): n is a, c, g, or t
  modified_base (295)..(295): a, c, t, g, unknown or other
  misc_feature (295)..(295): n is a, c, g, or t
  modified_base (798)..(798): a, c, t, g, unknown or other
  misc_feature (798)..(798): n is a, c, g, or t
tcagactgtacagtcacgaccggtgctcgatttagcagtactgcgtttgggtttgggggctttctgagagtcatggacctctgtgcaagaacatgaagcacctgtggttcttcctctgctggtggcggcncccgagtacgtcgggtcctcgtcccagctgcgtctgcgaggagtcgacgccgagggcgagggtgaacgtccgttacggacctacccgtcgtccctcacctcgcctcgtcgtctcgttggacacttccataccactagtatcgctctattacggtcggtctcgccnccgaccgaccggacccggaggggtaccgtcggtggtacggtcggtacgttcggacgtttcgtttcgtttacgtttacgtaaggttggtcgggtaacggttcctacccgtacgttacccgtccgttacccccttacgtaacgtacggtacgtacggtacctaccgttaaccgttacggtttaccggttaacgaccctaccggttaccgacgtaccgcgttaccggttagtttcccggttacttcgaaccgtaaccgtacgtttcggccggtttcctaacgggtcccccgacgggtcccgaaccccgggtacggttaccccgggttacgtttaagtacccgttttacggcggggttacgagggtacgttacggtaaccgggccggttaaaccgggttaccccgaaaaccccttttaccggaacccgttttacggtacccgtaaccggggcccggtaaccggggttaaccccggaacgggttacccgggttacccgtaccgtaccnccccgttcgtaacccg

SEQ ID NO: 270906 - DNA, 806 bp, Homo sapiens
  misc_feature: GYAE6OF01DYF69.25.87.H10.1.454.CMB.1.raw
  modified_base (578)..(578): a, c, t, g, unknown or other
  misc_feature (578)..(578): n is a, c, g, or t
tcagactgtacagtcacgaccggtgctcgatttagcagtactgcgttgggtttgggggtcagacccagtcaggacacagcatggacatggacgggtccccgctcagctccgtgggctcctgctgctctggctcccgaggtcgcccaatgtgacatccgaggtcgaccagtcctcccttcccacctgtctgctatacgtagtaggggacacgacgtaccacctatccgtacgtcggcccgggtaccgtaggtcgggtaggttgggttcggggtcggttcgttttcggtccgttaggttactcgacgaaccgaaaccgaaaaccggaaccgggaaacccgaaccccctaaaccgttccccttacccttaccgttagtacgggtacggtaccgttaccttaacctttaaccgaccgtaccggttccggtacccgtaccccgtacggtaaacggttccgacggtcggacgtaaggttcggtacgttccggtaacggacgtaagtaaccgtttacctaccctactaccgacctacgtaccggaccgtcccggtaccttacgaacccttaccgtgtaacgtttntttaaccgtttacaaccgttaactttgtacccgtacgacgttaacgtagtttaacgttttaaacttttacgtttcccgttacgttccggttttcccgttttacccggttagggaccgggttaacgggacgttaggggagtacggtacgacgtaaccgtgtacgttcgggtcgcgtaccgtcgtaacctcgttacgtccgttacgttacctcccgttccggtcccttag

SEQ ID NO: 270907 - DNA, 741 bp, Homo sapiens
  misc_feature: GYAE6OF01BEGB0.25.87.H10.1.454.CMB.1.raw
tcagactgtacagtcacgaccggtgctcgatttagcagtactgcgttgggtttgggggtcagacccagtcaggacacagcatggacatgagggtccccgctcagctcctggggctcctgctgctctggctcccaggtgccaatgtgacatccaggtcgaccagtctccttccacctgtctgcatctagtaggggacagacgtcacctatcctacttcggcccgggcctaggtccgggaggttcggttggggcggtcttttacggccgttgggtactcgagaccaaccgaaaaccgacggggtaaaacctacccccaaacgtcccgtacctactagtggacggtccgttccttacgtttaccactacgtcggtaccgtcccctacgtaacggttcgaacgcggtacgtacggtacggtactcggtacgggaactagtaacttccgactcgtacacacgtcacggtccgtcctgtaccgaacttgaacgttagttacttttacggactttaacttacgttaccgtccgtaacgtacgtaacgtttaagttaactttttaacttttacgtcgttaccgtttcccggttttacccgttacggggtacccgtacggggggtaccgttagggggtacggtacggaccggtaggtaacggtaccggaacggttcggttacggtccggtacgtccggtaacctccgttaccgttcgttaccttacctaccgttcccgttacccggtacc

SEQ ID NO: 270908 - DNA, 502 bp, Homo sapiens
  misc_feature: GYAE6OF02IWZ6K.25.87.H10.1.454.CMB.1.raw
  modified_base (324)..(324): a, c, t, g, unknown or other
  misc_feature (324)..(324): n is a, c, g, or t
tcagactgtacagtcacgaccggtgctcgatttagcagtactgcgttgggtttggggtcagacccagtcaggacacagcatggacatgagggtcccgctcagctcctggggctcctgctgctctggctcccaggtgcccaatgtgacatccaggtgacccagtctccttccaccctgtctgcatctataggggacagagtcaccatcacttgccgagccagtcggagtgttgggcggcttttggcctggtatcagcacaaaaccagggaaagcccccaaaatcctcctctatgaggcgtctactttacacactggagtcccctnaaggttcagcggcagtggatctgggacagaattcactctcaccatcagcggcctgcaacctgatgatttgcaacttatactgccagcagtataattttactctgcgttcccttttggccaggggaccagggtggagagcaagcgaactgtggctgcaccatctgtcttcatcttcccg

SEQ ID NO: 270909 - DNA, 515 bp, Homo sapiens
  misc_feature: GYAE6OF02GFFMB.25.87.H10.1.454.CMB.1.raw
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
  modified_base (327)..(327): a, c, t, g, unknown or other
  misc_feature (327)..(327): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagactgtacagtcacgaccggtgctcgatttagcagtactgcgttgggtttggggtcgtagaccagtcaggacacagcatggacatgagggtcccgctcagctcctgggctcctgctgctctggctcccaggtcgcccaatcgtgacatccgaggtgacccagtctccttccaacctgtctgcaatcgtataggggacagagtcaccatcacttgccgggacagtcggatgttgggcgcttttggcctggtaatcagcacaaacngggaaacnccccctaaatcctactctaancgaggctctacttacacactggactcccctnaaggttcagcggcagtgatcnggacngaattcactngaccatcgagcgtctgcaactgatgtactttgctaacttntacggtnacagcagtataattttcntgggtcttctttgaccagggtcctaggggttcgagacgcaagcgaactggtagcctgccacctagtntgtcctnacttcttacccgc

SEQ ID NO: 270910 - DNA, 527 bp, Homo sapiens
  misc_feature: GYAE6OF02G58AK.25.87.H10.1.454.CMB.1.raw
  modified_base (275)..(275): a, c, t, g, unknown or other
  misc_feature (275)..(275): n is a, c, g, or t
  modified_base (329)..(329): a, c, t, g, unknown or other
  misc_feature (329)..(329): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggccctcccaggtgcccaatgtgacatccaggtgacccagtctccttccaccctgtctgcatctataggggacagagtcaccatcacttgccgggccagtcggagtgttgggcggcttttggcctggtatcagcacaaaccagggaaanccccccaaatccctcctctatgaggcgtctactttacacactggagtccccctnaaggttcagcggcagtggatctgggacagaatttcactctcaccatcagcgcctgcaacctgatgattttgctaacttattactgccagcagttataatttttactcttgtccgtttcccttttggccctaggggtacctaggggttggagagacgaagcgaactggtggctggcaccatctgtcttcatcctcccgc

SEQ ID NO: 270911 - DNA, 532 bp, Homo sapiens
  misc_feature: GYAE6OF02G2LOR.25.87.H10.1.454.CMB.1.raw
  modified_base (278)..(278): a, c, t, g, unknown or other
  misc_feature (278)..(278): n is a, c, g, or t
  modified_base (330)..(330): a, c, t, g, unknown or other
  misc_feature (330)..(330): n is a, c, g, or t
  modified_base (374)..(374): a, c, t, g, unknown or other
  misc_feature (374)..(374): n is a, c, g, or t
  modified_base (462)..(462): a, c, t, g, unknown or other
  misc_feature (462)..(462): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtggacagtccaaggtgacccagttctccttccaccctgtctgcatctataggggacagagtcaccatcacttgccgggccagtcggagtgttgggcggcttttggcctggtatcagcacaaaccagggaaacncccccaaactcctcctctatgagcgtctactttacactactggactcccctnaaggttcagcggcagtcgatcgtgggacagaattcactctcacntcagcgcctgcactgatgtatttgctaattattactagtactaaaatttcgactagtgaccgtgatgtcggccaggtaccaggtcganactacgaaacgactggtacgcttgaccacctagtcgttagtcttactacttcccttcccgcctagttacc

SEQ ID NO: 270912 - DNA, 546 bp, Homo sapiens
  misc_feature: GYAE6OF02IT13K.25.87.H10.1.454.CMB.1.raw
  modified_base (275)..(275): a, c, t, g, unknown or other
  misc_feature (275)..(275): n is a, c, g, or t
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgggccagtcggagtggttgggcggtctttggcctggtatcagcacaaaccagggaaacncccccaaactcctcctctatgaggcgtctactttacacactggactcccctnaaggttcagcggcagtggatcgngggacagaattcactctcaccatcagccgctgcaacctgatgtatttgactaacttattactcgccagcaagttattaaactttttactacttcgtccgtttcccgttttggacccgtaggggaccgtaggggttggagagacgaagcgtaacgtggtcggctgacacctatcgtgtccttcacttcctcccgtac

SEQ ID NO: 270913 - DNA, 524 bp, Homo sapiens
  misc_feature: GYAE6OF02GY19N.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagccccccagggaagggcctggagtggattgcgattgtctttcatagtgggagtgcctactacagtccctccctcaagagtcgagtcaccatttcggtgacacgtccacgcagcagttgtctctgacactgacgtctgtcacggccgccgacacggcctctattactgtgcgagagtcagcggtacggaacccctacaaccccttactttcgacctaccgtggggccagggaccgtggtaccaccgtcacctcg

SEQ ID NO: 270914 - DNA, 505 bp, Homo sapiens
  misc_feature: GYAE6OF02FGTD5.25.87.H10.1.454.CMB.1.raw
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (492)..(492): a, c, t, g, unknown or other
  misc_feature (492)..(492): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgggccagtcggagtgttgggcggtcttttggcctggtatcagcacaaaccagggaaacgccccccaaatccctcctctatgaggctctactttacacactggatccccnaaggttcagcggnagtggatctgggacagattcactcncacatcagcgctgcactgatgatttgctaacttatactgccagctagtatattttactctgtcgttcctttggcctagggtaccaggggtgagagcaagcgaactggtggctgccacatctgtccttcncttccttcccgcc

SEQ ID NO: 270915 - DNA, 540 bp, Homo sapiens
  misc_feature: GYAE6OF02GWESC.25.87.H10.1.454.CMB.1.raw
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
  modified_base (452)..(452): a, c, t, g, unknown or other
  misc_feature (452)..(452): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagccccccagggaacgggcctggagtggattgcgattgtctttcatagtgggagtgcctactacacgtccctccctcaagagtcgagtcacctatttcggtnacacgtccacgcagcagttgtctctgacnctgactctgtccacggccgccgaccgccggccgtctacttctgtcgcgagngtcagcggtacgaacccctacaaccccgttacttcgacctacccgtcggggaccacggggacccgttggtaccaccggtcaccctccg

SEQ ID NO: 270916 - DNA, 559 bp, Homo sapiens
  misc_feature: GYAE6OF02HFSMT.25.87.H10.1.454.CMB.1.raw
  modified_base (331)..(331): a, c, t, g, unknown or other
  misc_feature (331)..(331): n is a, c, g, or t
  modified_base (403)..(403): a, c, t, g, unknown or other
  misc_feature (403)..(403): n is a, c, g, or t
  modified_base (441)..(441): a, c, t, g, unknown or other
  misc_feature (441)..(441): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgggccagtcggagtgttgggcggtctttggcctggtatcagcaacaaaccgagggaaacgcccccaaatccctcctctagtgaggcttctactttacacacgtggactcccctanaaggttcaggcgcagtggatcgtagggacagaattcgactctacacatcagcgctagcactgactgtatttnactaacttattactgccagctaagttattaattttacncttcgttccgtttcccgtttgggcccgtaaggggtaccgtagggtacggaagacgacgaagcgtaacgtggtcgctgaccacctagttcgttcgttcttacacttccgtacccgtacc

SEQ ID NO: 270917 - DNA, 563 bp, Homo sapiens
  misc_feature: GYAE6OF02G0VGA.25.87.H10.1.454.CMB.1.raw
  modified_base (327)..(327): a, c, t, g, unknown or other
  misc_feature (327)..(327): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgggccagtcggagtgttgggcggcttttggcctggtatcagcacaaaccagggaaacgcccccaaactcctcctctatgaggcgtctactttacacactggacgtcccctnaacggttcaggtcggcagtggatcgtgggacagaattcactctcaccatcagccgcctgaccaacctgatgtattttgctaacttattacctgacctaaacaattattaaataatttaacttacgaaccttacttttcggacctaagggggacctaagggtggtaagacgtacaaacgtactggtaggacgtcgacacctattcgtgtcttcacttcccgttcccgtctattaccg

SEQ ID NO: 270918 - DNA, 641 bp, Homo sapiens
  misc_feature: GYAE6OF02G8M2U.25.87.H10.1.454.CMB.1.raw
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (349)..(349): a, c, t, g, unknown or other
  misc_feature (349)..(349): n is a, c, g, or t
tcagactgtacagtcacgaccggtgctcgatttagcagtactgcgttgggtttgggggctttctgagagtcatggacctcctgtgcaagaacatgaagcacctgtggttcttccctcctgctggtggcggcgccccagatggggtcctgtcccagctgcgtctgcaggagtcgagcccagggcaggtgaagccttcggagaccctgtccctcacctgctctgtctctggtnactccatcaccagtaatgctcattacngggctgctccgccacgcccccagggacggcctggagtggatgcgagttgtctttcataggtggtagtgccgtactactacgtccctccctnaacgtacgtcgagtccaacctagttttacggtgtactaccggtcctacggccaacgtccgaagttttcggcttactcggaacctacgtgaccgttctaggttccaccgggccgccgtaccgaccggtcccgtacttaacgttacgtgttaggacgtacgtaggtacgtacgggtccggttaaccgggaaacccccttaacgaaccccccgttttagtttaaccgaccgtaacccgttggggacccctaacggggtaacccgtcggtacccgtaccccggtccgacctacccg

SEQ ID NO: 270919 - DNA, 813 bp, Homo sapiens
  misc_feature: GYAE6OF02I82ES.25.87.H10.1.454.CMB.1.raw
  modified_base (183)..(183): a, c, t, g, unknown or other
  misc_feature (183)..(183): n is a, c, g, or t
tcagactgtacagtcacgaccggtgctcgatttagcagtactgcgttgggtttggggcgtttctgagaagtcagtggtacctcctgtcgcgaagtaacattgaagctacctgtggtttcttccttccttgcgtggtcggtcgggcgcccagatgggtcctcgtcccagcctgcgtctgcaggngtcgagcccagggcaggtgaacgcccttaggacgaccccttgtcccctcgaccctgctctgttcttcgtggtcacctaccagtaccaacctagttaatcgtcttcaacgtttaacgtggggaccttacggccgtccgcccgtacgtacccccccgaaggggaacgggcccttagggtaaggtttaggtacggttcgacgtaacgtttaccggttacgtttttcggaacgtttacgggttcgggtagttcggacccgttacgtaccgtacggttccccttcccgtttacgaaacggtacggttacgtaacgtttccaaccttacgttttccggttaccgaaccgtaccgttacccgacgccgtaacgtcgtaagtttcgtaccttcgtagactacgttcggaccgtttcttacgtcctaccgggtacccaccggtaacctaccgggttccgttaccgttaactttaccgtaggtttcggtaccggtaacgttacggtccgtaaagggtccgggtaccggtaaaccccttaccgtaaaccccgttcgttttaacggacctacccggttacggggtacccgaacgggtaaccccgttggttacccgtaacccggttccctaacccgttacccg

SEQ ID NO: 270920 - DNA, 676 bp, Homo sapiens
  misc_feature: GYAE6OF02JV9W4.25.87.H10.1.454.CMB.1.raw
  modified_base (396)..(396): a, c, t, g, unknown or other
  misc_feature (396)..(396): n is a, c, g, or t
tcagactgtacagtcacgaccggtgctcgatttagcagtactgcgttgggtttgggggctttctgagagtcatggacctcctgtgttcaagaacatgaagcacctgtggttcttcctcctgctggtggcggcgcccagatgggtcctgtcccagcctgcgtctgcaggagtcgacgcccgagggcaggtgaacgtccgttcggacgacccctcgtccctcacctgcctctcgtcctcgtggtcacctccatccaacctagtaatcgcctactattacggtcggggcttcggccctccgcccgaccgacccccggaggggaacggccgtagggaggtggtagttggaccgtagtttcgttcctttcagttacggtgggagtcgtacctaccgtaacncgttcccctcctacaagtcgtcgacgtaccacgtacgtttcggtacgacctacgtccacgtaccgagtcgtagtttctcctcgtacgactactcgtaccgtcgttacgtccgaccgggtcccaccggaaccgccggtccgttcttaacgttctcggtgacgtagtacgtacgcggtaccggtaccccgaacccctaactacccccgttagttacggaacctccgggtaccgggacccgaacggggtaccctacggtaccctaccgtcctaacccgtcccg

SEQ ID NO: 270921 - DNA, 800 bp, Homo sapiens
  misc_feature: GYAE6OF02JCU1A.25.87.H10.1.454.CMB.1.raw
tcagactgtacagtcacgaccggtgctcgatttagcagtactgcgttgggtttgggggctttcgtgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccgagtaactcgcctacattaccgtggggccttgggccttaccggcccaacggcccccccgaaggggaaccgggcccgttagggacgttcggaagtttcgaccggtatttgttacgttttccaagttaggtggggtagttcggacccttagtaccgtacgttccccctcccgttaccgaaacggtacgtccgaacgttcctaaccctacgtttttccggggttacgaccctaccgggttacccacggtaccgtacgaccgtacggtttcggttaccttacgttcgtaacctaccgttacggtacccgttcttacggttcccgaccgggtacccgtcccgaaccgtcccgggtaccgtcccgttaacttttaaccgtcggtttcgaccggttaagacggttaccgacggtaccgggttacccggtaaacccccttaccgtaaacccccccgtttaagttttcccggaaaccgttacccccgggtacggggtaaccccgtaaccggggggttaacccccggtagggttaccccgtaacccgggttacccaccccgttaacccgg

SEQ ID NO: 270922 - DNA, 602 bp, Homo sapiens
  misc_feature: GYAE6OF02F8Y33.25.87.H10.1.454.CMB.1.raw
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgggccagtcggagtgttgggcggtcttttggcctggtatcagcacaaaccagggaaacgcccccaaatcctctctatgaggctctacttacacactggactcccctgaaggttcaggcggcaggtggatcgtggggacagaactttcactctacaccatcgagccggctgccaacctgacttgtattttcgactaaactttacttactcgaccctagacctaagtttactttaaactttttctccgttcgttccgttttcccgttttcgggaccgtagggggtacccgtagggggtcgaggacgacgaaggccgtaacgtggtcggccttacggcctaacctagttccgttacgttcctttaccaccgtttcccgttccccgtacc

SEQ ID NO: 270923 - DNA, 547 bp, Homo sapiens
  misc_feature: GYAE6OF02F9ISU.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagccccccgagggaacgggcctggagtggattgcgtattgtctttcataggtgggatgcctactacacgtccctcccacaacgagtcgagtcacctattttcggtgactacgtccacgcagcagttgtctctgacacgtcgacgtctgtcgaccggccgccgacaccggccgtctattacgtgtgtgagacgtcacgtcggtacgaacccctacaaccccgtctttacgacctaccgtcgggaccgacgggaccggtgtaccgaccgtccacctccg

SEQ ID NO: 270924 - DNA, 561 bp, Homo sapiens
  misc_feature: GYAE6OF02ILGU6.25.87.H10.1.454.CMB.1.raw
  modified_base (378)..(378): a, c, t, g, unknown or other
  misc_feature (378)..(378): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtgggctggctccgccagcccccgagggaacgggcctgggagtggattgcgtattgtctttcatagtgggagtgcctactacacgtcccctcctacaacgagtcgagtcacctatttcggttanactacgtccacgcagctagttcgtctctgacactgacgttctgtccgacggcccgccgacaccggcgtctacttactgtgcgagcgtcagcgtaccggaacccctacgtaaccccttacgtttacgaccgtaccgtcggggaccgacgggtacccgtcggtaccctaccgtaccaccgtaccg

SEQ ID NO: 270925 - DNA, 530 bp, Homo sapiens
  misc_feature: GYAE6OF02HQ6S1.25.87.H10.1.454.CMB.1.raw
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (377)..(377): a, c, t, g, unknown or other
  misc_feature (377)..(377): n is a, c, g, or t
  modified_base (457)..(457): a, c, t, g, unknown or other
  misc_feature (457)..(457): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagacccctgtccctcacctgctctgtctctggtgacctccatcaccagtaatgctcattacnggggttttcnggctccgccacgccccccagggaacgggcctggagtggattgcgattgtctttcatagtgggagtgcctactacacgtcccctcctcaagcgtcgagtcacatttcggtnacacgtccacgcagcagttgtctctgacactgacgttctgtccacggccgccgacaccggtcgtctattcctgtgtgagngtcagcgggtcgaacccctanaacccctnttacgacaccgtgggccacggggactggtaccaccgtcacctcg

SEQ ID NO: 270926 - DNA, 638 bp, Homo sapiens
  misc_feature: GYAE6OF02ILUJ5.25.87.H10.1.454.CMB.1.raw
  modified_base (228)..(228): a, c, t, g, unknown or other
  misc_feature (228)..(228): n is a, c, g, or t
  modified_base (243)..(244): a, c, t, g, unknown or other
  misc_feature (243)..(244): n is a, c, g, or t
  modified_base (254)..(254): a, c, t, g, unknown or other
  misc_feature (254)..(254): n is a, c, g, or t
  modified_base (343)..(343): a, c, t, g, unknown or other
  misc_feature (343)..(343): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtannctcattacgngggctggctccgccacgcccccgagggacggccgtggagtggagttgcgtatttgtcctttacgataggtgggagtcgaccttactacncgttcccctcctacaagtacgtcgtaacgtctacctagtttcggtacaccgtaccgtccacgcagactacgtttcgtctcgtacgactacgtgtacgtcgttcgtaccgaccggcccgcgaaccgtccggtccgtaccttactttaccggtgtcgaccgtaagtacggtacacgggtaccgtaacccgggtaaccccctaacccgtaacccctttaacgttccgacccgtacccggttaccggggaccgtaccgggtaacccggtcgtaccccggtaccgtcccgacccgtaccg

SEQ ID NO: 270927 - DNA, 856 bp, Homo sapiens
  misc_feature: GYAE6OF02GTCC1.25.87.H10.1.454.CMB.1.raw
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctagtaggggacagagtcaccatcacgttcgcccgggccaggtcggagtggttgggcggtcgtttggcctggtatcagcaacaaaccgagggaaaccgacccccaaactcctcctactactgacggtcgtctactttacactacgtcggacgtcccctagtaacggttcgaggtccggacgtaggtcgggacgttccggtaggggaactaaggttaacttccgtaccttccgttaccaacccgtatccgaacggccgggtacccgtacgacccgtaaaccgttaggtacgttacggtttaactttttaccggtaacctttaaaccgttttaaccgtttaaccgtttaccggtaacccgtaacggttaaccgttaaacgttttaaacttttaaaccgttttttttacccgtaccgtttttaccgggtttcccccggtttttacccggttttttacccggggtacccgggttaaaccggggggtttaaccccgggtaagggggggttaaccgggtaaacgggtaaccgggtaaccggtaaacgggtaccgggttaacccggttggggtaaccgggtacccgttacgggaacccgttaacccgttaggtttaccccgtttacggtttccgtttacccgtacccggttttccccgttacccccggttaaccccg

SEQ ID NO: 270928 - DNA, 635 bp, Homo sapiens
  misc_feature: GYAE6OF02GD9W0.25.87.H10.1.454.CMB.1.raw
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
  modified_base (483)..(483): a, c, t, g, unknown or other
  misc_feature (483)..(483): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtggggctggcctcccgccacggccccccgaggggaacgggcctggaggtggtattggcgtattgttctttcagtagtgggagtcgcctactactcgtcccctcctacaagngtcgagtccactatttcggtnacgtaccgtccgacgcagctagttcgtctctgactcgtgtaccgttcgtagtccgaccgggcccgccgaccgaccgggtccttacgttattaccgnggtgccggtagacgtccgagggtaccggtaccgaaacccccttacgtaaacccccgtttacgtttacggaacccgttacccgggtacggggaccccgtaacggggtaacccggttcgggtacccgtaaccccgttacccgaacccgttcccg

SEQ ID NO: 270929 - DNA, 776 bp, Homo sapiens
  misc_feature: GYAE6OF02HQZBB.25.87.H10.1.454.CMB.1.raw
  modified_base (246)..(246): a, c, t, g, unknown or other
  misc_feature (246)..(246): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcagggtgaagccttcggagaccctgtccctcacctgctctgtctctggtgactccatcaccagtaangctcattacgtggggctggcctccgccgacgacccccgagggaacggccgtgggagtacggagttcggcgtagtttcgtctttcagtaggtgggtacgtcgtacctactacaccgttcccctacctacgaacgtacgtacgacgtaccaccgttagtttcggtagaaccgacgtccacgacacggtactacggtttcgaccttctacgactacgttacggaaccgttccgttacgggtaccgacccggggtacccgacccggtaaaccgtccccgggtaccgtttaaccttaaggttttacccgtacggttacggtaccgggaaaggttaccggttacgaaaccggggttacccgggttaaaccccggaaaacccccctttaaccgttaaaacccccccgttttggttttacccggaaacccgttaaccccgggggttaccgggggtaaccccgtaaaccggggggtttaaacccggttccggggttaaacccctaacccccgggtttcccgaacccgttaacccccggg

SEQ ID NO: 270930 - DNA, 616 bp, Homo sapiens
  misc_feature: GYAE6OF02JU771.25.87.H10.1.454.CMB.1.raw
  modified_base (262)..(262): a, c, t, g, unknown or other
  misc_feature (262)..(262): n is a, c, g, or t
  modified_base (396)..(396): a, c, t, g, unknown or other
  misc_feature (396)..(396): n is a, c, g, or t
  modified_base (496)..(496): a, c, t, g, unknown or other
  misc_feature (496)..(496): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagcccttcggagaccctgtccctcacctgctctgtctcgtggtcactccatcaccagtaactcgactctattacgngggtctgcctccgccacgccccgagggacggcctggagtggatgcgtattcgtctttcagtagtgggatcgtaccttactacgacgttcccctcctacgaagtacgtcgacgtcaaccgtgtttcggtcgtacncgtccacgtcagctaggttctctacgtagacctacgtgtaccgtctggtacccgacggcccaccgacgtaccgggtccgttacttacgttacctgggtanccgtaagtaccgtcgacggtaccggtaaccgaacccctacgtaaccccgttgttaccgtaccgacccggtcgggtacccgaacgggaccgtttccgaccgtaacccgtcctaccctaccg

SEQ ID NO: 270931 - DNA, 537 bp, Homo sapiens
  misc_feature: GYAE6OF02G3AL4.25.87.H10.1.454.CMB.1.raw
  modified_base (374)..(374): a, c, t, g, unknown or other
  misc_feature (374)..(374): n is a, c, g, or t
  modified_base (407)..(407): a, c, t, g, unknown or other
  misc_feature (407)..(407): n is a, c, g, or t
  modified_base (445)..(445): a, c, t, g, unknown or other
  misc_feature (445)..(445): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccgagggaacggcctggagtggattgcgattgtctttcatagtgggagtgcctactacacgtccctcctcaagagtcgagtcacctatttcggtgacncgtccacgcagcagttgtctctgacactgactntcgtcaccggccgcgaccacgggtccgtcttattacgngtgcgagacgtcagcggtacgaaccctacaacccctagttcgacctaccgtggggacccacggggaacccgtggtaccaccggtccactccg

SEQ ID NO: 270932 - DNA, 672 bp, Homo sapiens
  misc_feature: GYAE6OF02GJ5I7.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccgagggacggcctggagtggattgcgtattgtcttcagtagtgggatcgcctactacgacgtcccctccctacaagacgtcgagtcctaacctgttttcggtgtaccaccgttccaccgcacgctacgtttcgtcctcgtacgacctacgtcggaccgttccttagtcccgtaaccgggccccgtaccgaccgtaaccgggtcccgttacgtttaactttacccgtggttaccgggacgtaagtaaccgttcgaacgggtccgggttaaccggaaaccccccttaccgtaaacccccgtttacgttttaaccggaaccctacccgggtacgggggtaaccccaacgggggtaaccccgttgggtaccccaaccggtttaccccaccgttacccgg

SEQ ID NO: 270933 - DNA, 589 bp, Homo sapiens
  misc_feature: GYAE6OF02H311C.25.87.H10.1.454.CMB.1.raw
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
  modified_base (410)..(410): a, c, t, g, unknown or other
  misc_feature (410)..(410): n is a, c, g, or t
  modified_base (441)..(441): a, c, t, g, unknown or other
  misc_feature (441)..(441): n is a, c, g, or t
  modified_base (555)..(555): a, c, t, g, unknown or other
  misc_feature (555)..(555): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccacctgtctgcatctagtaggggacagagtcacatcacttcgccggcagtcggagtgtgggcgtctttggctggtatcagcacaaacagggaacncccccaaatcctctcatgacgtctctactttacacnctgacgtcccctagacggttcaggcgcaggtcgatcgtagggacaggacttcactcacactatcagccgctcgacaacctgattagtattgacttaacttattaccncgaccacgtataagttaactttaattttacncgttacggttaccgttttcccgtttagggacccgtaacgggggtaccgtaaggggtcgaaggacggtacaaggtacgtaaccgtgggttaacggcctacggtaacctaaccgtnttacgtcgttaccttccgtacttccctcccgtac

SEQ ID NO: 270934 - DNA, 566 bp, Homo sapiens
  misc_feature: GYAE6OF02FTJQP.25.87.H10.1.454.CMB.1.raw
  modified_base (378)..(378): a, c, t, g, unknown or other
  misc_feature (378)..(378): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctcggctccgccacgcccccgaggggaacgggcctggacggtggattgcgtattgtctttcatagtgggagtgcctactacgacgtccctcctcaagagtcgagtcactagtttcggtnactacgtccacgcacgcagttcgtctctgacacgtgacgttctgtcgacgccgccgacaccggccgttctacgttactgtacgcgagtcgtcagggccggtacgaacccctacaacccctttgttaccgacctaccggtcggggaccctacggggaaccctcgggtaccacccgttcgaccccgtacg

SEQ ID NO: 270935 - DNA, 719 bp, Homo sapiens
  misc_feature: GYAE6OF02GMGQZ.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactcatcaccagtatgctcattacgtgggctggcctccgcacgcccccgagggacgggcctggagtggattggcgtattgttctttcagtagtgggtagtcgacctactacgacgttcccctccctacgaagtacgtcgacgtacctaccgtagttttacggtacgaccgtaccgtaccacggtaccgacgtacgtagtttccgtacgttccgtacgtaaccgtaccgtcggtacccgttcttaccggtcccgacccgggtccccgtacccggaaccggtacccgggtcccgtttaccgttaacgtttccgtacgggttcggaccggtaagggtacgtaccgaaccggggtacccgggtaacccgtaaaacccccttacccgtaaacccccgtttacgtttaccggaacccgtaacccgggtccgggggacccgtaaccggggtacccggtttcgggaaccccgtacccggtaccctaccccgtaacccgg

SEQ ID NO: 270936 - DNA, 632 bp, Homo sapiens
  misc_feature: GYAE6OF02JA8AZ.25.87.H10.1.454.CMB.1.raw
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtcgactccatcaccagtaangctcattacnggggctcggctccgccacgcccccgaggggaacggccgtggaggtggatggcgtattggtctttcagttggtgggagtgcctaactacaccgttcccctccctacaacgtacgtcgtacgtaccacctagttttccggttagaccaccgttcaccggcacgtctagtttcgtccttgtcgactacgtcgtaccgttctacggttccacccgggcccgaccggtaccgccgggtccctacgttattaccgtgtcggacgagacgttacgaggtaccgggtacgaaacccctaccgtaaccccgttaacgttcgaaccgtaccggttcgggacccgaacgggtacccggtcgtacccggaacccgtccgacccgtccg

SEQ ID NO: 270937 - DNA, 657 bp, Homo sapiens
  misc_feature: GYAE6OF02ISA8Y.25.87.H10.1.454.CMB.1.raw
  modified_base (267)..(267): a, c, t, g, unknown or other
  misc_feature (267)..(267): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccggcagtcgagtgtgggcgtctttgcctggtatcagcacaaacgaggaaacncccccaaactcctcctactatggacggtccgtacttactttaaccacgtacgtcggaccttcccctacgtaacggttcagccggacaggtcgatcgtgggaaccagtaactttcactctacactactcgaggtccgacctgaccaaccgtagacgttagttacgttttcaaccttaaacgttacttaccgtccgaccgtaagacgttaacgttaaacttttacgtttttaaccgcgtttacgttaccgttttacccgttttacgggaccggtaacggggtacgtacggggtacggagtaaacggacgtaacggtacgtacggttacggtcgtaccgtacgtaccacttacgttccttacgttccgttactacccgttccctacccctacg

SEQ ID NO: 270938 - DNA, 585 bp, Homo sapiens
  misc_feature: GYAE6OF02G42DQ.25.87.H10.1.454.CMB.1.raw
  modified_base (381)..(381): a, c, t, g, unknown or other
  misc_feature (381)..(381): n is a, c, g, or t
  modified_base (435)..(435): a, c, t, g, unknown or other
  misc_feature (435)..(435): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggcctccgccagccccccgagggaacgggcctggacgtggattggcgtattgtctttcatagtgggagtcgcctactacacgtcccctcctcaagcgtcgagtcactatttcggttgacncgtccacgcagcagtttcgtctctgacactcgaccgttctgtccaccgggcccnccgaccgacggcccgttactactttacgtgtcgacgagagtcgagccggtacggaacccccttacaacccccgtttattccgaacctcccggttacgggacccgtacggggacccggttcggtaccgacccggttcccacccgttacccg

SEQ ID NO: 270939 - DNA, 743 bp, Homo sapiens
  misc_feature: GYAE6OF02GE06Z.25.87.H10.1.454.CMB.1.raw
  modified_base (703)..(703): a, c, t, g, unknown or other
  misc_feature (703)..(703): n is a, c, g, or t
  modified_base (722)..(722): a, c, t, g, unknown or other
  misc_feature (722)..(722): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggcctccaggtgcccaatgtgacatccaggtcgacccagtcctccttcccaccctgtctgcatctagtaggggacagagtcaccatcacttcgccggcagtcgggagtcggttggggccgttcgttttcggccgttggtactcacgacaaaccgaaaccgaacggggaaacccgaccccctaaactccccttccttacgtacgtcggacggtccgttaccttaccttaacacctacggtacggtaccgttcccctaggtaacggttccgacggccggtacgaggtcggtattcggtagggaactacggtaactttcacctcgtacaccgttactaccgaccggtccggtacctcggaccctaaccgtgtaacgttagttaagttttaccggacctttaaacgtttcgtaccgttacgacccgttaagtacgttaactttaacgtttaacttttaccgttcgtttaccgtttcccggttttaccgtttccggggaccgttaaccggggtacgggtaggggttacgacggtaacgaccgtaacgggtaccgtacggtggtacgtccgtacgcctaacgngtttcgtacttacccgttntacccgttccctccgtacccg

SEQ ID NO: 270940 - DNA, 653 bp, Homo sapiens
  misc_feature: GYAE6OF02IYOHM.25.87.H10.1.454.CMB.1.raw
  modified_base (252)..(253): a, c, t, g, unknown or other
  misc_feature (252)..(253): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (574)..(574): a, c, t, g, unknown or other
  misc_feature (574)..(574): n is a, c, g, or t
  modified_base (644)..(644): a, c, t, g, unknown or other
  misc_feature (644)..(644): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccgagggcagggtgaagtcccttcgggacgaccccttgtcccctcacctgctctgtctcgtggtcactccatcacatannctacatcgnggcncgctccnccgacgcccgagggacggcgtggngtgngtgcgtnttgttcttagtagtaggtggagtcgaccttactacacccgtccctacctacgaagtacgtcgactcctaccgttacgtttcggttacaccgtccgtacccgacgcgacgtctttaggttcgtctcgtacgactacgtcgtaccgttcttacgggacctcccggacccgtccgtaacccggaccggttccgttacttagttaccgtgcggtacgacgtacggtcgaacggtccggtaaccccgtaacccctaccgtaaccccgtttntaacccgggacccttaccggggacggacccggttaaccgggtccgttccggtaaccccgtcccgtacccnccgtaccgg

SEQ ID NO: 270941 - DNA, 757 bp, Homo sapiens
  misc_feature: GYAE6OF02GWWT0.25.87.H10.1.454.CMB.1.raw
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
tcagactgtacagtcacgaccggtgctcgatttagcagtactgcgttgggtttgggggctttctgagagtcatggacctcctgtgcaagaacatgaagcacctgtgttcttcctctgctggtggcgcgccagatgggtcctgtcccagctgcgtctgcaggagtcgacgcccgagggcaggtgaacgtccgttacggacgacccttgtcccctacaccttgcttctcgtctcgtggtacactccagtcaactagtatcgtcctntaacgttcggnggggtcttcggaccgtaccccgaccgacccggacccccggaaggggtaacgggtcccgttagggacggtggtaacttcggacgttagtttcggttaccttttacgagttacggggtgggtaacgttccgtaccttaactaccgtccggttccccctaactaggaaacgtggtaccctaggtaccctaaccgttaggttttcggtaaccgaccgttaaccggtacccacggtacgtaacggtaccgttagttttcgtacccttaggtaacgtacccgttaagttccggtaacccttcggttaaccgcccgggtaacccgggccccgtaacggaacctcccgggtaccttaccgtttaatccgggttcgacgtaccgtagtacgcgtaaacggccgttaacccgaacccctaccgtaaccttgtaccggaccctcgggtaccggacgtaaccggtaccgtcgtaccctacccgtcaacccgtcg

SEQ ID NO: 270942 - DNA, 686 bp, Homo sapiens
  misc_feature: GYAE6OF02FZ4ZN.25.87.H10.1.454.CMB.1.raw
tcagactgtacagtcacgaccggtgctcgatttagcagtactgcgttggggtttgggggtcagacccagtcaggacacagcatggacatgagggtcccccgctcagctcctggggctcctgctgctctggcctcccaggtgcccaatgtgacatccaggtgacccagtcctccttcccaccctgtctgcatctagtaggggacagagtcaccatcacttgccggcagtcggagtggttgggcggtcgtttggcctggtatcagcaacaaaccgaagggaaaccgcccccaaactcctcctctatgacggtctctacttacactacgtcggacgtcccctagtaacggttcacggtccggactaggtcggtatcgtaggggactaagtactttccactaccgtacaacctataccgacgccggtcccgtagaccctaaccgtgtagtgtacgttttcgactttagtttacttacttcgtacctaacgtaagttaacttaaaccgtaaccgttccgggtaccgttaccgggttcggttacggtttaccggaacccggtaaacggggtaaccgtaaaggggttaacggaaaacgtaaccgtaaaccggtagtggtaccggtctaacggaccctacgtacgttcgtccgttacttactaacccgttccctaccccgtacctacgtaccgg

SEQ ID NO: 270943 - DNA, 660 bp, Homo sapiens
  misc_feature: GYAE6OF02JHAD3.25.87.H10.1.454.CMB.1.raw
  modified_base (254)..(254): a, c, t, g, unknown or other
  misc_feature (254)..(254): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgggccagtcggagtgttgggcggtctttggctggatcngcacaaacgaggaacgccccaactcctctctatgacggcgtctacttacacacgtcggacgtcccctagaacggttcacggccggcgaggtgactcgagggacaagtaacttcacctcgtaccacctactaccgacggtccgcctacgacctaacccgtgtacgttgttacttttacacgttaaactttattaccgtagtaccgacgtacttaaacgtttaacttttaactttttacctcgtttcgttaccccggtttttcccttacgggacccggtaacgggggtaaccgtagggggttaacggaacgtacggtaaccgtaacgggtacgtaacgtaggttcggaccttacggaccctactagttccgtttctaccgttacccgtacttcccgttaccccgtacg

SEQ ID NO: 270944 - DNA, 666 bp, Homo sapiens
  misc_feature: GYAE6OF02GY9BN.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtcgactcatcacagtatgctcattacgtgggctggcctccgccacgcccccgagggacggccgtggagtggattggcgtagttcgttctttcgagtacggtgggagtcgcctactacctaccgtcccctcctacgaagtacgtacgtacgtccacctagtttcggtacgacctaccgtccacgcacgctagtttcgtctcgtacgactacgtcggtaccgtcgttcgtaccgacccgggcccgtacccggaccgtaccgggtcccgttacgttacgtttaccgtgggtacgacggacgttaagtccggaacgggtccgggtaacccgaaacccccttaccgtaaaccccgtttcgtttaaccggaacccgtacccggtaccggggaacccgtaacggggtaccccggttgggtaccccctaccggtccgaccctacccgg

SEQ ID NO: 270945 - DNA, 614 bp, Homo sapiens
  misc_feature: GYAE6OF02FU0T5.25.87.H10.1.454.CMB.1.raw
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcgcgcccagatgggtcctgtcccagctgcgtctgcaggagtcgagcccagggcaggtgaagccttcggagaccctgtccctcacctgctctgtctctggtgactccatcaccagtaatgctcattactggggctggcctccgccacgccccccagggacggcctggagtggatgcgtattgtcttcatagtgggagtgcctactacacgtccctcctcaagacgtcgagtcactagtttcggtnacncgtccacgcagctagttcgtctctgactacgtgaccgttcgtcgtaccgaccggcccgcccgaccgaccgggtcccgtcttacgttaccgtggttcggtcgacgtaggtcaagggtcccggtaccggtaacccccttaccgtaacccccgtttagtttaccggaaccctacccggttaccggggacccgtaacggggtaacccggttcgggacccgtacccggttaccctacccgtacccg

SEQ ID NO: 270946 - DNA, 623 bp, Homo sapiens
  misc_feature: GYAE6OF02FGN2V.25.87.H10.1.454.CMB.1.raw
  modified_base (320)..(320): a, c, t, g, unknown or other
  misc_feature (320)..(320): n is a, c, g, or t
  modified_base (421)..(421): a, c, t, g, unknown or other
  misc_feature (421)..(421): n is a, c, g, or t
  modified_base (457)..(457): a, c, t, g, unknown or other
  misc_feature (457)..(457): n is a, c, g, or t
  modified_base (484)..(484): a, c, t, g, unknown or other
  misc_feature (484)..(484): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagactggtcctgtcccagctgctctgcaggagtcgagcccaggccaaggtgaagccttcggacgaccctggtcccctcaccctgccttctgtccttcctgggtcactccattccacccagttaaactgacctcacttacctagggggtcctgggcttcccggcccacgccccccccgaggggaacncccggtggacggtggagtttgcggattcgttctttcattaagtgggagttggcctactacacgtccctccctcaacgactcgaacgtcaccatttccggtnaccgtacgtccaccgcagcacgttgtctctgcactnacgtctactctaccgcccgccgtaccnccggcccgtctacgttactcgtacgtccgagactcgaagccggttacggaaccccttaaccgaacccccttaactttacgaaccctacccgcggggtcccgacggggaacccgtacgggtccacccgggtcacccgtcc

SEQ ID NO: 270947 - DNA, 774 bp, Homo sapiens
  misc_feature: GYAE6OF02H1ER8.25.87.H10.1.454.CMB.1.raw
  modified_base (279)..(279): a, c, t, g, unknown or other
  misc_feature (279)..(279): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccacctgtctgcatctagtaggggacagagtcacatcacttgccgggccagtcggagtggttgggcggtcttttggccttggtatcagcaacaaaccgagggaaaccncccccaaatccctcctatagtgacggtcttacttactttacactactcggaccgttcccctagtaacggttccaggcggacgtaggtggtactcgtggggaactaaggtaactttccgaacctcgtaccaacctataccgtacggcccgggtacctacgggtacccaaaccgtttggaacgttttacgggttaacgttttttaccggaaaccttttaaaacgtttacgttttaacccgtacggtaaccccgtaaagttaacccgttaaagtttttaaaaccttttttaaaacgttttttacccgtccgtttaacgggttttccccgtttttacccgggttttaacggggacccggttaaacggggggtaccgtaagggggttcggaaacggacgtaacgtaacggttaccggaacgtttcgggtacgggtacctccgtaacccgtaccgtagttccctttaggttacccttcgtaccgttccctaccccgtaacg

SEQ ID NO: 270948 - DNA, 629 bp, Homo sapiens
  misc_feature: GYAE6OF02HYQED.25.87.H10.1.454.CMB.1.raw
  modified_base (431)..(431): a, c, t, g, unknown or other
  misc_feature (431)..(431): n is a, c, g, or t
  modified_base (530)..(530): a, c, t, g, unknown or other
  misc_feature (530)..(530): n is a, c, g, or t
tcagactgtacagtcacgaccggtgctcgatttagcagtactgcgttgggtttgggggtcagacccagtcaggacacagcatggacatggagggtccccgctcagctccgtggggctcctgctgctctggctcccaggtgcccaatgtgacatccaaggtcgaccctagtctccttccaccctgtctgcatcgtagtacggggacagacgtcaccatcgacttcggccgggcaggtcggagtcggtgggcgtcgtttggctggtatcacgacaacaaacgacggaaaccacccctaaactcctcctactagtgacggtcgtacttacgttacacgtacgcggtacctacccctagtaacggtcacggtcgactagtgattcgaggacagtattcacttcgacacatacgacgcggacctggccctaacgtntacgtattacttgaacttacttatactcgaacaacgtaataataattaacgtacttaccgacgtttagttacggaccggtaagggtaccgtaagggtanaggtactaaacggtaaagaccgtggtacggctacgaaccgtactacgttaccgttagttaccctttcgacccgtttccggacccttcgtacgtaaccgg

SEQ ID NO: 270949 - DNA, 766 bp, Homo sapiens
  misc_feature: GYAE6OF02IHQ5E.25.87.H10.1.454.CMB.1.raw
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
tcagactgtacagtcacgaccggtgctcgatttagcagtactgcgttgggtttgggggctttctgagagtcatggacctcctgtgcaagaacatgaagcacctgtggtttcttccctcctgctggtggcggcgcccagatgggtcctgtcccagctgcgtctgcaggacgtcgacgccccaggggcagggtgaacgtccgttcgggacaccccttgtcccctacacctcgcttctcgtcctcgtaggtcacctccagtccactagtaatcgctacgagttacggtgggctcggccnccncgaccgcccgagggacggtccaggcgtaggacttcgactagtttctntacagttcgngggtactcgcctacacgtaccgtcccctacctagaacggctacgtaacggtacctacgttagttccggggttacaccttaccgtcccgaagcgtacgtacgttcgttcggttccttacggtcgtaccgtacgtacggtacgttaccgtacggtaccgacccggtcccgaccggaaaccggtacccggttacccgtactttacggttaccgttacggtaccggtcgaacgggttacggtacgaccggggttaacccggttaacccggttaaacccccttacccggttaaccccgtttacgttttaaaccggcccggttaaacccggggtcccgggggaaaccccggttaacggggtaaccccgggtttaccggtacccggtaccccggttaccccggtacccttaacccgg

SEQ ID NO: 270950 - DNA, 720 bp, Homo sapiens
  misc_feature: GYAE6OF02JJS5E.25.87.H10.1.454.CMB.1.raw
tcagactgtacagtcacgaccggtgctcgatttagcagtactgcggttggggtttgggggtcagacccagtcaggacacagcatggacatgagggtccccgctcagctccgtggggctcctgctgctctggcctcccaggtcgacccaatgtgacactccgaggtcgaccctagtcctcccttccaccctgtctgacatctagtacggggacagagtcaccatcacgttcgccggcaggtcggtagtcggtgggcgttcgtttcggcgtggtatcacggacaacgaacgaacgggaaccgaccccaactcctacctactatcggacggtctacgttaccttacacctacgtacggaccgtccctacgtaacggttccgacggcggtctaggtacggacgtacggtacgggaactacgtaacgttcctacgtcctaacgacctacgtaccgacggtccgggtactccggaaccgtacgtagtacgttcttacgtttacgacctttaacgttaaccgttacgtccgaccgttaacggtactttaacggtttaaaccttttacgtttaccgttcgtttaccggttcccgttttacggttaccgggtaccggtacggggtaacccgtggggtacgaacgtcggacgtaccgtgacggttcgtcggtacacgtaccgtacgtcttcgttcgtacctttacggtacccgtttccctccggtaaccc

SEQ ID NO: 270951 - DNA, 844 bp, Homo sapiens
  misc_feature: GYAE6OF02IKPYM.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgccagatgggtcctgtcccagctgcgtctgcaggagtcgagcccgaggggcgaggtgaacgccgttcgggacgaccctcgtcccctcacctgctctgtctcgtggtcgacctccatccacctagtaatcgctctattacggtgggcctcggcctccgcccgaccggccccggaggggtacggccgtagggacgtcgggtagttcgcgttagtttcggttctttacgtaagttcgggtaggggtacgtcggtaccttactaccgtaccgtacccctccgtacgtaaacgtcggtacggacgtacctacgttacgttttacggtacgtaccgtaccgtaccacgtcgtacggtaccgtacggttttcgtaccttacgtacgtaacctacgttacggttaccgttccgttcggtaccccggaccggggtacccccggtaacccggacccggtaaccccgggtttacccgttaccgttttaaccgtttaccggtacgggttaccggtaaccgggtaccgtaacgggttacccgggaaccgggtttaacccggggtaacccccggtaaacccccgttaaccccgtttacccccggtttaaacggttttaccccggaaccccgggttacccgggtaaccgggggaaccccggggttaacccgggtaacccggggttaccggtaaccccggtacccccggttacccgtaacccgtacccgg

SEQ ID NO: 270952 - DNA, 683 bp, Homo sapiens
  misc_feature: GYAE6OF02ILJZT.25.87.H10.1.454.CMB.1.raw
  modified_base (278)..(278): a, c, t, g, unknown or other
  misc_feature (278)..(278): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtgcccaatgtgacatccaggtgacccagtctccttccaccctgtctgcatctagtacggggacagagtcacatcacgttgccgggccagtcggagtgttgggcggtcgttttggcctggtatcagcacaaacgagggaaacncccccaaactcctcctctagtgacggcgttacttactttacactacgtcggtaacctcccctagtaacgggtttcaacggtccggactaggtggaacgttcgtaggggaacctaaggtaactttccgtacttcctaccaaccactaccgaggtaccacgtaccgtacggaccgaacggtccgtaaggaaagtacgttagttacgtaccttaaacttttacgttaacttaacgttaaacgttaaaagttaaccttaaacgttaccctaccgtacccctttctacccgttaccggtttaccgggaccgggtaacggtaaccgtaagggtacgaacggtaataccgaacgtacgtggcgtacgtagacctacgtacttctcgttccttacacgttaccctcccgtacg

SEQ ID NO: 270953 - DNA, 806 bp, Homo sapiens
  misc_feature: GYAE6OF02ITBIN.25.87.H10.1.454.CMB.1.raw
  modified_base (771)..(771): a, c, t, g, unknown or other
  misc_feature (771)..(771): n is a, c, g, or t
tcagactgtacagtcacgaccggtgctcgatttagcagtactgcgttggggtttgggggtcagacccagtcaggacacagcatggacatgacgggtccccgctcagctccgtggggctcctgctgctctggcctcccaggtcgacccaatgtgacactccgaggtcgaccctacgtcctcccttcccacccgggggggggggtctctcgcattacgtagtaggggacagacgtaccaccactctacgttcggcccgggaccgacggtcggtacggttgggttcgggtcggtcgtttcggtccgtaggtatcgagaccaaccgaaaccgaacgggaaaccgaccccctaaaccgtcccctcctcctagtacgacggtcttaccttaaccgtttacctaaccgtaccgttacgggtaccgttccccgtaccgtaacggttaccgaggtccggacgtaggtcggtacgtccggtagggaacgtaaggtaacttacctactcctaccaccctactaccgtacggccggtaccctcgacctacgtagtaagttcgttacgtttacgacctttaatttccttaacgctaaccgtaactacgttaacgttaattttaacgttttcctcggtttaccgttcccggtttttcccggtttacggtaccgggtaacgggggtaccgttaaggggtcggaaagtcgggtaaaccgtacggtaccgttaacgggttggtaccggtacgtacccgtaaccgccttaacgtttccggtaccgtttnttaaccccggttctttacccccgttaccccggtac

SEQ ID NO: 270954 - DNA, 859 bp, Homo sapiens
  misc_feature: GYAE6OF02J1E03.25.87.H10.1.454.CMB.1.raw
  modified_base (173)..(173): a, c, t, g, unknown or other
  misc_feature (173)..(173): n is a, c, g, or t
  modified_base (622)..(622): a, c, t, g, unknown or other
  misc_feature (622)..(622): n is a, c, g, or t
tcagactgtacagtcacgaccggtgctcgatttagcagtactgcgttgggtttgggggctttctgagagtcatggacctcctgtgcaagaacatgaagcacctggtggttcttcctcctgctggtggcggcgcccagagtcgggtcctcggtacccagctgtcgtctgcaggngtcgagcccgagggcaggtgaacgtccgttacggagacccctggtacccctcgacccgtgcttccgtgccttcgtcggttcgaccttccacttaccgaaccgtagttaacgtcgtactaccgtacgttacggcggggtctcgggtaccgtcccgacccgtaccggtcccccggtaagggggaaccgtcccggtgggtacggttacggtactacggaaccgttgttccggtttactaccgtagtacgggtaggtggttaaccgtaccgttaaccgttaccgcccggtttacccctaccgttaacgaacggttccgggtacgttaacgtaacccggtacccttaagggttttcccggtaccgaacggttaccctaccgacggtaccttaacggtccggtttagtttaccgtaccgttacgtaaccgtaacgtccggtgtaaaccgtttccncggtaacccgtcgggcccgacggtacccgtacggttacccggttcttaagttccgggtacgggtcggaaccggttaagtaccggttacccggacggggtttaaccccggtaaacccggtaaaccccccttactttaacccgggttaacttaccggacccggtacccgggtttaaggggacccccgttacggggttaacctccgggtaacccctaacgggtccgtaaccctacccggg

SEQ ID NO: 270955 - DNA, 725 bp, Homo sapiens
  misc_feature: GYAE6OF02JW20V.25.87.H10.1.454.CMB.1.raw
  modified_base (237)..(237): a, c, t, g, unknown or other
  misc_feature (237)..(237): n is a, c, g, or t
  modified_base (299)..(299): a, c, t, g, unknown or other
  misc_feature (299)..(299): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgacgcccagggcaggtgaagccttcggagaccctgtccctcacctgctctgtctcgtgtcgactccancacctagtaatcgctctattcgtgggctcgcctccgccacgcccgagggacggtccgtaggngtacggtgtagcgttagtttcgttcgtttactagtaggtagggtacgtcgtaccgtaccttaccgaccgtttcccctaccgttacgaacggtacgtaccgacgttccctaaccgttaggttttaccggttacggtacccaccggttacccgacgaccgaacggtacgtacggttttccgtaccttcgtaccgtactacgtcggtaccgtacggttacgccgaccgggtacccgccggtaccgtaccgtccgttaaccttacgtttacgtacggtcgggaccttagggccgtacggtacgggtacccggtaaacccggtacccccttacgtaaccccgttacgttaacccggaccggtacccggtaccggggacccggtaaccgggttacccgtccggttacccgtaacccgtaccctaccgacccg

SEQ ID NO: 270956 - DNA, 759 bp, Homo sapiens
  misc_feature: GYAE6OF02GBHGS.25.87.H10.1.454.CMB.1.raw
  modified_base (522)..(522): a, c, t, g, unknown or other
  misc_feature (522)..(522): n is a, c, g, or t
tcagactgtacagtcacgaccggtgctcgatttagcagtactgcgttggggtttggggggctttctgagagtcatggacctcctgtgcaagaacatgaagcacctgtggttcttcctcctgctggtggcggcgcccagatgggtcctgtcccagctgcgtctgcaggagtcgagcccagggcaggtgaacgccgttcggaacgtccccgtgtccctacaccgttcgccttctcggtccttcgtcgggtactaccctcactacccaacctaaggttaactcgtcctcgtacgttacggtcggggccgttaggccgttcccgcccgaccccggacccccggaagggggtaaccgggccgtagggacggttacgggtacgttacggccggtaatttcggttcgttttaccaagggttacgggtggtacgggtaccgtacctaccgttaaccggtaccgtccccttacgtcgaaacgcgggttacgtacgtcctacgtaacgtttcggtacgaaccgtcgtccacncgacgtctggttctctcgtcggaactaccgtggcttcgacgtcccggaccggcccgtccggaaccctacgggtcccttacgttacgttccgtagcggtacggaacgtacgtagcccggggtaacctaacccgggtaacccctaacctaaccccggttcgttaccaacccggtccgggtacgggtacccgaacggggttaccgtcccggtacggtacccctaccggtaccctacccgg

SEQ ID NO: 270957 - DNA, 806 bp, Homo sapiens
  misc_feature: GYAE6OF02IC52V.25.87.H10.1.454.CMB.1.raw
  modified_base (727)..(727): a, c, t, g, unknown or other
  misc_feature (727)..(727): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgacgcccgaggggcgaggtagaacgtccgttcgggacgtaccccgtgttccccctcaccgtcgtccttcttcgtcctcgtgggtactacctaccattccaactagtaatcgtctactagttacggtgggctacggcctaccgacccgaccggacccccggaaggggtaaccggtccggtagggacggttaggtacgttggtacgttagtttcgttacttttacgaggttagggtagggtacgttaccgtaccgtaaccgtaccgtacccgttccccctaccgtaacgaaggtaccgtacggtaacgtaccctaccgtttaacggtttaccggttaccgaacccgttaccggtacccgaaccgtacgacgttacccgttagttttcgccttacggtaccgtactacgtacggtaccgttacgttccggaccccggtaccggaccccgacgggtaaccggcccgttaccgtttaacgtacgtttcgacggttacggacggtaacgtgtaccggacgggtaacccgttaacccgtaacccccgttaccgttaacccggttnttaacccggacggtacccgggttaccgggtaccggtaacggggtccgtaccgtaccccgaaccgttccgtacccgtacg

SEQ ID NO: 270958 - DNA, 818 bp, Homo sapiens
  misc_feature: GYAE6OF02JS6O3.25.87.H10.1.454.CMB.1.raw
  modified_base (310)..(310): a, c, t, g, unknown or other
  misc_feature (310)..(310): n is a, c, g, or t
tcagactgtacagtcacgaccggtgctcgatttagcagtactgcgttgggtttgggggtcagacccagtcaggacacagcatggacatgagggtccccgctcagctccgtggggctcctgctgctcgtggcctacccgaggtcgaccctaaagtcggtacgaacctacgtcccgaagggtccgaaccccctaacggttcccttccctttccccaaccccgttcgtcctcgccctaattccgtaagtaacgggggacagtaacgaccaccctataccgtaccgttcggcccgggtaccgtaggtaccgggnggttcggttcgggcggttcgttttacggccggttaggtctcgagaccaaccgaaaccgacggtaaacccgaccccctaaacgtccctcgtacctagtacggccggtacttaccgtacttaaccaccgacgtccgtaaccggtccctacggtaacggttcgacggtcgacgaggttacgacgtccgtaggtaacacgtaactttccgacttaccacaccgtatacggccgaaccggtcctaccgacgtaccgttaggacgttctaactttaccggatttaaaccttaattccggttacgaccggaacttacgttaattaacttttaaaccgtttccttacggttaccgtttcccggtttacgtttaccgggaaccgttcgggtaaccggttacgggtacggtacgaacgtaccgaaggttccggtaagttccggtacgaacggtccgtaccgttaacgtccttccgttacggttaccttaaccggttcgttaaccccgttaccggaccc

SEQ ID NO: 270959 - DNA, 739 bp, Homo sapiens
  misc_feature: GYAE6OF02GTPRV.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggagtcgacgcccgagggcaggtgaagccgttcggacgaccctcgtccctcacctgctctcgtctcgtggtcgacctccactccacctaagtactgcctactattacggtcgggtctcggcctcccgcccgaccgacccccggagggacggccgtaggaggtaggtagtcgtcgttattcgttctttacgtagttaggtcgggtacgtcgtaccgttaacctaccgtaccgttccccttacctacgtaaacgtacggtaccgtaacgtacccgtaaccgtttacgttttaccggttacgaacccttacccgtaccgtaacgtccaacggtcttagggtttccgtactccgtacgaaccttacgtaccggttacctccggttccgaccggtacccggcccgtacccggacgtacccgggttccgttacttacgttcggtgtaccggtaggtacgtacggtacgaacggtacccgggttaacccgaaccccctacctaacccgtttactacgaacccggtacggtaccgggacccgaacggggttacccgtcggacccgtaccgttccgaccgttccg

SEQ ID NO: 270960 - DNA, 849 bp, Homo sapiens
  misc_feature: GYAE6OF02GCWT8.25.87.H10.1.454.CMB.1.raw
tcagactgtacagtcacgaccggtgctcgatttagcagtactgcgttgggtttgggggtcagacccagtcaggacacagcatggacatgagggtccccgctcagctccgtggggcctcctgctgctctggcctcccgaggtcgacccaatgtgacatccgaggtcgacccagtccttccttcccaccctgtctgcatctagtacgggacagagtccacatcacgttcggccggacctaggtcgggaggttgggttcgggtcggttcgttttcggccgttaggtactcgacgaccaaaccgaaaaccggaacgggaaacccgacccccctaaaccgttcccctaccttacgtaagtacggacggttacccgttacttaaccttaacaacctacgtaccggtaaccgtcccctacgtaacggttccgacggtacggtacgtacggtacggtactcggtacggggtaactaacggttaaccttccgtaaccgttaccgtaaccaacccgttacgaccggtaccggtacccggacccgttaccgaacccgtaaccgttacggtaacgttggtttaaacgttttacgtaacctttaaacgtttacgttaaccgtacggtacccgttaacgtaacgtttaaacgtttaaactttttaacgttttacccgttaccgtttaccggttttcccgttttacccggtttaccggaacggggtaccgggtaacgttaacggggtacggtaagttaaaccggaaccgttaaaacggtacggttagaccggttaacgaccgtacctaaccgttcgttacgttaccgtttacttcccgtaccgttcccgttacccgcttaaccg

SEQ ID NO: 270961 - DNA, 700 bp, Homo sapiens
  misc_feature: GYAE6OF02IXKZ1.25.87.H10.1.454.CMB.1.raw
  modified_base (301)..(301): a, c, t, g, unknown or other
  misc_feature (301)..(301): n is a, c, g, or t
  modified_base (436)..(436): a, c, t, g, unknown or other
  misc_feature (436)..(436): n is a, c, g, or t
tcagactgtacagtcacgaccggtgctcgatttagcagtactgcgtttggggtttgggggctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctcggctccgccagccccagggaggcctggagtggattgngattgtctttcatagtgggagtgtcctactacagtcccctccctcgtaaagcgtcggtaacgtccacctaagttttccgggttgaaacctaccggttcccaaccgtcgacgtactagttttacggtcttcgttanaaccgtacctacggtaaccgttccttaggtacctaccggggtcccgccggaaccgtaacccgggtcccggtacgttaacgtttaccttcggtacgttggaaggtggttaccgaacggtaccgggttaaccgggtaaaacccccttaccgtaaaacccccccgttaggttttaacccgacggtaaccccgttaggggggcccgtaacgggggtaaccccggttacggggttaccctaacccggttacccggtacccctaacccgg

SEQ ID NO: 270962 - DNA, 662 bp, Homo sapiens
  misc_feature: GYAE6OF02HSASE.25.87.H10.1.454.CMB.1.raw
  modified_base (466)..(466): a, c, t, g, unknown or other
  misc_feature (466)..(466): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcgcgcccagatgggtctgtcccagctgcgtctgcaggagtcgagcccgagggcaggtgaagccttacggagaccccttgtcccctctacctgctctgtctctggtgactccatcacagtaatgctacattacgtgggctggcctccgccgacggccccgagggaacggccgtggaggtgtagttggaggtactttgtacctttgaagttacgggtgggagttcgacctaacgttacaccgtccctccgtactaaagtcgtaccgtagtacctaacttagtttacggttagaacccgtacgtacccacgtacgacgtacgagttcgtctacgtacgtaacncgtacgtcgtctacgtccgaacgcccgacgacgaccggtctacgttaacttcgtagtcgcgtaaggtcgtacgaacgggtaccggtaaccgaacccgttaccaaaccccgttaggtttaccgaaccgaccggttcgggaacccgttaaccgggaccggttaccggtcccgtaacccggtccgtaaccttacccggg

SEQ ID NO: 270963 - DNA, 805 bp, Homo sapiens
  misc_feature: GYAE6OF02HW88O.25.87.H10.1.454.CMB.1.raw
  modified_base (192)..(192): a, c, t, g, unknown or other
  misc_feature (192)..(192): n is a, c, g, or t
  modified_base (380)..(380): a, c, t, g, unknown or other
  misc_feature (380)..(380): n is a, c, g, or t
tcagactgtacagtcacgaccggtgctcgatttagcagtactgcgttgggtttgggggtcagacccagtcaggacacagcatggacatgagggtccccgctcagctccgtgggcctcctgctgctcgtggcctcccgaggtcgcccaagttgtgacatccgaggtcgacccagtctccttccaccctggtcngcatcgttgttcgggacgtacaggtactacaacctatactaccgttcgggccggggacgacggtcgaacgggtacctagtttacggtaaaacttttggtttcggtccgttaggtactaccgaagtacgtaaacgaaaaccggagggttaaacgttaccccaaccttacctacagttacctagtcgtcnggtacaccttctaccgttttagaccttaggtttccgggtccttacctcggtaacttcgacggtcggtactacggggttcggtactcggggaactaaccggttaacttccgtaaccttcctacccgtacgaccgttacgacgcgtaccgtccgtacgtcccgaagtacccgttaggtaacgtcgttacggttaccgtacggtttaaaacttacgttaacggttaaccttaagttaaaaacgttcgtaaacgttaacggttccggttaccgtaacggttaccggttccgttaccgggttaaccggacggggttaacgtacgggtaccgtaaccgtaggaaacccgtttaaacgggcggtaccggttaacggaccgttacggtccccgtaacgttacccggttacgtttaccgtacccggtttaaccg

SEQ ID NO: 270964 - DNA, 886 bp, Homo sapiens
  misc_feature: GYAE6OF02FVO0R.25.87.H10.1.454.CMB.1.raw
  modified_base (174)..(174): a, c, t, g, unknown or other
  misc_feature (174)..(174): n is a, c, g, or t
  modified_base (403)..(403): a, c, t, g, unknown or other
  misc_feature (403)..(403): n is a, c, g, or t
tcagactgtacagtcacgaccggtgctcgatttagcagtactgcgttggggtttgggggctttctgagagtcatgggacctctgtgcaagaaccatgaagcacctgtcggttacttcctcctgcctgggtcggccggcgacccagatggggtccttagtcccagtctggcgttntcggacaggtagtcgaacgcccgagggcagggtacgaagcccttagggactacccttgccccgtacaccgtgccttcgtcggttctcgtgggttacaccttaccagttaccacgtaagttaatcgtctacgtaacttcgggtacgggtcgtcggtaccctccggtaccgaccgacccccggaggggaacggtccgtagggtaaggtgggtactaggtcgttacggtttnttaccgtttagacggttaggttgggacgttaccgaacttaaccggttaaactccggttaccccttacccgaagtaacggtaccggttcgaacgttaccaacctttgggttacgtaccggtaccgtaccgtaccgacgcggtacgttactaaccggtttctacggtactaacgtaccgttacgtagtacccggttgttaccggtacggtacccgggtaccctaccggaccggtccccggtagttaccgttaaccggtttcgtaccgggtacgggtaacgaaaccggtttacgtaacccgggtaaccgtaaccggggttaaaaccccgtacccccgtttaaaacccggtaacccgtttaacccggtaacggttacccccgtaacccgggggtttaaccgggaacccggggtttaaaacccggttcccggggttaacgggtacccccgttaacccgggttttaacccgacccgttaaaccccgggg

SEQ ID NO: 270965 - DNA, 805 bp, Homo sapiens
  misc_feature: GYAE6OF02JOUGM.25.87.H10.1.454.CMB.1.raw
  modified_base (705)..(705): a, c, t, g, unknown or other
  misc_feature (705)..(705): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcgcgcccagatgggtcctgtcccagcctgcgtctgacaggagtcgacgcccagggcaggtgaacgccgttcgggacgaccctggtcccctccacctgcctcgtcgttcctcgttcggtacgaccttcccgaacttccaacccgaggttaaatcggtccttacctacgttttaccgggtggggtccttccggggtcccttccccggacccgtaccccggaccccccggtaagggggaaccggtcccggtttaggggacggtcggttaaggttccggaccggtttaagtttcggtttacctttacggtaacgttaggggttacggggtacgttaccggtaacccgttaacgtaccgtaaccccgttccccgttaacccgtagtaaacggttcggtacggacggttaaccctaacgtttaacgtttttcgggtacggaaccctaccgggtcccgtaacggtcgaacggttcgttaacgttcggttaccttaccgtacgtaccttacgtacgttacccgttgttccggtacccggacccggtcccgtaccgggaaccgtccgggtaccttacgttacttacgnggtaccgacggtacgtcgtacgcgtaccggaacctacccgaaccttacccgtgtacgccgtacgcggtacgacgggttaccgcgtccaccgtcacctccg

SEQ ID NO: 270966 - DNA, 1017 bp, Homo sapiens
  misc_feature: GYAE6OF02IX0GK.25.87.H10.1.454.CMB.1.raw
tcagactgtacagtcacgaccggtgctcgatttagcagtactgcgttgggtttggggctttctgagagtcatggacctcctgtgcaagaacatgaagcacctgtggttcttcctctgctggtggcgcgccagagtggtcctgtccagctgcgtctgcaggtagtcgacgcccgagggccaaggtgaaacgtccgttcggaacgtaccccgttcggtcccctacgtaacccgttgtccttccgttaaggttccgttacgttacgggtaccgtaaccgttaccaacttcccgaaaccgtaaaggtttaactcgtccttaacttaacgtttacgggtcggggcctttccggacccgttaccggtaaccccgtacccggaccccccggtaaaaggggggtaacccgggtccggttaacgggggtaacggtttcgggttaacgtttacgggtaccggtttaacggtttttcggttttacccggttttaacgtaaccggttttaggggttaacgggttaccggtaccgtttacccgttaaaccgttaacccggtaccgtttcccccgttaaccgttaacggaaacgttaacggtttaccgtaaacgtttcccgtaaacgttttaccgggttttacgggttaaaccgaacccggttacccgttaaaccgtaccgtaaccgttaaccgggttaccgtttaacggttttaccggtttaccttaccgttaaaccggtaacccgtaacgggtttacccgttaaaccgtttccggtttacggttaacccgggtccccgggtacccgtaccccggtaacccggtacccgggtacccgtttacgttaaacccgtttcgttcgggtacgtacgaaccgggtttacgaacgttacgggtacccggttaaacccggtacccttaacccgtaaacccgtttcggtttaaccgacccgggttaaccggaccgggttaacccggaaccgggttaccggttacgttaccccggtaaccgttacccgacgttaacccgg

SEQ ID NO: 270967 - DNA, 616 bp, Homo sapiens
  misc_feature: GYAE6OF02JF6AG.25.87.H10.1.454.CMB.1.raw
  modified_base (232)..(232): a, c, t, g, unknown or other
  misc_feature (232)..(232): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
  modified_base (608)..(608): a, c, t, g, unknown or other
  misc_feature (608)..(608): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctgggtggcggcgcccagatgggtcctgtcccagctgcgtctgcaggagtcgagcccgagggcaggtgaagtccttcggacaccctgtccctcacctgctctgtctcgtggtnacctccactcacagtaatcgctactagttacggtcgggctcggcctccgccgaccgcccccggagggaccggtcgtggagtggtagtcgcgtattgttcttnagtggtggntcgctactacncgtccctcctacagtcgctactcctacttagtttcggtacacctaccgtaccaccgtcacggtctggttctctctacgaccacgtcgtaccttcgttacgccggtacccgccgaccgtccgaccggtccttagttacttacgtgtcggacgtacgcgtacgacgaccggtaacccgtaccctaacctacccgttaccgttacgaccggtacccgtcggggaccgtaccgggacgttaccgtaccgaccgttccnccgtaccg

SEQ ID NO: 270968 - DNA, 917 bp, Homo sapiens
  misc_feature: GYAE6OF02GGEXS.25.87.H10.1.454.CMB.1.raw
tcagactgtacagtcacgaccggtgctcgatttagcagtactgcgttgggtttgggggctttctgagagtcatggacctcctgtgcaagaacatgaagcacctgtggttcttcctcctgctggtggcggcgcccaagatcgggtcctgtcccagctgcgtctgcaggagtcgagcccgagggcagggtagaacgtccgttacggacgacccttcgtccccgtcacctgctctcgtctcgtggtacgacctaccataccaaccgaagttaactgtcctactaacgttacggtcggggcctcggtccgtcccgacccgtaccggacccccggaaggggaaccggtccgtagggtagggtacggtagttccggacgttacgttttcgttaccgttttaacgaggttaacgggtagggtacgttccggtaacccgttaacgttacccgttaaccccgttccccttaccgtaacgaaacggttacggtaccggtaacgtaccgttaaccgtttaacggtttaccgggttaccgaaccgttaccgacccggtaccgtaccgtaaggtccgtttaacggttttcgttacgtccgttacgtaaccctaggtacggtacccgtttacggtccggttaaccccggaacggttcccccgggaacgtaaccgggtcccggttacccgtttactaaccggttttccggtaggttcccgtaaacgggcgttaaccggtaccggtaacccggggtaccggtaaaccccccggttaaaccccctttaaacccggttaacccccggtttaagttaaccccggtaacccggtaaaccggggtttcccgggggggaaacccggtttaaccccgggaccccgggttttaaccggacccggttacccccgggtttaacccctacccgggtaaccccgg

SEQ ID NO: 270969 - DNA, 844 bp, Homo sapiens
  misc_feature: GYAE6OF02GRNY9.25.87.H10.1.454.CMB.1.raw
  modified_base (165)..(165): a, c, t, g, unknown or other
  misc_feature (165)..(165): n is a, c, g, or t
tcagactgtacagtcacgaccggtgctcgatttagcagtactgcgttgggtttgggggctttctgagagtcatggacctcctgtgcaaagaacatgaagcacctgtgttcttcctctgctggtggcggcgcccagatgggtcctgtccagctgcgtctgcgaggngtcgacgcccgagggcagggtgaacgtccgttacgggacgtaccccgttcgtccccctcgtacctgtccttcgttcgttcctcgtcggtacgaccttaccaactaccaaccgtagttaactcgtaccttactacgtttacgggtggggtaccgttcgggtcccgtaccccgacccgtaacccggacccccccgggtaagggggtaacccggggtcccgtaggggtaacgggtagggttacttacgggtaccgttagttttccggtttaccttttacggtaagttacgggtgggtacgtaccgtacccttaaccgttaaccgtacccgttcccccttaccggtaacgtaacggtaccgttaacgtacgttacccgttaacgtttacggttttacccggtaacgtacccgtaaccgtccgtaacggccttaacggtacttcggttctaccgtcgtacgtacctacgtcgtaccgtggttaccgtaccgaccggtacccgaccggtacccgtccgggtacccgttacttaacggttccgtaggtcgtaacggtacgtacggtacgtacgggtacccgtaaaccgttaacccgtaacccttaaccgttacggttaccgaaccgttaccgggtaggaacccggtacggtacccggtaccgtaccgtacccgtactaccggtacc

SEQ ID NO: 270970 - DNA, 757 bp, Homo sapiens
  misc_feature: GYAE6OF02GW21U.25.87.H10.1.454.CMB.1.raw
  modified_base (144)..(144): a, c, t, g, unknown or other
  misc_feature (144)..(144): n is a, c, g, or t
  modified_base (346)..(346): a, c, t, g, unknown or other
  misc_feature (346)..(346): n is a, c, g, or t
  modified_base (403)..(403): a, c, t, g, unknown or other
  misc_feature (403)..(403): n is a, c, g, or t
tcagactgtacagtcacgaccggtgctcgatttagcagtactgcgttgggtttgggggtcagacccagtcaggacacagcatggacatgagggtccccgctcagctccgtggggctcctgctgctctggctccaggtgcccaangtgacatccaggtgacccagtctccttccaccctgtctgcatctagtaggggacagagtcaccatcactgcggcagtcgagtgtgggcggctttggacgtggtatcagtcaactaaaccgagggaaacgcccccaaatccctactctaagtcgaagtccgttactaacttacacagtgacgttcccctagacggttacgacncggactacggtgagttcgaggggaacagtaaacttcgactcgtacacccgaatacgnggaccggtacccgtgacctaaacgtacggaagttacgttaacgttttaacggaaccctttaaaagtttaaccttaaacgtcccgtaaccgaacggttacctaaagtttaacgtttaaactttttttaaccttacgttcgtttaccccggttttacccgtttttacgggtaccccggtaagggggtaaccccggtaagggggttaaccggtaaagggtaaacggtaacgaaaaccggttaccggaaacggtttcggttcggggaaccctttaccggacccgttaaccgtaacccgttaccggtttaacggtttccgtttaaccctaacggttttaccctacccccggtttaaccc

SEQ ID NO: 270971 - DNA, 832 bp, Homo sapiens
  misc_feature: GYAE6OF02GO52J.25.87.H10.1.454.CMB.1.raw
  modified_base (126)..(126): a, c, t, g, unknown or other
  misc_feature (126)..(126): n is a, c, g, or t
  modified_base (244)..(244): a, c, t, g, unknown or other
  misc_feature (244)..(244): n is a, c, g, or t
tcagactgtacagtcacgaccggtgctcgatttagcagtactgcgttgggtttggggggctttctgagagtcatggacctcctgtgcaagaacatgaagcacctggtggttcttcctcctgctggnggcggcgcccagatgggtcctgtcccagctgcgtctgcgaggagtcgagcccgaggggcagggtgaacgtccgttcggacgtacccctgtcccctacacctgctctgtctctggtacncctccatccacgagtaatcgctacagttacggtgggctcggcctccgaccaccggccccggaggggaacggccgtaggggagtggtactcggtagtacgtttacggttcctttacgaggttagggtgggtacgtcggtaccctaacgtaccgtacccgttcccctcccgtaaacgaaccggtacgtaccggtacggttaccctaccggtttaacgtttttccgggtaccggaaccgttaacccggtacccgtaaccggtaactaacgggtaccgtttaaacggttttcgttaccctaccggttaacgacccgtaccgtttaccggtaccgttcggttaacccgggtacccgaaccccgggtaccccggaaccggtaaccccggtaaccgggtacccctttaaggttaccttaacggtcggttacggacggtaagtacgcggtaacccgggtaccgggtaaacccggttaacccctaacccgttaaccccgttacgtttaacccggaaccggtaacccggtaccggggtaccggtaaccgggtacccggttaccggtaccccgtacccgtacccgtacccggtaacccg

SEQ ID NO: 270972 - DNA, 622 bp, Homo sapiens
  misc_feature: GYAE6OF02GF51I.25.87.H10.1.454.CMB.1.raw
  modified_base (246)..(246): a, c, t, g, unknown or other
  misc_feature (246)..(246): n is a, c, g, or t
  modified_base (577)..(577): a, c, t, g, unknown or other
  misc_feature (577)..(577): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccgaggtgcccaatgtgacatccaggtgacccagtctccttccacctgtctgcatctatagggacagagtcaccatcactcgccggcagtcggagtgtggcgtctttggctggtntcgagcaacaaccgaggaacgaccccctaactccctactctacgtgacggtcgtctacttacactacgtacgggactccccgtacgtaacggtcgtaggcggactaggtcggtatcggtacggactaggtactcgactcgcaaccgtataccgcggccgtactggacctaactcggtactagttaccgtttagccttaagttcttacgcggaccttaaggtccttaagttaatttaccgttttactacgttcgttcccgttttacggttcggaccggtacggggtacctagggggttccaaagtccggactaacggctaacgtcggtaggntccggactaacgtcttcgtcttccgtacctcgtccctaccggtac

SEQ ID NO: 270973 - DNA, 628 bp, Homo sapiens
  misc_feature: GYAE6OF02JMJZ9.25.87.H10.1.454.CMB.1.raw
  modified_base (166)..(166): a, c, t, g, unknown or other
  misc_feature (166)..(166): n is a, c, g, or t
  modified_base (240)..(240): a, c, t, g, unknown or other
  misc_feature (240)..(240): n is a, c, g, or t
  modified_base (443)..(443): a, c, t, g, unknown or other
  misc_feature (443)..(443): n is a, c, g, or t
  modified_base (462)..(462): a, c, t, g, unknown or other
  misc_feature (462)..(462): n is a, c, g, or t
  modified_base (468)..(468): a, c, t, g, unknown or other
  misc_feature (468)..(468): n is a, c, g, or t
  modified_base (518)..(518): a, c, t, g, unknown or other
  misc_feature (518)..(518): n is a, c, g, or t
tcagactgtacagtcacgaccggtgctcgatttagcagtactgcgttgggtttgggggctttctgagagtcatggacctcctgtgcaagaacatgaagcacctgtggttcttcctcctgctggtggcggcgcccagatgggtcctgtcccagctgcgtctgcaggngtcgacgcccgagggcaggtgaagtccttcggacgacccttgtcccctcaccgtgctcgtcgtcctcgtggtcncctccatccactagtatcgctctacttcggtcgggctggcctcccgcgacccggccccggaaggggacggccgtgggacggtggtacgttcgacgtagttcgttcgtttacagttacggtgggtcgtcggtaccctacgacgtaccgtccctaccgtagaacgtcgtcgacgtactacgtagtttcgtacactacgtccacgngctacgtgttcgtcctganaccgtntcgtcgtcgtcgaccgccgccgtcgaccgtcgtcctattacgttgtacgngtacgacgtacgtacgcggtaccgtaaccgtaaccctaccttaccgtcgttacgcccggtacggtacgggacgtacgggttaccgaccgttccacccgttcaccgtaccg

SEQ ID NO: 270974 - DNA, 730 bp, Homo sapiens
  misc_feature: GYAE6OF02FT3UH.25.87.H10.1.454.CMB.1.raw
tcagactgtacagtcacgaccggtgctcgatttagcagtactgcgttgggtttgggggtcagacccagtcaggacacagcatggacatgaggtccccgctcagctcctggggctcctgctgctctggctcccaggtgacccaatgtgacatccaggtcgacccagtcctccttccaccctgtctgcatctatagggacagagtcaccatccacttcgccggccagtcggagtgtggcgtcttttggcctggtatcacgtcaacgaaaccgaagggaaacgaccccccaaaatcccctaccactaacgtgacggtccgttacttaaccgtttaccacgtaacctcggaaccgttccccctacgtaacggttacacggccggtacgaggtcggtagtaccgtacggggtacaagtaacgtttacaaccgtttcaccgtaactactaccgtaagcccgtacgtcgtaaccgaaaccttgtaagttcgttaacttttaacgaccttaaaacgtttaacttaaccggtaccgtacgtaaccgtacgtaaacgtttaaattttaacccgtttttaccttacgttaccgttaccgttttaccgtttaccgggacccggtaacgggtaccgtaggggtacgtaggacgtaacgacgggtaacaccgcgggtttagacgttacggaccttaccaacgtcgttaccgttaccttacctacggtttaccctcccggtaacc

SEQ ID NO: 270975 - DNA, 846 bp, Homo sapiens
  misc_feature: GYAE6OF02JQSN5.25.87.H10.1.454.CMB.1.raw
  modified_base (192)..(192): a, c, t, g, unknown or other
  misc_feature (192)..(192): n is a, c, g, or t
tcagactgtacagtcacgaccggtgctcgatttagcagtactgcgttgggtttgggggtcagacccagtcaggacacagcatggacatgagggtccccgctcagctcctggggctcctgctgctctggctcccaggtcgcccaatgtgacatccaggtcgaccacgttctccttccaccctgtctgcacttntagtagggacagacgtaccacctatcacttacggccgggccgtaacggcgggtaaggttcgggtttcgggggtccggttccggttttcgggtccggttaggttacgtaccggacgaaccgtaaaccaaaccggaaacggggaaaaccccgtaacccccgtaaaccgttaccccttaccgttactaacggtcggtacgggtaccgttaccgttaaccgttttaccgaaccgttacggtaccggtaccggttaccccgtacgtaacggttacgtaccggtaccggtaccgtaggttacgggtacgttaccggtacggggtaaacgaacgttaacgttaccctaaccttacgttaacccaccgttaacgtaccggtacggtacccgggtcggtaccgtaccgacccgttagtaacgtttcggttaacgtttacgacgtttaacgttacctttaccgtcaacgtaccgtattaacgttactttaactttaccgtactttacggttaccggttttaccggttaccggtaccggtaaacgggtaccggtagggtaacgacggtaacgtcgtaacgtacgggtacgtacggtcggtaccgtcgtaccgttacgtcgttaccgtcgttacccgttccgttaaccgttcccgttaacccgtcg

SEQ ID NO: 270976 - DNA, 590 bp, Homo sapiens
  misc_feature: GYAE6OF02FTPY9.11.87.H10.1.454.CMB.1.raw
  modified_base (389)..(389): a, c, t, g, unknown or other
  misc_feature (389)..(389): n is a, c, g, or t
  modified_base (417)..(417): a, c, t, g, unknown or other
  misc_feature (417)..(417): n is a, c, g, or t
tcagcgagagataccacgaccggtgctcgatttagcagtactgcgttgggtttgggctcaactctcttgtccaccttggtgttgctgggcttgtgattcacgttgcagatgtaggtctgggtgcccaagctgctggagggcacggtcaccacgctgctgagggagtagagtcctgaggactggtccagcctgggggatccctcagactctcatgtgcagcctctggattcaacgtcaagaaacaactttatgagttgggtccgccacggccccagggaaacggggctgggaggtgggtctcgagtctatttataggtggtgacacaacatactatacagacgctgtagaagggcagattcgacgtctaccgagacgacactaccgaaanacacttcctactatcttcagatcgaacngcctgcgtagtccgaacgacgacggctagttaattaatttagttacggtaacggggaagtagttcggtagcgttaggtaccgttggtacctaatttacgtaccgttacgtaaggttggtttaccgttcggtaagttccggttacggttacgggggttccgtacggtacccccg

SEQ ID NO: 270977 - DNA, 854 bp, Homo sapiens
  misc_feature: GYAE6OF02G75WC.11.87.H10.1.454.CMB.1.raw
tcagcgagagataccacgaccggtgctcgatttagcagtactgcgttggggtttgggctcaactctcttgtccaccttggtgttgctgggcttgtgattcacgttgcagatgtaggtctgggtgcccaagctgctgggagggccacggtcaccacgctgctggagggtagtagacgtccgtaggaggtacctcgggtaccaggtccggtgggggtactcccctacgagtacctctctagtgtcgcgtacgccttcggtcggtacttccgaacgtacgaaacgtaaacttaacgtttacgtaggttacgggttcgggtaccccgtaccggaccgggtaccccggtaaggggaaacgggggtcgtaggggtacggttcgggtcctacgtacggtacttacggttttaacgtaggttcgggtacgtacctaacgtaactacttaacgtaacttaacgacggtccgtagtagggttacgggaaaggtcctaacggttacctttcccggtaacccgttaccgttaacccgaaggtaacccgtaaccgtaacccggttaacccggaaacgtaaccctacctttaacccgtccgtttaactttacccgttacgaaacggttactaaacggtaaccgtaccgggtacctaccgggttaacgggtaacccgttacccgaaccggtaaccgtaaccgggtcttaacgtttaacgttaacgtttacgggtacgggtaacggtcttaagggttcggtagtaccgtacgtacggttggtaactttacgtaacgttaccgttacgtaagggttccgtttagtacggtcgtttacggttacgggtcgggttcccgtaccgtaccccggg

SEQ ID NO: 270978 - DNA, 510 bp, Homo sapiens
  misc_feature: GYAE6OF01CTB55.25.4.A04.1.454.CMB.1.raw
  modified_base (269)..(269): a, c, t, g, unknown or other
  misc_feature (269)..(269): n is a, c, g, or t
  modified_base (391)..(391): a, c, t, g, unknown or other
  misc_feature (391)..(391): n is a, c, g, or t
  modified_base (440)..(440): a, c, t, g, unknown or other
  misc_feature (440)..(440): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgagacagaatcagcatcacttgccgggcgagtcagggcattagcaattatttagcctggtatcaacagaaaccaggganagttccaagctctgatctatgctgcctccacgttacactcgagggtcccatctacggttcagcggcagtgaatcgtgggacagagttcactctacactatcagcagcctgcagcctagaagntgttgactaactttatactagtaactaaagtataactactcgacccttntaccgtacgtttcgggacggtaacggacccgaagggttcgaacgtaacgtaacaaacggtagtggtacgg

SEQ ID NO: 270979 - DNA, 523 bp, Homo sapiens
  misc_feature: GYAE6OF01DC4FM.25.4.A04.1.454.CMB.1.raw
  modified_base (270)..(270): a, c, t, g, unknown or other
  misc_feature (270)..(270): n is a, c, g, or t
  modified_base (435)..(435): a, c, t, g, unknown or other
  misc_feature (435)..(435): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccaggganagttcctaagctcctgatctatgctgcctccacgttacactcagggtcccatctcgttcagcgcagtgaatcgtgggacagtagttcactctcactatcagcagcctgcagcctagaagatgttagctaacttattactgtactaaagtataatactcgcccctntccgtaacgtttccgggacgggtaacgggtaacccgaaaggggttacgggaacgtaacgttaccgaaaaacggtacgtggttaacggg

SEQ ID NO: 270980 - DNA, 630 bp, Homo sapiens
  misc_feature: GYAE6OF01A55HY.25.4.A04.1.454.CMB.1.raw
  modified_base (222)..(222): a, c, t, g, unknown or other
  misc_feature (222)..(222): n is a, c, g, or t
  modified_base (259)..(259): a, c, t, g, unknown or other
  misc_feature (259)..(259): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccatccctcctgtctgctatctgtgagacagaatcagcatcacgttggccgggngagtcgaggtcattagctaattattacgcctaggtanacaacgagaaaccgagggtacgtacgttacctaagtcctccgtagtacttctatcgactcgtcctacctacgttacaccgtcgacgggtcccacgtcgtcggtacgacgcgactagtagaacgtcgtagggactagtacgttacactactacctactacgtacgacgtcgaacgtcctacgaccgtacggtaccgtaaggtaacgtacgttacggttaactaacttaaacttttaacgttaacgttaacgttaaactaaaacgttactaacctaccgtcccgttaccccttacgtaccgttaccggttacggggacggtaacgggtaaccgtaagggtacgaacgtaccgtaacgaacgtcgttggtacgg

SEQ ID NO: 270981 - DNA, 515 bp, Homo sapiens
  misc_feature: GYAE6OF01AEQYV.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagtcctaagctcctgatctatgctgcctccacgttacactcaggggtcccatctcggttcagcggcagtgaatctgggacagagttcactctcactatcagcagcctgcagcctgaagatgttgactaacttattactagttacaaaagttataaacttactcgtcccctctaccgtacgtttcgggacggtacggggaacccgaagggttacggaagactaacgaaacggtaacgtggtacggg

SEQ ID NO: 270982 - DNA, 481 bp, Homo sapiens
  misc_feature: GYAE6OF01B4M6M.25.4.A04.1.454.CMB.1.raw
  modified_base (434)..(434): a, c, t, g, unknown or other
  misc_feature (434)..(434): n is a, c, g, or t
  modified_base (468)..(468): a, c, t, g, unknown or other
  misc_feature (468)..(468): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcaggggtcccatctcggttcagcggcagtgaatctgggacagagttcactctcactatcagcagcctgcagcctgaagatgttgacaacttattactgtacaaaagtataaatactgcccctntccactttcggacggtgggaccaaggtgagatanaaacgatggtcgg

SEQ ID NO: 270983 - DNA, 498 bp, Homo sapiens
  misc_feature: GYAE6OF01BKU2S.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcaggggtcccatctcggttcagcggcagtgaatcgtgggacagagttcactctcactatcagtcagcctagcacgcctgaagatgttgactaacttattactgtacaaagtataatactcgtccctctctactttcggacggtagggacccgaagggtaggaacgtacacgaaacgtactggtacgg

SEQ ID NO: 270984 - DNA, 508 bp, Homo sapiens
  misc_feature: GYAE6OF01B1NR3.25.4.A04.1.454.CMB.1.raw
  modified_base (427)..(427): a, c, t, g, unknown or other
  misc_feature (427)..(427): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtggttatcactactggagctggatccgccagcacccgagggaagggcctggagtggattgggtacatctattaccggtgggagcaccttctaccaacccgtccctcaatagtcgagtcaccatctcattagacacgtactaagaacctagttctccctgtaagttgaactctgtgactgccgcggacncggccgtgtattactgtgcgcatactacgatactagtgccgatatcaccatcacgattcgtcttttgatctgtggggaccg

SEQ ID NO: 270985 - DNA, 546 bp, Homo sapiens
  misc_feature: GYAE6OF01C1PUP.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccagggagagtcctaagctctgatctatgctgcctccacgttacactcgagggtcccatctcggttcagcgcagtgaatcgtgggacagagttcactctcactatcagcagcctgcagcctagaacgtattgttagactaaactttattactagttaacctaaaagttataaactaccttacgcccccttattaccgtaacgttttcccgggacgggtaacggggaacccgtaaaggggtcgggtaacgtaaacgttaccgaaaaaccggacgttggttaacggg

SEQ ID NO: 270986 - DNA, 505 bp, Homo sapiens
  misc_feature: GYAE6OF01BJZ53.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcaggggtcccatctcggttcagcggcagtgaatctgggacagagttcactctcactatcagcagcctgcacgcctgaagattgttgactaacttattactagttaacaaagttataactactcgtcccctcttacaccgttttacggcgggtagggacctaagggtcggagtactacaaacgtacgtggtacgg

SEQ ID NO: 270987 - DNA, 603 bp, Homo sapiens
  misc_feature: GYAE6OF01BJ1A1.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttgccgggcgagtcaggacattagtcactgtagtaaattggtatcaacagaaaccaacggggaacccctaaactcctagatactacgatcgcctacaagtttggaggcgaggggtcccatacaaagttcactaggaagtggatcgtgggactagtatttagttgtactatcgagcagctgacaactgtaagtatttacgactaactattactttcgtgtaacctaacctaagttaattacggtacttccgttacccttaccctactaccttacgttttacgggacccgtaacgggggtaaccctaaggggtcggtaaaggtaacgttaaccgaaaaaccggtaaccggttacggttacgggtaccttacggacctaaacccgtagtttacccgg

SEQ ID NO: 270988 - DNA, 604 bp, Homo sapiens
  misc_feature: GYAE6OF01CGCSH.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcgagggctaattacgactaaattattttagccttggtaataccaacaaggaaaaccgaggggacgtagtttaccctaaagccttacctgtactctatcgtctcgtcctacctacgttaccactcgtacgggtcccagttccgtcggttcacgcgctagtgaatcgtgggacagtacgtcactctactactactcgaagtcaacggccctacgactccgtagaaagtcttagttactactaaacgtttacttaccttagtaaactaaaagttaattaacttaccgtccgtacccccttatacccgtacggtttccgggacggtaacgggaacccgtaagggtacggaacgtaactaacgtaaacggtaactgggtcgtacg

SEQ ID NO: 270989 - DNA, 517 bp, Homo sapiens
  misc_feature: GYAE6OF01CHQHS.25.4.A04.1.454.CMB.1.raw
  modified_base (219)..(219): a, c, t, g, unknown or other
  misc_feature (219)..(219): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaattatttagcctggtatcaacagaaaccagggagagttcctaagctcctgatctatgctgcctccacgttacactcgaggggtcccatctcggttcagcggcagtgatcgtgggacagagttcactctcactatcagcagcctgcagcctagagatgttgactaacttattacgtagtactaaagttataacttacctcgtacccccttcgttacctaccgtttcgggaccgggtagggacccgaaagggtcggaagtactaacgaaacgtacgtggtacgg

SEQ ID NO: 270990 - DNA, 781 bp, Homo sapiens
  misc_feature: GYAE6OF01EHUEQ.25.4.A04.1.454.CMB.1.raw
tcagactgtacagtcacgaccggtgctcgatttagagtagtgatcagggggcagaaagggtctctctcaggtcacggacaccaggcttatgggacttatgtaggggtccctgctcgagctacctgggactcctaggctcgcttcgtgggtcgtcccaggatacctaggtatttgttggtacggtcctaagttaaagttgacccaggttctccgagttccgtccctgtccttggccgagttcgtgggttaggacgtacgtagaagtccgtaggggcccaagtcctaccgttcggccggggcgacgtcgacgggtctagttagtacctaaacttttagtttacgaccttaggttactacaaactaggaaaacccggtaggggtacggtaccgttacccgtaaaggtcccttacccggtagggaacggttccttaaggtcggtccgttcgtcccgttacgtaccgtttacgtacggttcggtacggggtccctagttccggtcggttcaggtaccggactaggtcgaactccggtgggaacgacgggtaccgttccacgttctacctactagtacgacgtacctacgaccgtacaccgtactacgtaagtaacgtattacgtaacgtaaccttaacgtttctttaacggtacgttaaaccaaaggttaactaaccgttaccgtcccgtaccccttaacgttcggttaccgtttcggggaaccgggtaacgggtaaccgtaagggtacgggtaactacggtaaccgaaacgtgttcggttaacgg

SEQ ID NO: 270991 - DNA, 514 bp, Homo sapiens
  misc_feature: GYAE6OF01DELH5.25.4.A04.1.454.CMB.1.raw
  modified_base (219)..(219): a, c, t, g, unknown or other
  misc_feature (219)..(219): n is a, c, g, or t
  modified_base (344)..(344): a, c, t, g, unknown or other
  misc_feature (344)..(344): n is a, c, g, or t
  modified_base (508)..(508): a, c, t, g, unknown or other
  misc_feature (508)..(508): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaattatttagcctggtatcaacagaaaccagggagagttcctaagctcctgatctatgctgacctccacgttacactcacggggtcccatctcgttcagcgctagttaanctgggacagagttcactctacactatcagcagcctgcagcctagtaagatgttagctaaactttattactagtaactaaaagtattaactactactccctactctaccgtttcggacgggtaacgggtacccaagggtggaacgaacttacgaaagacgttggnggtacg

SEQ ID NO: 270992 - DNA, 570 bp, Homo sapiens
  misc_feature: GYAE6OF01CNQJ3.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttgccgggcgagtcgagggcattagctaattattagctggtatcaacagaaaccagggagagttcctaagctctagatctatgctgcctccacgttacactcgacgggtccactcgtcggtcaggcgctagtgaatcgtagggactagtagttcactctacactatcagcacgcctgacacgtcctagaacgtagttgttactacgttaaactttacgttactagttaaactaaaagttacttaaacgttacctccgtaccccttcgttaccgttaccggtttaccgggacggggttaaaccgggaaccggtaagggtacgggaacgtaacgtaaccgtaaaacggtagtgggtacggg

SEQ ID NO: 270993 - DNA, 501 bp, Homo sapiens
  misc_feature: GYAE6OF01BV2IH.25.4.A04.1.454.CMB.1.raw
  modified_base (388)..(388): a, c, t, g, unknown or other
  misc_feature (388)..(388): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttctaagctcctgatctatgctgcctccacgttacactcagggtcccatctcggttcagcgcagtgaatctgggacagagttcactctcactatcagtcagcctgcagcctgaagnttgttgactaacttattactagttactaaaagtataaactactacgtccccttctcctacgtttcggacggtacgggaaccaagggtacgtacgatacaaacgacgtgtacgg

SEQ ID NO: 270994 - DNA, 516 bp, Homo sapiens
  misc_feature: GYAE6OF01EEVNW.25.4.A04.1.454.CMB.1.raw
  modified_base (393)..(393): a, c, t, g, unknown or other
  misc_feature (393)..(393): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattattagcctggtatacaacagaaaccagggagagttcctaagctcctgatctatgctgcctccacgttacactcgagggtcccatctcgttcagcgcagtgaatcgtgggacagtacgttcactctactactatcagcagcctgcagcctgaagtntgttgactaacgtttattacttagtaaccaaagttactaatacctcgtccccttatccgtacgtttcgggacggtacgggacccgtaagggtcggaacgactaacgaaacgtacgtggtacgg

SEQ ID NO: 270995 - DNA, 571 bp, Homo sapiens
  misc_feature: GYAE6OF01C0IEW.25.4.A04.1.454.CMB.1.raw
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttaccactcgagggtcccatctcggttcagcgcagtgatcgnggganagtgtcactctctacgtatctagcacgcctgacgacgtccgtagaacgtagttgttacgtacttaaactttacttaacgttagttaacgtaaaagttacttaaacttaccttaccgtcccccttactacccgtttaccggttcccggggaacggggtaaccgggaaccggtaaagggtacgggtaaacgtaacgtaaccgaaaacgtacgtggtaccggg

SEQ ID NO: 270996 - DNA, 651 bp, Homo sapiens
  misc_feature: GYAE6OF01BCTZQ.25.4.A04.1.454.CMB.1.raw
  modified_base (531)..(531): a, c, t, g, unknown or other
  misc_feature (531)..(531): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcgagggcattagctaatttatttagccttggtactcaaacagaaaccgagggagacgttacctaacgctcctagtatctatgctcgtcctacctacgtttaccaccgtcgaacggggtcccagttccgtcggttaccaggtcggacgtacgtgaaacttcggtacgggaacgtagtaacgtttccaacttccttacgtaactacgtcgaacgtcaacgtcccgtagaccaacgtccgtaagaagtcttaggttacgaacttaacgttaattacgtacgttaaactaaaggttaattaactccgttacncccccgtttattacccggttacgtttaccggggacccggggtaacggtaaccggttaaacgggtacggtaaaacggtaccgttaaaacccggaaacgttaaaccggttggtaacccgggg

SEQ ID NO: 270997 - DNA, 505 bp, Homo sapiens
  misc_feature: GYAE6OF01DWAJ4.25.4.A04.1.454.CMB.1.raw
  modified_base (258)..(258): a, c, t, g, unknown or other
  misc_feature (258)..(258): n is a, c, g, or t
  modified_base (321)..(321): a, c, t, g, unknown or other
  misc_feature (321)..(321): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagtggttatcactactgganctggatccgccagcacccagggaaggcctggagtggattgggtacatctagttaccgtgggancaccttctacaacccgtcctcaatagtcgagtcaccatctcattagacacgtctaagaacctagttctcctagagttgaactctgtagactgccgcgacgacggccgtgtactacgtgtcgcgcatactacgatactagtgcgatagtcacatcacgtatgtcttttagattatcgtgggaccg

SEQ ID NO: 270998 - DNA, 523 bp, Homo sapiens
  misc_feature: GYAE6OF01EIT00.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctcacgttacactcaggggtcccatctcgttcagcggcagtgaatcgtgggacagtagttcactctcactactcagcacgcctgcagcctagaagtatgttgacttaacttattactagtaacaaaagttattaaactactcgaccccttcttccgtacgttttccgggacgggtacgggtaacccgaagggttacggacgaataccgaaaacgtagtggtacggg

SEQ ID NO: 270999 - DNA, 520 bp, Homo sapiens
  misc_feature: GYAE6OF01DFSIV.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcagggcattagcaattatttagcctggtatcaacagaaaccagggagagttcctaagctcctgatctatgctgcctccacgttacactcgacggggtcccatctcggttcagcggcagtgaatcgtagggacagtacgttcactctacactatcagcagcctgcagcctagaagtattgttacgactaactttattacttagtaactaaaagttattaactacctcgtcccctctccgtacgtttcgggacggtacgggaccgtaagggcggacactacgaaacgtagtggtacgg

SEQ ID NO: 271000 - DNA, 560 bp, Homo sapiens
  misc_feature: GYAE6OF01A6GZT.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccagggagagttccaaggctcctgatctatgctgcctcacgttacactcgagggtcccatctcggttcagcggcagtgaatcgtgggactagagttcactctcactatcagcagcctgcagccctagaagattggttacgaccttaactttaatttaccttaggttaacctaaaaagttataaacttacctaccgtcccccttacgtaccgttaccggttttcgggaccgggtaacggggtaaacccgaagggttacgggaacgtaacgtaaccgaaaaccggtaacgttggtaccggg

SEQ ID NO: 271001 - DNA, 515 bp, Homo sapiens
  misc_feature: GYAE6OF01BDNHN.25.4.A04.1.454.CMB.1.raw
  modified_base (219)..(219): a, c, t, g, unknown or other
  misc_feature (219)..(219): n is a, c, g, or t
  modified_base (339)..(339): a, c, t, g, unknown or other
  misc_feature (339)..(339): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagcaattatttagcctggtatcaacagaaaccagggagagttcctaagctcctgatctatgctgcctccacgttacactcgacggggtcccatctcggttcaggcgnagtgaatcgtagggacaggtagttcactctcactatcagcacgcctgcagcctagagattgttagactaacttattactagtactaaagtataatctacgtccccttctacgtaccgtttcgggacggtacgggaaccgtagggtacggtagaactaacgaaacgtagtggtacgg

SEQ ID NO: 271002 - DNA, 526 bp, Homo sapiens
  misc_feature: GYAE6OF01B9P8U.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcagggtcccatctcggttcagcggcagtgaatcgtgggacagagttcactctcactatcagcagcctgcagcctagaagtatgttgactaacttattactagttacaaagttataacttactacgtccccttactaccgtaccgttttaccgggacgggtaacgggtacccgaaagggtcggaacgtaacgtaccaaacggtaacgtggtacggg

SEQ ID NO: 271003 - DNA, 638 bp, Homo sapiens
  misc_feature: GYAE6OF01DOV09.25.4.A04.1.454.CMB.1.raw
  modified_base (229)..(229): a, c, t, g, unknown or other
  misc_feature (229)..(229): n is a, c, g, or t
tcagactgtacagtcacgaccggtgctcgatttagagtagtgatcagggggcaggaagtctctctcagtcaggacacagcatggacatgagggtccctgctcagctcctgggactcctgctgctctggctcccagataccagactgtgacgttccagatcgacccagtctccatcctccctgtctgcatctgttggagacagtaatcagccaatcgaacttgcccgggnagtcagggcattagactaagttattacgcctggtatacaactagaaaccgagggacgagttacctaagccgtaccgtggtactactatgtctgcctccacgttacactcgacgggtcccattctcggttcacgtcggactagtacgaactcgaggacctagtacgttcgactctacgtacttacgtcaagtcgtaagtccgttgacgtacgtaacccgtagtaacgtaacgtttgttacgtaccttaaacgtttaacgtttaaccgttagtaaacccgtaaaaggttactaacgttacctacgccccctttacgtacccgttaccggtttaccgggtacgggtaacgggtaacccgtaacgggttacgaacgggttaactaaccgtaaaccggttatcgggttaaccgg

SEQ ID NO: 271004 - DNA, 515 bp, Homo sapiens
  misc_feature: GYAE6OF01CLW9R.25.4.A04.1.454.CMB.1.raw
  modified_base (219)..(219): a, c, t, g, unknown or other
  misc_feature (219)..(219): n is a, c, g, or t
  modified_base (447)..(447): a, c, t, g, unknown or other
  misc_feature (447)..(447): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaattatttagcctggtatcaacagaaaccagggagagttcctaaagctcctgatctatgctgcctccacgttacactcagggtcccatctcgttcagcgcagtgaatctgggacagagttcactctcactatcagcagcctgcagactagaacgtattgttcgactaactttaattacttacgttactaaaagtattaatacctgaccccttntcctacgtttcggacggtaacgggacccgaaaggttcggaacgtacgtacgaaaacgaagtggtacgg

SEQ ID NO: 271005 - DNA, 491 bp, Homo sapiens
  misc_feature: GYAE6OF01D8GSB.25.4.A04.1.454.CMB.1.raw
  modified_base (433)..(433): a, c, t, g, unknown or other
  misc_feature (433)..(433): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccagggagagttcctaagctcctgatctatgctgcctccacgttacactcagggtcccatctcggttcagcggcagtgaatcgtgggacagagttcactctcactatcagcagcctgcagcctagagatgttgactacttattactagtacaaagtataatactcgcccctntccgtacgtttcggcggtacgggaccgaagggtcggagatacgaaacgagtggtacgg

SEQ ID NO: 271006 - DNA, 951 bp, Homo sapiens
  misc_feature: GYAE6OF01BGO2K.25.4.A04.1.454.CMB.1.raw
  modified_base (220)..(220): a, c, t, g, unknown or other
  misc_feature (220)..(220): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatcctccctgtctgcatctgttggagacagaatcagcatctcttggccggngagtcagggcattagactaatttatttacgccttaggttaataccaaacgtaaggaaaacccgaagggggaacgtaacggtttaccctaaaacggtccttacccttaggtactttaccttaagttcggacccttcggtacccctttacccgtaaaccgggtttttaacccaaccggtttaccggtaaccggggggtttaccccctaacgttttcccggtttacccggggttttaccgtaaaccggggcccgggttaaccgtaaacggggtttaacgtaaaaccggtttccgggtttaacggggggaaacccgtaagggttaacccggttttacctaaacccgtttcccgttaaccttaaacctttaaccgttacgaaccggtaccggtaaccggtccccggttaggacccgtaaaccgggtaccccgttaagggaaacggttacgtttacggtttaacggtaaccctttaaaaccgtttttacgttttaaaccgttaaacgtttaaacgtaaaaaacggtttaacttaaaaccgtacccgttttacccggtaaccccctttaaccggttttaaccccggttaacccgggtttttaccgggggaaccccgggggttaaaacgggtaaacccccggggtttaaaacgggggtacggggttaaaaccgggtaaaccgttaaaaaccccgggttaaaaccggttaaaacccgggtttcgggggttaaaccccggg

SEQ ID NO: 271007 - DNA, 557 bp, Homo sapiens
  misc_feature: GYAE6OF01B5CYG.25.4.A04.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (289)..(289): a, c, t, g, unknown or other
  misc_feature (289)..(289): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttgccgggnagtcaggcattagntaattatttagcctaggtancaaacaagaaaccgagggagtagttaccaagctcctnatctatgctgcctcacgttacactcgacgggtcccatctcggtcagcggcagtgaatcgtagggacagtagttcactctacactatcagcagccagcaggcctagaagtagttgtcgaactactttaattacctagtaacaaaagtataaacgtactcctccccttataccgtaccgtttacggggaccgggttaaccggggaaacccgtaaaggggtacggtaaacgaacgttaaccggaaaacgttaaaccgtgggttaacccggg

SEQ ID NO: 271008 - DNA, 557 bp, Homo sapiens
  misc_feature: GYAE6OF01DDDNZ.25.4.A04.1.454.CMB.1.raw
  modified_base (221)..(221): a, c, t, g, unknown or other
  misc_feature (221)..(221): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggnagtcgagggcattagctaattatttagccttggtatacaacagaaaccgagggagtagttacctaagctcctgatctatcgctcgcctcctacgttacactcgacgggtcccagtctcggttcaggcgcagtgaatcgtgggacagtagttcactcgtacactatcacgcacgcctgacgacgtcctagaagtcgttagttcgaaccttaactttaacttaactaggttaaacctaaaagttattaactacctcgaccccttcgttaccgtaccgtttacgggacgggtacggtaaccgtaagggtagacgtaactacgaaacgtacgtggtacgg

SEQ ID NO: 271009 - DNA, 517 bp, Homo sapiens
  misc_feature: GYAE6OF01BOIF3.25.4.A04.1.454.CMB.1.raw
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtcctgcatctgttggagacagaatcagcatcacttggccgggcgagtcgagggcattagcaattatttagcctggtatcaacagaaaccagggagagttcctaagctcctgatctatgctgcctccacgttacactcgacgggtccatcgtcgttcagcgcagtgaatcgtgggacagtacgtcactctacacttancgaancgacgtccgtgcagcctagaagtatgttgacttaacttattactagtaacaaagttataagtctcgtccctactacgtacgttcggacggtaacggtaccgaaggtacgaacgactaacgaaacgtacgtggtacgg

SEQ ID NO: 271010 - DNA, 584 bp, Homo sapiens
  misc_feature: GYAE6OF01CPLPZ.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcagtcgagggcattagcaattatttagcctggtatacaacagaaaccgagggagagttcctaagctcctgatctatgctgcctccacgttacactcgacgggtcccagtctcggttcacggcggctagtgaatcgtgggacagtagttcactctactactactacagcagcctgaccgacgtaccctaggaacgtagttcggttacgaccgttaaactttaacgtttacttaagttaacctaaaaaggttacttaaacgttaccgttaccgttacccccttacgttaccgttaaccggtttccgggaacgggtacgggaacccgtaagggtacggtacgtaacgtacgaaacgtacgtggtacgg

SEQ ID NO: 271011 - DNA, 653 bp, Homo sapiens
  misc_feature: GYAE6OF01DK8XC.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgcttctctggctcccagataccagatgtgacgtccagatcgacccagtcctccatccctccctgtctgcatcgtgtggagacagaatcagcaatcacgttcggccgggacgtagtcgagggctagttagactaatttatttagccttaggtaactacaaacgaacggaaaccgtaggggacgtacgttacctaagtccttcctagtacttcctagtcgccttcgtccccttaccgtaaccggttaaccaccgttaccggtaccggggtaccctagttcccggttaccgggtttaccacgggccggtacgtaaggtacgtaaagttcggtacgggtactaaggttaccgttacctaccgtctactacttacgcaacgcacgtcctagcacgtcctagaagtagtcgttacgacttaacttacttacgtagtaaacctaaagttactaacgtcctccgtaccctcgttactaaccggttccgggaggtaacggtacgtaagggtgaagtacaacgtaaaccggtacgtggtgtaccgg

SEQ ID NO: 271012 - DNA, 807 bp, Homo sapiens
  misc_feature: GYAE6OF01AUYJN.25.4.A04.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttggccgggnagtcgagggcagttagactaattatttagccttggtactacgaacgtaagaaaccgtagggacgtaacgttaccgtaacgccttaccctaggaacttccttaagtcgtccttcgtcccttacccgtaacgtttaccaaccgttccggaaccggggttacccctacgttccgtttccgggttacctacggcccggtacgtaaggttcggtaaacgttacggttaggggaacctaggttacgttacctaaccgttcctaaccgtaacttaacgtcaacgggacctaacgtcccgttacggacctaaccggtccgttaacgaaacgggttacgtttacgggtttaccgtaaacctttaaacgttttaaccgtttaacggttaaacgttaaaacccgtaaaaggtttaacgttaaaaccctttacccgttaccccgttcccccgtttaaccgtttaaacccggtttacccgggttttaacccgggggacccggggttaaaaaccggggtaacccgttaaacgggggttacggtaaaccggtaaaccgttaaaccgtaaaacccgggttaaccgttacggggttaaccccgg

SEQ ID NO: 271013 - DNA, 582 bp, Homo sapiens
  misc_feature: GYAE6OF01CDFIM.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctcgcctccacgttacactcgacggggtcccatctcggttcaggcggcagtgaatcgtgggacagagttccactctcactatcagcgacgcctgccgacgtcctaaggaacgtagtttggttacgtaccttaaactttactttaaccgttagttaaactaaaagttattaaacttcctaccgtccccttacttacccgttaccgttttaccggggaccgggtaacggggtaacccgtaaaggggtacgggaacgtaacgtaaccgaaaccggtaacgttgggtaccggg

SEQ ID NO: 271014 - DNA, 519 bp, Homo sapiens
  misc_feature: GYAE6OF01D50YM.25.4.A04.1.454.CMB.1.raw
  modified_base (239)..(239): a, c, t, g, unknown or other
  misc_feature (239)..(239): n is a, c, g, or t
  modified_base (338)..(338): a, c, t, g, unknown or other
  misc_feature (338)..(338): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattntttagcctggtatcaacagaaaccagggagagttcctaagctcctgatctatgctgcctcacgttacactcagggtcccatctcggttcagcggcagtnaatctaggacagagttcactctcatatcaagcagctgctagcctgaatatgtgactaacttacttacgtattacaaaagttacttaatacttcgaccccttataccgtaccgttttacgggcgggtaacggtaaccgaagggtacggtaagtaacgtactaaacggaaagttcggtacggg

SEQ ID NO: 271015 - DNA, 650 bp, Homo sapiens
  misc_feature: GYAE6OF01DT0W6.25.4.A04.1.454.CMB.1.raw
  modified_base (196)..(196): a, c, t, g, unknown or other
  misc_feature (196)..(196): n is a, c, g, or t
  modified_base (381)..(381): a, c, t, g, unknown or other
  misc_feature (381)..(381): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccatcctccctgtctgcatctgttgganacagaatcagcatcacgttggccgggcgagtcgagggctattacgactaaatttagtttacgccgttaggtactacgaaacaaggaaaacccgaggggaacgtaacggtttacctaaagcctcctagactctatgctcgcctaccacgttacactcgacgggtcccatcgtcgtcagcgcaggtnaagtcgtagggacagtacgttcacgtctctaatactcgagccagtccctgacgacgtcctaggaagtcttgggttacaacttaaactttacgtttaacgtacgttaaacgtaaaaacgttacttaaacttaaccgttccgtaccccccttacttacccggttaaccggttttaccgggggaacccgggtaacggggaaacccggtaaagggttacggggtaaacgtaacgttaaacccgaaaaccgggtaaccgttgggttaacccggg

SEQ ID NO: 271016 - DNA, 638 bp, Homo sapiens
  misc_feature: GYAE6OF01EQ3OS.25.4.A04.1.454.CMB.1.raw
  modified_base (208)..(208): a, c, t, g, unknown or other
  misc_feature (208)..(208): n is a, c, g, or t
  modified_base (257)..(257): a, c, t, g, unknown or other
  misc_feature (257)..(257): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctnacctgcactgtctctggtgctccatcaccagtggttatcactactgganctggactccgcagcacccgagggaacggcctggagtggattgggacattctattaccgtgggatcaccttctacaacccgtcctcaatacgtcgagtcaccatctctattacgactacgtactaagaacctagtttctccctagtaaacgttcgaaaccttcgtagtcgtacgttcggcccgacggaccgaccgggtccgttacgtaacgtttaaccgtggtacggacgggtactaacgttaaccgtaacggtactaaccgttaagggtccggtacccgtaagtttacgtacccgtaaccgtaacgtttaccgaaaccggttagttacgggttacctttttacggtaaagtttacgttcccggttacggggggaaaccccg

SEQ ID NO: 271017 - DNA, 517 bp, Homo sapiens
  misc_feature: GYAE6OF01B6COP.25.4.A04.1.454.CMB.1.raw
  modified_base (220)..(220): a, c, t, g, unknown or other
  misc_feature (220)..(220): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggnagtcagggcattagctaattatttagcctggtatcaacagaaaccagggagagttcctaagctcctgatctatgctgactccacgttacactcgacggggtcccatctcggttcacgcggcagtgaatcgtagggacagtagttcactctacactatcagcacgcctgcacgcctagaagagttgttcgactaaactttattactagtaactaaagtataactactcgcccttctacctacgtttccggacgggtacggaccgtaagggtgtaagactacgaaagtacgtggtacgg

SEQ ID NO: 271018 - DNA, 632 bp, Homo sapiens
  misc_feature: GYAE6OF01C5QGA.25.4.A04.1.454.CMB.1.raw
  modified_base (223)..(223): a, c, t, g, unknown or other
  misc_feature (223)..(223): n is a, c, g, or t
tcagactgtacagtcacgaccggtgctcgatttagagtagtgatcagggggcagaagtctctctcagtcaggacatagcatggacatgagggtccctgctcagctcctgggactcctgctgctctggctcccagataccagatgtgacgtccagatgacccagtctccatcctccctgtctgcatctgtggagacagaatcagcatccacgttcggccggggngagtcgagggcattagactaattagtttagcctggtactacaaacgaacgaaaccgagggaagtacgttacctaagctctagtactctatcgctcgcctccacgttacacgtcgtacggggtcccacgtcgtcggttcgacggcggcgtagtcgtaacgtcgtaggtacgagtacgtactactctacactacgtacacgacacgtcctacgcgacgtccgtagaacgtagttcgtacgtaacttaacgtttaacttacgtaagttaactaaagttactaacgttactccgtaccccttacgtaccgttaccggtttaccggggtaaccggggtaacgggtaaccggtaaacggggttacggtaaacggtaaacgtaacccggtaaaacggtaacgttcgggtaaccggg

SEQ ID NO: 271019 - DNA, 565 bp, Homo sapiens
  misc_feature: GYAE6OF01CEY13.25.4.A04.1.454.CMB.1.raw
  modified_base (220)..(220): a, c, t, g, unknown or other
  misc_feature (220)..(220): n is a, c, g, or t
  modified_base (404)..(404): a, c, t, g, unknown or other
  misc_feature (404)..(404): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggnagtcagggcattagctaattatttagcctggtatacaacagaaaccagggagagttcctaagctcctgatctatgctgcctccacgttacacgtcgacgggtcccagtctcgttcagcggcagtgaatcgtgggacagtagttccacgtctacacttatcagcacgcctgcacgcctagaagtnttgtacgactaactttatacttaggtaaacctaaaagttacttaaactccgttacgtaccccttacttaccgtaccgtttacggggaccgggtaacgggaacccggtaaagggtacgggtaaacgtaacgttaaaccgaaaaccggtagttaggtaccggg

SEQ ID NO: 271020 - DNA, 555 bp, Homo sapiens
  misc_feature: GYAE6OF01AGQQT.25.4.A04.1.454.CMB.1.raw
  modified_base (222)..(222): a, c, t, g, unknown or other
  misc_feature (222)..(222): n is a, c, g, or t
  modified_base (422)..(422): a, c, t, g, unknown or other
  misc_feature (422)..(422): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctggttggagacagaatcagcatcacgttggccgggngagtcgagggcattagctaattattagcctggtatacaacagaaaccgagggagtagttccaagctctagatctatcgctcgtcctacctacgttaccacgtcgacggggttcccagttccgtcggttcaggcggctagtgtaatcgtagggacagtacgttcactctacactatacagcacgcctgctacgctagaatnttgtacgtactaacttattactagtaactaaagtactaactacctccgtcccctactaccgtaccggttacgggacgggtacgggaaccgaagggttacggaacgtaactaacggaaacgtacgtggtaccgg

SEQ ID NO: 271021 - DNA, 565 bp, Homo sapiens
  misc_feature: GYAE6OF01D56UL.25.4.A04.1.454.CMB.1.raw
  modified_base (382)..(382): a, c, t, g, unknown or other
  misc_feature (382)..(382): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccggggcgagtcgagggcaattagctaattatttagcctggtatacaacaagaaaccgagggagagttacctaagctcctgatctatgctcgcctccgtactacactcgacgggtcccatcgtcggttcagcgcagtgaatcgtaggacagtagttcactctcactancagcacgcctgcacgccgtagaagtagttggttagacctaactttattaacgttagttaactaaaagttattaaacgtacctccgtaccccttacgttacccgtaccggttttcggggacgggtacgggaacccgtaaggggtacggtaacgtaactaacgaaaaccggtaacgtggtacggg

SEQ ID NO: 271022 - DNA, 509 bp, Homo sapiens
  misc_feature: GYAE6OF01EWIJN.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagtggttatcactactggagctggatccgccagcacccagggaagggcctggagtggattgggtacatctattaccgtgggagcaccttctacaacccgtcctcaatagtcgagtcaccatctcattagacacgtactaagaacctagttcctccctgaagttgaactctgtgactgccgcgacacggccgtgtattactgtgcggcatactacgactactagtcggccgatactcacatcacgatcgtcttttgattactcgtgggaccg

SEQ ID NO: 271023 - DNA, 733 bp, Homo sapiens
  misc_feature: GYAE6OF01EH92I.25.4.A04.1.454.CMB.1.raw
tcagactgtacagtcacgaccggtgctcgatttagagtagtgatcagggggcagaagtctctctcagtcaggacacagcatggacatgagggtccctgctcagcctccgtgggacctcctgctgctctggcctcccagactaccagatgtgacgtccagatcgacccagtcctccatccctccctgtctgctatctgtgagacagaatcagctactctacgttcggccggggagaggtcgagggctaagttagacttaaatttagtttacgccgttaggtaactaccgaaacgaacgaaaccggaggggtaacgtacgtttacctaacggtccttaccgtagtaacttctagtcgtcctcgtccctaccgtacgttaccacgtcggacgggtccctagttccgtcggtcgacgcggtcagtagaacgtcgtacgggactaagtcttcactcacctactactacgagccacgtccgtacgcgtaaccgtccgtaaggtactacgttacggttactaacctttaaacgtttacgtttaacgtaacgtttaaacgttaaaacgttttcggaaacgttaacgggttaccggtaaccgggttacgggttaccgtttacccgggggttaacccgggtaccccgggtaaacggggtaaacccgtaacgggggttaaaccggaaacccgttaacgtaaaacccgggtaaaaccggttacccgggttagggttaacccgggg

SEQ ID NO: 271024 - DNA, 781 bp, Homo sapiens
  misc_feature: GYAE6OF01BRO4J.25.4.A04.1.454.CMB.1.raw
  modified_base (225)..(225): a, c, t, g, unknown or other
  misc_feature (225)..(225): n is a, c, g, or t
tcagactgtacagtcacgaccggtgctcgatttagagtagtgatcagggggcaggaagtctctctcagtcaggacacgagcatggacatgagggtccctgctcagctcctgggactcctgctgctctggctcccgagatacccagatgtgacgtccagatgacccagtctccatcctccctgtctgcatctgttggagtacagaatcagccatcacttgccgggngagtcgaggcattagctaattattacgcctggtactacaaccaagaaaccgaggtagtacgttaccgtaaagtcctaccgtagactactagtcgtctcgtccctaccgtaccgttaccgtaccgtaccgtaacggggtcccctaacgttccgttaccgggttaccgaacggtcccggtaccgtaacggttacggtaaacgttccggttacggggtaaccgtaacggttaccgtttacccgtaacccgtttcccgttaaccgttaaacccgttaacgttacccgtaaacgggtacccgttaaaccggtccccgtttacgggacccgtaacgggtaccccgtttaaggaaacggtttacgttacggtttacgtaaaccgtttaaaccgttttaacgtttaaccgtttaacggttaaaccgtaaaaaggtttacgttaaacgttacccgttaccggttaccccttaccgttaccgttaaccgggtttaccgggaaccgggtaacgggtaaccgtaaggttacggaacgtacgtaaccgaaacgtacgttcggtacccgg

SEQ ID NO: 271025 - DNA, 642 bp, Homo sapiens
  misc_feature: GYAE6OF01EK8TJ.25.4.A04.1.454.CMB.1.raw
  modified_base (326)..(326): a, c, t, g, unknown or other
  misc_feature (326)..(326): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacacgaccctgtccctcacctgcactgtctctggtggctccatcaccgtagtggttatcactactggagctggactccgcagccacccgagggaaggcctggagtggattgggacatctagttaccggtggacnctaccttctaccaacccgtcctacaactacgtcgacgtaccacctatcctactattacgactacgtactaacgaaccctagttcctaccctagtaacgttcgaaaccttcgtacgtacgtacctcggacccgccggaacgtaccgggtcccgttagttaactttaacggtcggttcggaccggtactaacgttaccgtaacggtaacttaaccgttaagggtccggtacccgtaattaaccgtcctaacccaattcccgaaacgtacgttcgtttaccgtttttgaacgtttacgttcgggtcggggtaaacccgg

SEQ ID NO: 271026 - DNA, 542 bp, Homo sapiens
  misc_feature: GYAE6OF01BCGON.25.4.A04.1.454.CMB.1.raw
  modified_base (368)..(368): a, c, t, g, unknown or other
  misc_feature (368)..(368): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatccctccctgtctgcatctggttggagacagaatcagcatcacgttggccgggcgagtcgagggcattagctaattattagcctggtatcaacagaaaccgagggagagttcctaagcctcctagatctatgtctcgtcctccacgttacactcgacgggtcccagtctcggtcagcggcagtgatcgagggacagtntcactctcactatcagcacgccagcacgctagacgtatgtactactaactttattaacgtactaactaaagtataacttacctcgtaccccctctacccgtacggtttcgggaccggggtaacggtaccggtaaagggtcggaacgtacgtaacaaaacggtcgttggtaccgg

SEQ ID NO: 271027 - DNA, 813 bp, Homo sapiens
  misc_feature: GYAE6OF01AX977.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggcgagtcgagggcattagctaattattagcctggtatacaacaagaaaccgaggggagtacgttacctaagtcctcctagtactctagtcgtacctcgcccttaccgtaccgttaccaccgttaccggaacgggggttcccctacgttccgttccgggtttaccgacggtccgggtacgtaacggttacggtaaacgttccggttacgggggtaacgtacggttaaccgggtttaccctaaccggtttacccttacccgttaaacccgtttaacgttacccggaaacgggtacccctaaccgggttccccgttacggtaacccggtaaccgggtaacccccgttaagggtaaacggttaggttttaccgggtttaacggtaaccctttaaaaccgtttttaacgttttaaaccgttacggtttaaaaccgtaaaaacggtttaactttaaaacccgttaccgttaacccgttaccccccgtttaaccgtttacccggttacccgggtttaccggggaccggggttaaacgggtaacccggtaagggtacggtaaacgtacgttaaaccggaaacggtacggttacggtaccggg

SEQ ID NO: 271028 - DNA, 508 bp, Homo sapiens
  misc_feature: GYAE6OF01EGKOV.25.4.A04.1.454.CMB.1.raw
  modified_base (409)..(409): a, c, t, g, unknown or other
  misc_feature (409)..(409): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
tcagactgtacagtcacgaccggtgctcgatttagagtagtgatcagggggcagaagtctctctcagtcaggacacagcatggacatgagggtccctgctcagcctcctgggactcctgctgctctggctcccagataccagatgtgacgtccagatcgacccagtctccatcctccctgtctgcatctggttgagacagaatcagcatcacgttggccgggcagtcgagggcatttagacaattatttagcctaggtatcaacaagaaaccagggagagttacgtaagctcctgatctatgctgcctcacgttacactcaggggtcccatctacggttcacggcgcagtgaaatgtggacagagttcactctcactatcagcagcctgcagcctagaacgtatggttnactaacttattacttataactaaaagtataaactactccgtccctactccacgtttaggcggtaggaccgaaggtagganaanagaaacgagtgtacgg

SEQ ID NO: 271029 - DNA, 551 bp, Homo sapiens
  misc_feature: GYAE6OF01EEPU1.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccaggagagttcctaaagctcctgatctatgctgcctccacgttacactcaggggtcccatctcggttcagcggcagtgaatctagggacagtagttcaactctacactagtacagcagcctgcacgcctagaacgtatgttcgactaaacttaattacttagtaactaaaagtaattaacttactacgtccccttacttaccgtaccgttttcggggacgggtaacggggaaccgtaaaggggtagggtaacggaaactaaccgaaaacggtaaacgtggttaaccggg

SEQ ID NO: 271030 - DNA, 617 bp, Homo sapiens
  misc_feature: GYAE6OF01BVS3V.25.4.A04.1.454.CMB.1.raw
tcagactgtacagtcacgaccggtgctcgatttagagtagtgatcagggaccggcctggctgtaccaagcctccccagccgtgagagttcccaggagtctccacttggtgatcagcactgaacacagaccaccaaccatggagtttgggcttaactgtcttttcctgttgcttgttttaaaaggtgtccaatgtgaggtgcaactggtggagtcgtggggggagtcttggtacagccaggcccggtccctgacactctcctgcacagcttccggactcacctttggtgagcatgctatcgaccgtgggtccgccgaggcctccggagggaaggtctgggagtggcgtttgggtcagttagaacgcgaagtcctagtgggtgggacaaacgacgaacgtaccgccgcgtacgtaggtaaaacggcaagtacttcgacgtcctcgtacgaaggagatagaacttaccgaaaagcctaatccgaccttagtccgtacgtacaacgtagtgacgacgacgtaccgtaggaacgtaaggcgtacggacctcggaacggtcccgttagttacttaccgttgtttactttaacgttaccttagtaggtaggtaggtttaacggg

SEQ ID NO: 271031 - DNA, 542 bp, Homo sapiens
  misc_feature: GYAE6OF01DP4CB.25.4.A04.1.454.CMB.1.raw
  modified_base (300)..(300): a, c, t, g, unknown or other
  misc_feature (300)..(300): n is a, c, g, or t
  modified_base (411)..(411): a, c, t, g, unknown or other
  misc_feature (411)..(411): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagactaattatttagcctggtatacaacagaaaccagggagagttcctaagctcctgatctatgctcncctccacgttacactcgacgggtcccagtctcggttcagcggcagtgaatcgtagggacagtagttcactctactactatacagcacgcctgcacgcctggaagtatgttnactaactttattactagtaactaaaagttacttaaatacctcgtacccctcgtacctaccggtttccgggacgggtaacgggaacccgtaaggggtacggaagtaactaccgaaaacgtacgttggtacgg

SEQ ID NO: 271032 - DNA, 501 bp, Homo sapiens
  misc_feature: GYAE6OF01BM5ID.25.4.A04.1.454.CMB.1.raw
  modified_base (192)..(192): a, c, t, g, unknown or other
  misc_feature (192)..(192): n is a, c, g, or t
  modified_base (435)..(435): a, c, t, g, unknown or other
  misc_feature (435)..(435): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttganacagaatcagcatcattgccgggcagtcagggcattagcaattatttagcctggtatcaacagaaaccagggagagttacctaagctcctgatctatgctgcctcacgttacactcgagggtcccatctcggttcagcggcagtgaatcgtgggacagagttacactctacgatatccaagcacgcctgcagcctgaacgtatgttgactaagttatactgtaactaaagtataaatcgtacnccctacgtactacgtttcgggcggaacggaccgaagggtgaacgacttacgaaacgacgtggtacg

SEQ ID NO: 271033 - DNA, 641 bp, Homo sapiens
  misc_feature: GYAE6OF01CX85Y.25.4.A04.1.454.CMB.1.raw
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
  modified_base (304)..(304): a, c, t, g, unknown or other
  misc_feature (304)..(304): n is a, c, g, or t
tcagactgtacagtcacgaccggtgctcgatttagagtagtgatcagggggcagaagtctctctcagtcaggacacagcatggacatgagggtccctgctcagctccgtgggactcctgctgctctggcctcccagataccagatgtgacgtccagatcgacccagtcctccatccctcctgtctgctatctgtaggagacagaatcagcatcacgttggccgggnagtcgagggtcattagactaattatttacgccttggtanacaaacagaaaccgaggagagttccaagctacctgactntatcgctcgcctacctacgttacacgtcgacgggtcccagttccgtacggttacacggtcgacgtagtacgtaagtcgtagggacctaggtacttctaccttctactactacgtccaaggtccacggtcctaggacccacgtacctaggtaacgtagtttacgtacgtaaccttaaagtttaactttaacgtaacgtaattaaaactacttaaacttccgttacccgtaccccttagttaaccgttccggggttaccggaacgggtacggtaaacccgggtaaggtaaccggggtaactaacggttaaacccaaacgggtaagtacgggttacccgg

SEQ ID NO: 271034 - DNA, 541 bp, Homo sapiens
  misc_feature: GYAE6OF01DN1FV.25.4.A04.1.454.CMB.1.raw
  modified_base (393)..(393): a, c, t, g, unknown or other
  misc_feature (393)..(393): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttgccgggcagtcagggcattagcaattatttagcctggtatcaacagaaaccagggagagttcctaagctcctgatctatgctgcctcacgttacactcgaggggtcccatctcggttcagcgcagtgaatcgtgggacagtacgttcaactctacactatcagcagcctgcagcctaganattgtagctaactttattactagtaactaaaagttataaactaccgtcgtcccccttacgtcctaaccggtttccgggacgggtaaacggggaacccgtaaggggtagggtaacgtaagtaccgaaaacggtacgttgggtaaccggg

SEQ ID NO: 271035 - DNA, 516 bp, Homo sapiens
  misc_feature: GYAE6OF01EDK91.25.4.A04.1.454.CMB.1.raw
  modified_base (194)..(194): a, c, t, g, unknown or other
  misc_feature (194)..(194): n is a, c, g, or t
  modified_base (377)..(377): a, c, t, g, unknown or other
  misc_feature (377)..(377): n is a, c, g, or t
  modified_base (433)..(433): a, c, t, g, unknown or other
  misc_feature (433)..(433): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggcagtcagggcattagcaattatttagcctggtatcaacagaaaccagggagagttccaagctcctgatctatgctgcctccacgttacacgtcgacgggtcccatcgtcgttcaggcggcagtgaactcgtagggactagtacgttcactctacactancagccagcctgcacgcctagaatagtgttagacttaactttattaacctgttaaanaaagttataactctacgtcccctatccgtacggttcggacggtacggaaccgaaggtcgaagactaacgaacgtagtggtacg

SEQ ID NO: 271036 - DNA, 775 bp, Homo sapiens
  misc_feature: GYAE6OF01CDNG6.25.4.A04.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
tcagactgtacagtcacgaccggtgctcgatttagagtagtgatcagggggggcagaagtctctctcagtcaggacacagcatggacagtcgagggtccctgctcaggctcctgggactcctgctgctcgtggcctccagataccagatgtgacgtcagatcgaccagtcctccatcctcctgtctgcagtctgttgganacagaatcagtcacgtcacgttcggccgggngtagtacgagggactaatttaaggcttaaatttacgtttaagaccgttaaggtaacgtaacgaaaccgtaaggtaaaacccgtacgggggtagtaaccgtttacctaaaggttccgttacccgtaggtacttacgtttagtcggtacttaccggtcccgtaccctaacggtttacctaccggttaccgacgggggttcccctaagttcggttacggttacgaacggtcggacgtaagttacggtaacttacggtacgggacctacggtacgttaccaaccgttcttctaaacgttctacggaacgtcgaacgtctacgacctacgttccgtagtaacgttacttacggtacgtaacgttaacgtttactttaaccgtacgttaaaccgttaaaacgttaccgtaaacgtttacccgtacccggtacccgtttaccggtaacgtttaacccggggtttaccgggaaccgggggttaaccgaaccggggttaaaggttacggaacggttaaactaacccggtaaaacgtccggtttgggtacccgg

SEQ ID NO: 271037 - DNA, 753 bp, Homo sapiens
  misc_feature: GYAE6OF01AZB2A.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggcctcccagactaccagatgtgaccgtccagatcgacccagtcctccattccctccctgtctgcatctgtgagacagaactcagcatctacgttcggccgggcgtagtcgagggactaattaggactaatttacgtttacgccgttaggtaactaccgaaacaacggaaaacccggtgggggtaacgtaacgtttaccgaaacgtcccgttaccgttaggtacttacgttagtcgtcgtcccggtaccctaccgtaacgttaccacccgtacggtaccgggttaccctagttccgtaccggttacgaccggtaccggactaggtacgtaacggttcgggtaacggtaaccggtaggttacctttaccgaaccgttaccgtactaaacgtttcgaaccgtacgtacccgtaccgtaccggtaacctccggtaaccgacccggtttaagaaacggttcccgtttaagttaccgtaacgttttaaaccgtttacgttaaacgttccgttaaaaagttaaccgttaacttaaccgttccgtacccggttcccttaaaccgttcgttaaccgggtagggaccgggtaacgtaaccggtagtacgtaacgactaacggaacttcggtgtaccg

SEQ ID NO: 271038 - DNA, 477 bp, Homo sapiens
  misc_feature: GYAE6OF01AKJT6.25.4.A04.1.454.CMB.1.raw
  modified_base (432)..(432): a, c, t, g, unknown or other
  misc_feature (432)..(432): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaatatttagcctggtatcaacagaaaccagggagagttcctaagctcctgatctatgctgcctccacgttacactcaggggtcccatctcggttcagcggcagtgaatctgggacagagttcactctcactatcagcagcctgcagcctgaagatgttgcaacttattactgtcaaaagtataaatactgccccctntcactttcggcggagggaccaaggtggagatcaaacgactgtcgg

SEQ ID NO: 271039 - DNA, 524 bp, Homo sapiens
  misc_feature: GYAE6OF01CV4C4.25.4.A04.1.454.CMB.1.raw
  modified_base (272)..(272): a, c, t, g, unknown or other
  misc_feature (272)..(272): n is a, c, g, or t
  modified_base (467)..(467): a, c, t, g, unknown or other
  misc_feature (467)..(467): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagctaattatttagcctggtatacaacagaaaccaggganagttccaagctcctgatctatgctgcctccacgttaccacgtcgacggggtcccagttcgtcggttcaggtcggctagtagaagtcgtagggacaggtacgttcacgtctcactatcagcagcctgcagcctagaagtatgttagactaacgtttattactagtaactaaaagttataacttactcgaccccttntaccgtacgttcgggacgggaaggaccgaaggtgagaactacaaacgcgtggtacgg

SEQ ID NO: 271040 - DNA, 659 bp, Homo sapiens
  misc_feature: GYAE6OF01BYRTW.25.4.A04.1.454.CMB.1.raw
  modified_base (256)..(256): a, c, t, g, unknown or other
  misc_feature (256)..(256): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtgttatcactactgganctggatcccgccagccaccccgaggggaacgggcctggagtggattgggtacatctaattaccggtgggacgcctaccttctaaccaaccccgtccctacaatacgtcgagtcaccatctcaattagactacgtactaaagaacctagtttcctaccccgtagaaacgtttcgaaacctttcgtaggtaccgacgttccggcccggtaccggaaccgtcccgggtaccggttagttaacgtttcggtacggtacggaccggtacttaaccttaaccgttaccggtaacttaaccggttagggtaccgggtaccgtaaacttaccgtacccgaacctacgtaacccgacgttagttcggtttactttaaggagtttaccgtccggggtaacgggtaaacccggg

SEQ ID NO: 271041 - DNA, 596 bp, Homo sapiens
  misc_feature: GYAE6OF01D1FF5.25.4.A04.1.454.CMB.1.raw
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
  modified_base (366)..(366): a, c, t, g, unknown or other
  misc_feature (366)..(366): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctcatcacagtgttancactactgganctggatccgccagccacccgaggggaaggcctgggagtggagttgggacntctattaccgngggancaccttcaaccaacccgtcctanaaactgtcgagtcaaccatcctnaattagaacctacgtacaacgaacctagtttcctcctagtaacgttcgaacttcgtagtacgacgttcggcccgtacggaccgtaccgggtccgttagttaacttcgtggtcggaccggtactaacgttacctaagtattaaccgtaggtacggacccgtaattacgtccaaccgtatccgaacgtattcgttactttttaggaatttacgttcggtggggtaaacccgg

SEQ ID NO: 271042 - DNA, 547 bp, Homo sapiens
  misc_feature: GYAE6OF01E46LF.25.4.A04.1.454.CMB.1.raw
  modified_base (193)..(193): a, c, t, g, unknown or other
  misc_feature (193)..(193): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttgganacagaatcagcatcacttgccgggcagtcagggcattagctaatttatttagcctggtatcaacagaaaccgagggagagttcctaagctcctgatctatgctcgcctcctacgttacacgtcgacggggtcccatcgtcggttcagcggacagtgaatcgtgggacagtagttcactctcactatcacgcagcctcgcgacgtcctagaacgtattgttcgacttaactttattaacgtagttaactaaaagttactaaacgttacctcgtccccttacttccgtaccgtttccgggacgggtacgggaaccgtaagggtagtaacgactaaccgaaacgttacgtggtacgg

SEQ ID NO: 271043 - DNA, 764 bp, Homo sapiens
  misc_feature: GYAE6OF01ETH5S.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctccagataccagatgtgacgtccagatcgacccagtcctccatcctcctgtctgctatctggttgagacagaatcagcatcacgttcggccgggacgagtcgagggctaattagactaaatttatttacgccgttaggtaactacgaaaacaacggaaaccgaaggggtaacgtaacggtttacctaaacggtccttaccgtagtaactacgttaacgtcgtaccttccgtaccctacccgtaaccgttaaccaccgttccggtaaccggggttacccttaacgttccggttaccggtttaccggacggccgggtaacgtacggttaacgtaacggttacggtacgggaacgtaacggttacggtttaccaaccttactactaacttacgtacgagtaccctacggtcccgtcgtaccgtaccgacttaggaaacgtgttacgttactaaccgttaactttagttaaccttaacggtttaaacaaaacgtttaacttaaaccgttaccgttacccgttaacccccttggttacccgttaccgggttttacgggaacccggggtaacggtaacccgggtaaagggtaacgggttaaacgaccgttaaaccggaaaacggttcggtacgggtaccggg

SEQ ID NO: 271044 - DNA, 706 bp, Homo sapiens
  misc_feature: GYAE6OF01CO9QF.25.4.A04.1.454.CMB.1.raw
  modified_base (256)..(256): a, c, t, g, unknown or other
  misc_feature (256)..(256): n is a, c, g, or t
  modified_base (341)..(341): a, c, t, g, unknown or other
  misc_feature (341)..(341): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacacgaccctgtccctcacctgcactgtctctggtgctcatcactagtgttatcactactgganctggactccgccagccacccgaaggggaacgggcctagggagtggtagttcgggtaactattcgttaagtttaccggtggggacncctacccttactaaccgaaccccgttccctacaaatacggtcgacgtaccacctatcctactaagttacgactacgtactaaacgacctagtttccctaccctaggtaaacgttgaaccttcgttcgtacgaccgttcggacccgggaccggtaaccgaccgggtccgttaacggtttaacgtttaccgtgggttacggacccggtactaaacgtttaacccgttaacggtacttaaaccggttaggtaccgggtaaccctaagttaaaccgttcccaaaccgttaacgttacccgtaacgttaacgtttcgttaaccgtttttagaagttttaaccgttccggggttaacgggggaaacccggg

SEQ ID NO: 271045 - DNA, 817 bp, Homo sapiens
  misc_feature: GYAE6OF01DFZKX.25.4.A04.1.454.CMB.1.raw
tcagactgtacagtcacgaccggtgctcgatttagagtagtgatcaggggagctctgggagaggagccccagccgtgagattcccaggagtctccacttggtgatcagcactgaacacagaccacaaccatggagtttgggcttaactgttcttttccttgttgcttgttttaaaaggtgtacaatgtgaggtgcaacgtggtggagtcggtgggggagtcgttggtacagccgagggcccggtcctgaccactctcctgcacacgtccgttccggactccgtaccgtttgggtgacgctagtcgacttagtcggaccgttcgggtcccgccgtacggtccgtccggaaggggtaacgggtcgtgggaggttcggtcgtttgggttactaagttaggaacggacgaacgtccgtaaggtgggtacgggactaaacgacgaacgtaccgccgtacgtacgtaacggtaaaacggctaaggtacttccgacgtcccgttactaacgaaaggtaacgtaagtacggtaacttaaacccgaaaaggtccctaacgttacccgtaccttaacgttccgtaccgaaccgtaaccgtaacgttacggaaccggaccgtaaccggtacccgggttaagggaaacgggtaaacccgggtacggggaaacccggttaaccgttaacccgggtaacgggttaccccggttttaggtttaaaccgttttttaccggtttaccggttttttaaacctttttaacggtttaacccgtttaccggttaaggggttaaacgtttaaggggtttaaacgggttttttaaaccgg

SEQ ID NO: 271046 - DNA, 513 bp, Homo sapiens
  misc_feature: GYAE6OF01BJY71.25.4.A04.1.454.CMB.1.raw
  modified_base (209)..(209): a, c, t, g, unknown or other
  misc_feature (209)..(209): n is a, c, g, or t
  modified_base (259)..(259): a, c, t, g, unknown or other
  misc_feature (259)..(259): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtcccctnacctgcactgtctctggtggctccatcaccagtggttatcactactgganctggatccgccagcacccagggaagggcctggagtggattggggtacatctattaccgtgggagcaccttctacaacccgtccctcaatagtcgagtcaaccatctcattagacacgtctaagaaccagttctcccctgaagttgaactctgtgactgccgcggacacggccgtgtattaactgtgcggcatactacgataacctagtcggcgatatcaaccatcacgatgtcttttgattatcgtggggaccg

SEQ ID NO: 271047 - DNA, 632 bp, Homo sapiens
  misc_feature: GYAE6OF01BHR74.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctcatcacagtggtatcactactggagctggatccgcagcaccccgaggggaaggcctgggagtggagttgggacatcgtagttaccggtgggatctaccttctaccaacccgtcctacaatcgtcgaagtccaaccatctacattagactacgtactaagaaccctagttcctaccgtagtaacgtttacgaacttactcggtagacgttacggacccggtacggaccgaacgggttcccggttagttaacgttccgttaggtcggtaccggaccgtaattaccgtaacgtacttaaaccggtacgtagggacccgtaattaccgtcctaaccctataccgaaccggttattaccggtttactttttaggaatttacgttccggggttcggggaaaccccggg

SEQ ID NO: 271048 - DNA, 673 bp, Homo sapiens
  misc_feature: GYAE6OF01AU2HC.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctcgtggtcgcctccatccacctagtggtactcactacgtggagctggactccgacacggccaacccgagggggaacgggccgtgggacgttgggtacgttcggggtaaccagttaccgttacgtttaacccgggtggggaacgtcccttaacccgtttcctaaaccgaaacccccggtttccctacgtaaacgttacggttaccggaacgttaccaacctacgttcctactaacgtttacgaacctaacgttactaacgtaacctacgtttacctccctaggtaacgttacgaaccttctagtacgtactcgccggtacggaccgacgggtcctagtaacgttcgtggtcggcgtataacgtactacgactacgtggtacgacgtaatactaccacctaagtcccgaacgtacgttcgtacgttttagaacttacgtgggtacggggaaccgg

SEQ ID NO: 271049 - DNA, 720 bp, Homo sapiens
  misc_feature: GYAE6OF01CUI5E.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtcagatgacccagtcctccactccctccctgtctgcatctgttggagacagaatcagcatctacgttcggccgggcgagtcgagggcaattagactaaatttatttacgccgtaggtatacaaacgaacggaaaaccgaggggaacgtacgtttacctaaacggtccttcccgtagtaacttcttaacgttcgtccgttcggtacccccttacccgtaaccggtttaaccaaccggttacccgggaaccgggggtttacccctaacgtttcccgtttaccgggtttaccgacgggtccgggactaaggtacgtaacgttcggtacggggactacggtacgttaccacgttaccttacgaacttactacgaacgccgacgcccttaggacctacggtccgtaaggaacgttagttcgtttacgaacttaaacgttttaacgttacgttaacgttaaactaaaagttctaaacttaccctccgtaccccttacgtaccgtttaccggttaccgggacgggtaaacgggtaccgtaagggtacgaacgtaacgtacgtaaaacgtgtggtacgg

SEQ ID NO: 271050 - DNA, 515 bp, Homo sapiens
  misc_feature: GYAE6OF01ANU3A.25.4.A04.1.454.CMB.1.raw
  modified_base (394)..(394): a, c, t, g, unknown or other
  misc_feature (394)..(394): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttccaagctcctgatctatgctcgcctccacgttacactcgacgggtcccatctcggttcagcgcagtgaatcgtagggactagagttcacttctctactatcagcagcctgcagcctgaangtgtgactaacttattactagtaactaaagtataactctcgtaccccttgtccgtacgttccgggacggtacgggtacccgaagggttacggaacgtactaacgaaaccgtagtggtacgg

SEQ ID NO: 271051 - DNA, 600 bp, Homo sapiens
  misc_feature: GYAE6OF01BAABR.25.4.A04.1.454.CMB.1.raw
  modified_base (245)..(245): a, c, t, g, unknown or other
  misc_feature (245)..(245): n is a, c, g, or t
  modified_base (320)..(320): a, c, t, g, unknown or other
  misc_feature (320)..(320): n is a, c, g, or t
  modified_base (499)..(499): a, c, t, g, unknown or other
  misc_feature (499)..(499): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtcgctccatcacagtgttancactacgtggagctggactccgcagccaccgagggacggcctggagtggattggtacatctagtaccgtgggacnctaccttctaaccaacccgtcctactaaagtcgtacgtacgtaccaacctactctacctaagtttaacgacctaacggttactaaacgaaccgtacgtttcctaccccgttaggtaaacgtttgtaaaccttcgtagtcgaacgtcggccgtacggacgccggtcgtagtacgttacgngtcggacggtactagtaacgtacgattacgtggtcggacctatacgccaacctagtccacggtattcgttactttagattacgtcgggtacggggaacccg

SEQ ID NO: 271052 - DNA, 614 bp, Homo sapiens
  misc_feature: GYAE6OF01DLWFT.25.4.A04.1.454.CMB.1.raw
  modified_base (330)..(330): a, c, t, g, unknown or other
  misc_feature (330)..(330): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcacagtgttatcactactggagctggactccgccagccacccgaggggaacgggccgtggagtggagttgggtactagtctagttaccggtgggacnctaccttactacctaaccccgttcctactaaacgtacgtcgtaacgtccaacctactctctaattacgacctacgttactaaacgtaaccctagtttccctaccgtagtaacgtttcgaaccttcgtgtcgactcggcccgcggaccgtaccggtccgttagttaacttacgtgtacggccggtactacttaccgtaagtacttaccgtaggtcggaccgtatacgtccaacctatccgacgtattcgttacttttacgatttacgtcggtcggggtaacccgg

SEQ ID NO: 271053 - DNA, 624 bp, Homo sapiens
  misc_feature: GYAE6OF01DDPM3.25.4.A04.1.454.CMB.1.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (369)..(369): a, c, t, g, unknown or other
  misc_feature (369)..(369): n is a, c, g, or t
  modified_base (419)..(419): a, c, t, g, unknown or other
  misc_feature (419)..(419): n is a, c, g, or t
tcagactgtacagtcacgaccggtgctcgatttagagtagtgatcagggggcagaagtctctctcagtcaggacacagcatggacatgagggtccctgctcagctccgtgggactcctgctgctctggctcccagataccagatgtgacgtccagatgacccagtcctccatcctccctgtctgcatctgtgagacagaatcagcatcacgttggcccgggnaggtcgagggnaattagactaattatttagcctggtatacaacagaaaaccgaggaagtagttacctaagctacctatatactatgcctcgcctacctaacgttacacgttcgtacggggtccctagtccgtcggttacgaggccgnaaggtgaagttcgagggacagtaacgttcaactctacaacttacacgacncaacggtcctagaccgacgtaccgtaagggtaatacgttcgtttacgaaccttaaccgtttaactaacgtttaccggtaaaactaaaagttaactttaaacgaacctttaccgccccttaacttccgtaaccgttttacgggacccggtaagggaacccgtaaggttacggaacgaaactaaccgaaagtaaccggtgtaccggg

SEQ ID NO: 271054 - DNA, 810 bp, Homo sapiens
  misc_feature: GYAE6OF01AR1AE.25.4.A04.1.454.CMB.1.raw
  modified_base (262)..(262): a, c, t, g, unknown or other
  misc_feature (262)..(262): n is a, c, g, or t
tcagactgtacagtcacgaccggtgctcgatttagagtagtgatcaggtctgtgaaggcgttcaccagtcctggacctcctgtgcaagaacatgaaacacctgtggttctccctcctgctggtggcagctcccagatgggtcctgtcccaggtgcagctgcgaggagtcgggcccaggactggtgaagccttcacagaccctgtccctcacctgcactgtctctggcgctaccatcaccagtcgttatccgactactggacncgtggactccgccagccaccccgaggggaacgggcctagggacgtggacgttagggacagttcttaagttacccggtggggaactccgtaaccttccgtaaccgaaccccgtcccgttaactaacgtacgtccggtaacgtaccaaccctacgttacccttacgaatttaaccggactaacccgggtttacctaaacgggtaacccctaaggttttccccgtacccctttaagggaaacgttttacggtaaacccttccgtttacgtaacggtacccgtttacggggacccccgtccggggtaaacccttaacccggggtccggttttaaccggtttaaacttttccggttagggttcccgaccgggggttacctaaaccgtttaccgttaaaaccgtacggtttaacccttacggggtacgggttaccccgtaaaagtttaccgttaaccccgaaccgtaacgtttcccggaaaccctttaaaggtacccgttttcgtttttaaccggaaattcccgtttcccggggttaaaacgggggaaccccgg

SEQ ID NO: 271055 - DNA, 573 bp, Homo sapiens
  misc_feature: GYAE6OF01BADMU.25.4.A04.1.454.CMB.1.raw
  modified_base (219)..(219): a, c, t, g, unknown or other
  misc_feature (219)..(219): n is a, c, g, or t
  modified_base (334)..(334): a, c, t, g, unknown or other
  misc_feature (334)..(334): n is a, c, g, or t
tcagactgtacagtcacgaccggtgctcgatttagagtagtgatcagggggcagaagtctctctcagtcaggacacagcatggacatgagggtccctgctcagctcctgggacgtcctgctgctctcggctcccagataccagatgtgacgtccagatgacccagtctccatcctcctgtctgcatctgttggagacagaatcagcatcattgccgggnagtcagggcatagcaattattagctggtatacaacagaaaccgagggagagttactaagcctctagatctatgctcgcctcacgttacactcgacgggtccatctcgtcagcgcngtgaatcgaggacaggtagtcacgtctacactactcagtcgacgcctgacacgccttaggaacgtattggttaccgtacttaacttttaattaaccgttacgtaaacttaaaacggttattaaacttaccgttccgtacccctttaccttacccgttaccggttcccggggacgggtaaaccgggacccgtaaaggggtcggtaaacgtacgttaaaccgaaacgtagttgggtaccgg

SEQ ID NO: 271056 - DNA, 754 bp, Homo sapiens
  misc_feature: GYAE6OF01CS2X2.25.4.A04.1.454.CMB.1.raw
  modified_base (229)..(229): a, c, t, g, unknown or other
  misc_feature (229)..(229): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagactaccagatgtgacgtccagatcgacccagtcctccactccctccctgtcctgctatctgttggagacagaatcagcatcacttcggaccgggngagtcgagggctaagttagactaatttatttagccgttaggtaacttaccaaacgaaacggaaaacccgaaggggaactaacggtttaccgtaaacggtccttacccgtaggtaactaccgtaagttcgtcttcgaccgtacctaacgttactaccgtcgaacgggttcccagttccgtcggttacgagtaccggcgtagtacgtaattcgtagggacgtaacgtacttccgtaacttcctaactacgttaactacgacgccacgtccgtacgaccgaggtacccgtaagtacggtaactttcggttaaccgtaaccgtttaaacgttttaacttaacgttacggttaaaacgttaaaacgtaccgttaaattaacccgttacccgtccccgtttaccgttaacccgtttaaccgggtttacccggggaacgggggttaaaccggtaacccgggtaaacggggtttaacggaaaccggttaaacctaaccgggttaaaaacggcccggtttaaggttaacccggg

SEQ ID NO: 271057 - DNA, 600 bp, Homo sapiens
  misc_feature: GYAE6OF01DFG4W.25.4.A04.1.454.CMB.1.raw
  modified_base (220)..(220): a, c, t, g, unknown or other
  misc_feature (220)..(220): n is a, c, g, or t
  modified_base (308)..(308): a, c, t, g, unknown or other
  misc_feature (308)..(308): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgtgcccgggnagtcgagggcattagctaattatttagcctaggtatacaacgaagaaaccaggggatacggttacctaagctccagtatctatgctcncctcacgttacactcgacgggtcccatcgtcggttcaggcgcagtagagtcgtaggacagtacgttcacttcctactactactacagcacgtccgtcggactacgcctaggaagtagttacggttacaaccttaacgtttaacgttaacgttaagttaactaaaaagttactaaacttaccgtacctcccccttagtacccgttaccggtttaccggggacgggtaaccgggtaaccgtaagggttaaccggagtaaacgtaaccggaaaccggtaaaggtggtaacccggg

SEQ ID NO: 271058 - DNA, 607 bp, Homo sapiens
  misc_feature: GYAE6OF01AVKX0.25.4.A04.1.454.CMB.1.raw
  modified_base (282)..(282): a, c, t, g, unknown or other
  misc_feature (282)..(282): n is a, c, g, or t
  modified_base (372)..(372): a, c, t, g, unknown or other
  misc_feature (372)..(372): n is a, c, g, or t
  modified_base (429)..(429): a, c, t, g, unknown or other
  misc_feature (429)..(429): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaacgtggtggagtcgtgggggagcttggtacagccaggccggtcctgacactctcctgcacagtccttccggactctaccgtttggngagcatgctatcgaccgtcgggcccgcacggctaccgaggggacggtcgtgggagtggcgttgggtcagttagaagcgaagctagtgggnggacacacaagtcgcgcgtcgtagtaaaggcagtacttacacgtcctctacgaaagngtaatacgaacttaccgaaagcactcgaccttatctacgacacagtacgacgaccgtacgtccgtaaggaagtaacggacgggaacggtacctacggacggttccgttagtttaaccgtttcgttaccgttttactttaacgttacttacgtaggtaacgttaggtttaggtttaacg

SEQ ID NO: 271059 - DNA, 570 bp, Homo sapiens
  misc_feature: GYAE6OF01C2C7A.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacacgaccctgtcccctcacctgccactgtctctggtcgctcatcaccagtgttatcactacgtggagctggactccgccagccaccgaggggacggccgtgggaggtggtagttgggtactagtcttagttaccggtgggactcctaccttcaccaacccgtcctacaatacgtacgagtccacctattctctaattacgactacgtactaacgaacctacgttcctcctagtacgttagtaactctagtacgactcgccgacggacgccggtaccgtgttactacgtggtcgcgactactactacgtatacgtagtcggacctatactccactatccacgtattcgttctttagattagtcggtcggggtaaccgg

SEQ ID NO: 271060 - DNA, 733 bp, Homo sapiens
  misc_feature: GYAE6OF01C72XC.25.4.A04.1.454.CMB.1.raw
  modified_base (220)..(220): a, c, t, g, unknown or other
  misc_feature (220)..(220): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatcctcctgtctgcatctgtggagacagaatcagcatcacgttggccgggngagtcgagggctaattagactaatttattacggccgttaggtactaccgaaacgaaacggtaaaaacccggagggggtaactaacgtttaccgtaaacggtcccttaccgtagtaacttacttagtcggtcctccggtaccccttaccgtaaccgtttaccgaaccgttaccggaaccggggttcccctaacgtttccgttaccgggtttcaacgggaccggtacgtaagggttacgaacgttcggtacgggaactagtacgttaccaccgttactactaacgtactacgacgaccgacgtccgtagacccgtagtaccgtaagtaacgtacgtttacggttaacgtaaccgttaactttaaccgtttaacgtacgttaaacgttaaaaacttacttaaacgttaccttccgtaccccttacttacccgttaacgggttccgggaacgggtaacgggaccggtaaacgggtacgtaaacgtaactaaaccggaacgttaacggtggtacccgg

SEQ ID NO: 271061 - DNA, 603 bp, Homo sapiens
  misc_feature: GYAE6OF01AE3CO.25.4.A04.1.454.CMB.1.raw
  modified_base (248)..(248): a, c, t, g, unknown or other
  misc_feature (248)..(248): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (491)..(491): a, c, t, g, unknown or other
  misc_feature (491)..(491): n is a, c, g, or t
  modified_base (548)..(548): a, c, t, g, unknown or other
  misc_feature (548)..(548): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctcgtggtgctccatccacagttggttancactacgtggagctggactccgcagcaccgaggggaggcctggagtggattgggacatctagttcggnggacncctaaccttcgtaaccaaccccgtcctactaagtcggtacgaacgttccaaccgtaatcctactaagttacgacctacgttactaaacgacctagtttcctaccgtagtaacgttgaacttcgtagtcgacgtcgcccgacggacctaccgggtcttagttactttacgnggtcgacgactaacttacgtaacgtatacgtaggccggaccgtaatacgtccaaccngttaccaacgtagttcgttacgttttacgaattcgttcgggacggggtaacccgg

SEQ ID NO: 271062 - DNA, 595 bp, Homo sapiens
  misc_feature: GYAE6OF01BDOU6.25.4.A04.1.454.CMB.1.raw
  modified_base (166)..(166): a, c, t, g, unknown or other
  misc_feature (166)..(166): n is a, c, g, or t
  modified_base (195)..(195): a, c, t, g, unknown or other
  misc_feature (195)..(195): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
  modified_base (459)..(459): a, c, t, g, unknown or other
  misc_feature (459)..(459): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcnccactcctccctgtctgcatctgttgganacagaatcagcatcacttggccgggcgagtcgagggctattagctaatttatttacgcctggtaatacaaacaacgaaaccgaggggacgtacgtttaccctaaaggtcctaccgtagattacctaatgacctcgcccctactaccgtttaccacgtcgtaacggggtccctaagtccgtacggttcaaggcgtacagtagaagtcgtacgggtacagtacgttcactctacacgtatcaagcacncgtncacgcctagaactntatagacttaattacgttactagtaaactaaagtattaaactctacccgtcccttactaccgttcggttaccggggacggaacgggtaacccgtaagggtcgaaacgtaacgaactaaaacggacgttggtaccgg

SEQ ID NO: 271063 - DNA, 552 bp, Homo sapiens
  misc_feature: GYAE6OF01E0Q9M.25.4.A04.1.454.CMB.1.raw
  modified_base (334)..(334): a, c, t, g, unknown or other
  misc_feature (334)..(334): n is a, c, g, or t
  modified_base (378)..(378): a, c, t, g, unknown or other
  misc_feature (378)..(378): n is a, c, g, or t
  modified_base (400)..(400): a, c, t, g, unknown or other
  misc_feature (400)..(400): n is a, c, g, or t
  modified_base (542)..(542): a, c, t, g, unknown or other
  misc_feature (542)..(542): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaactagaaaccgagggagtagttcctaagctcctgatctatgctcgcctcctacgttacactcgaggggtcccatctcgtnagcgcagtgatctagggacagagttcactctctactatcagacncgcctgacgcgcctagtaacgntggttacgactaaacgtttattaacgttacgtaacgtaaaagttacttaaactactaccgttcccctacttacccgttacgtttacgggacgggtaccgggtaaccgaagggtacggtaacgaagtaaccaaacgttaacgnggttaccggg

SEQ ID NO: 271064 - DNA, 545 bp, Homo sapiens
  misc_feature: GYAE6OF01DLVTP.25.4.A04.1.454.CMB.1.raw
  modified_base (219)..(219): a, c, t, g, unknown or other
  misc_feature (219)..(219): n is a, c, g, or t
  modified_base (383)..(383): a, c, t, g, unknown or other
  misc_feature (383)..(383): n is a, c, g, or t
  modified_base (412)..(412): a, c, t, g, unknown or other
  misc_feature (412)..(412): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcgagggcattagctaattattagctggtatacaacaagaaaccgagggagagttcctaagctcctagatctatgctcgcctaccgtacgttaccactcgacgggtcccagtcgtcgtcagcgcagtgatcgtagggacagtacgttcactctacacttacnctagcacgtcctgacagtcctagaacgtnttgttacgacttaactttacgttaactagtaactaaaagtctaaactaccttccgccccttatacccgtacgtttcgggacggtacgggaccgtaagggtacggtaactaacgtacaaacggtcgtggtaccg

SEQ ID NO: 271065 - DNA, 671 bp, Homo sapiens
  misc_feature: GYAE6OF01C77A9.25.4.A04.1.454.CMB.1.raw
  modified_base (246)..(246): a, c, t, g, unknown or other
  misc_feature (246)..(246): n is a, c, g, or t
  modified_base (307)..(307): a, c, t, g, unknown or other
  misc_feature (307)..(307): n is a, c, g, or t
tcagactgtacagtcacgaccggtgctcgatttagagtagtgatcaggggagctctgggagaggagccccagcccgtgagattcccaggagtctccacttggtgatcagcactgaacacagaccacaaccatggagtttggcttactgtcttttcctgttgctgtttaaagtgtcaatgtgagtgcactggtcgagtcgtggggagcttggtacagccaggcccggtcctgacactctcctagcanacgcttcccggactctaccgtttggtgacgcatcgctatcgacctcgggtccgccaggccncgagggaggtcgtggagtggcttgggtcagttagagacgacgtcctagtgggtggactaacgacgaactaccggccgtacgtcgtaggtaaaacgccgaagtcgttacgacggtaccttgtaacggaaacgtaagtaacttaacggtaaccgtttaaaccgaaaacgtcctaacgttacccgacccgttttaatacccgttagtaccgtaaacgtagttaccggacgtaccggtaacgtccccgttaagggacggtaaacggcccggtaaacggaccgttaccgacggtcccggttagttaccgttttaacgttcgttttacttagtttaccttacgttacggtaaggtcgttagttttaacgg

SEQ ID NO: 271066 - DNA, 538 bp, Homo sapiens
  misc_feature: GYAE6OF01DMVJZ.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttgccgggcagtcagggcattagactaattatttagcctggtatcaacagaaaccagggacgagttcctaagctcctgatctatgctgcctctacgttacactcgacgggtcccatcgtcggttcagcgcagtgaactcgtaggacagtacgttcacgtctacactatcgagcacgctgcagcctagaacgtagttgttagacttaacgtttattacgtagttaactaaaagttactaaatcctcgaccccttctaccgtacggtttacgggacggtaacgggtaccgaagggtacggaagtaactacgaaaacgtcgtggtaccgg

SEQ ID NO: 271067 - DNA, 498 bp, Homo sapiens
  misc_feature: GYAE6OF01A0BFO.25.4.A04.1.454.CMB.1.raw
  modified_base (395)..(395): a, c, t, g, unknown or other
  misc_feature (395)..(395): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcagtcaggggcattagcaattatttagcctggtatcaacagaaaccagggagagttcctaagctcctgatctatgctgcctccacgttacactcgacggggtccatctcggttcagcggcagtgaatcgtagggacagagttcactctcactatcagcagcctgcagcctagaagntgttgactaacttattactgttaacaaagttataactactctccctctctacgtttcgggcggtacgggacaaggtcggaagactaacaaacgtatggtacgg

SEQ ID NO: 271068 - DNA, 937 bp, Homo sapiens
  misc_feature: GYAE6OF01CEG70.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatcctccctgtctgcatctgtggagacagaatcagcatctacgttcggccgggcgagtcgaggggcattagctaatttacgtttacgccttggtaactacaaactaaggaaacccgaggggtaagtacgtttacctaacgtccttacccgtaggtacttccgtaagttcgtccgttcgtcccttacccttaaccggtttaacctaccgttccggtaaccgggggtttacccctaagtttcccgttaccgggttccgaacggtccgggacgtacggttagtaacgttccgggttagggaaccgtacggttacgtttaccctaccgtttacccgttaccgtaaacctttaacgtccggtaacggaccctaaccgggtcccccggttacggtacccgaacccgggttacccgttaaacgggttaaaccggtaacggttttacgggttttaacgttaaaccccgtttaaacgtttttttaaacccgtttttaaacccggttttaaacggtttaaaaaccgtttaaaaaacggtttaaacgttttaaaaaccgtttaacccggtttaccccggtttaaccccccctttaacccgttttacccccgggttttaaaccccgggttttttaaccccgggggggaaacccggggggttaaaccccgggggtaaacccggggttaaaaccggggttaggggggtaaaaccgtttaaacccggttaaaacccgggaaaaacccgggtttaaacccgggtttcggggtttaaacccgggg

SEQ ID NO: 271069 - DNA, 721 bp, Homo sapiens
  misc_feature: GYAE6OF01A478W.25.4.A04.1.454.CMB.1.raw
  modified_base (220)..(220): a, c, t, g, unknown or other
  misc_feature (220)..(220): n is a, c, g, or t
  modified_base (524)..(524): a, c, t, g, unknown or other
  misc_feature (524)..(524): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgtggagacagaatcagcaactcacttggccggngagtcgaggcaagttagactaatttattacgacctggttaacaccgaaacgaacggaaaacccgtagggggtaacgttaacgtttaccgtaaacggtccttaccgttaggtaacttccgttaagtcggtccttaccggtccccttacccgtaacgtttaaccgaccgttaccgggtaccggggttacccctaacgttccgttaccgggtttacgacggtcgggtacctaaggtaacgtaacgttcgggaacgggtaataacggttacgttaccacttccttactaacgttactacgacgtaccncggtacttcggacgtacgtaccgtaagtaagtacgtttacggttactaacgttaactttaacgttaacgtaacgttaaactaaaattacgtaaaactcgtacccgtacccttacgttaccgtaccgggtttacgggaacggtaacgggtaacgtaaggtacgtaacgtaacgtaaccgtaaacggtgtcgggtaacg

SEQ ID NO: 271070 - DNA, 562 bp, Homo sapiens
  misc_feature: GYAE6OF01C6ZWV.25.4.A04.1.454.CMB.1.raw
  modified_base (223)..(223): a, c, t, g, unknown or other
  misc_feature (223)..(223): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccattctccatcctccctgtctgcatctgttggagacagaatcagcatcacgttcggccgggngagtcgagggcattagctaattatttagcctggtatcaacagaaaccgagggagtagtcctaagctacctgtatctatgctcgccctaccacgttaccactccgacggggttcccattccgtcggttcaggtcggctagtgaatcgtagggacagnttccactcncactntcaagcacgcctgcgagcctagaatgttgttacgacttaaacgtttattacgttagtaacgtaaaagttattaaacgttacctcgaccccttctaccgttccggtttacgggacggtagggtaaccgaggggtacgaacggtaactacgaaaaccgtagttggtaccgg

SEQ ID NO: 271071 - DNA, 572 bp, Homo sapiens
  misc_feature: GYAE6OF01BZMZ8.25.4.A04.1.454.CMB.1.raw
  modified_base (219)..(219): a, c, t, g, unknown or other
  misc_feature (219)..(219): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagctaattatttagctggtatacaacagaaaccagggagagttcctaagctctgatctatgctgcctccacgttacactcgacgggtcccagtctcggttcaggcggcagtgaactcgtagggacagtagttcacttctactactatcgacgcacgtcctgacgacgccgtagaagtagttgttacgtactaactttattacgttagttaactaaagttaacttaacttaccgtccgttaccccttccgttaccgttaccggttttacgggacgggtaccgggtaaccggtaaagggtagggtaaacgtaacgtaaccgaaaccgtaacggttggtacggg

SEQ ID NO: 271072 - DNA, 741 bp, Homo sapiens
  misc_feature: GYAE6OF01E1LTS.25.4.A04.1.454.CMB.1.raw
  modified_base (315)..(315): a, c, t, g, unknown or other
  misc_feature (315)..(315): n is a, c, g, or t
tcagactgtacagtcacgaccggtgctcgatttagagtagtgatcaggggagctctgggagaggagccccagccgtgagattcccaggagtctccacttggtgatcagcactgaacacagacccaccaaccatggagtttgggcttaactgttcttttccttgttgtcttagttttaaaaggtgtccaagttgtgaggtgcaactggtggagtcgtggggggagtcgttggtacacgccgacggcccggtccctgacctacctctcctgcacagtccttccggactctaccgtttggagagccagtcgcttacgnggtaccccgtggggtcccgccgagggtcctacccgggagggggtaacgggttcgtagggaggtttgggtccgttttaggggttacctaagtttaacgggaaaggtccggaaacgtccggttaagtcgggggttacgggaacctaaaacgtacgtaaacgtcccggtacccggtcgttaacgtaagggtaaaaacgggcctaagtacttccgacgtccttactaccgtaagacgacttagtaaacgttaccaaaacgtccaacgtccgaccttatcgtacgacaacgtagtacgagtacgacggtaccgtaggaacgaacggacgtacggtaccgtacgtacggtaccggtttagttactttacgtttcgttttaacgtttacgtttaaccgttacgtaaggttacggttaggttaagttttaacgg

SEQ ID NO: 271073 - DNA, 666 bp, Homo sapiens
  misc_feature: GYAE6OF01DA3UZ.25.4.A04.1.454.CMB.1.raw
  modified_base (258)..(258): a, c, t, g, unknown or other
  misc_feature (258)..(258): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttgccgggcgagtcgagggcattagctaattattagcctgtatcaanagaaccaggagtagtcctaagctcctgatctatcgctcgccctaccgtacgttaccgtacctacgacggggtcccctagttccgttcggttccgaggtacgggctaggtagtactacggtgggactaggtaactttcctaaccttcctacctaacttacttacgtaacgccgacgtacccgttcgacgtacggacccttaggaagtagttacggttacgaccttaaaccttttagtttaacctaacggttaaactaaaaaggtttacttaaacgttacccttaccgtacccccgtttacctaccgttaacccgttttacgggggaccgggtaaacccgggaaccgggtaaagggtacgggtaaacgtaaacggaacccgtaaaaacggtccggttagggttaaccggg

SEQ ID NO: 271074 - DNA, 544 bp, Homo sapiens
  misc_feature: GYAE6OF01AJDTJ.25.4.A04.1.454.CMB.1.raw
  modified_base (257)..(257): a, c, t, g, unknown or other
  misc_feature (257)..(257): n is a, c, g, or t
  modified_base (448)..(448): a, c, t, g, unknown or other
  misc_feature (448)..(448): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccagggccggtccctgacactctcctgcacngccttccggactcacctttggtgagcatgctatgacctgggtccgccaggctccgagggaggtcgtggagtggcttgggttcagttagaacgcgaagtccgtagtggtgggcaaacgacaagtacgccgcgtctagtaaaggcagattcacgcctactcgaagagatagattaccaaagcagtcgacctancctgacacatcgacgcacgcctaggacggagcgtagacctcgacggtccgttgtacttcttcgttactttacttactcgtagagtagttgtttagg

SEQ ID NO: 271075 - DNA, 678 bp, Homo sapiens
  misc_feature: GYAE6OF01BI82O.25.4.A04.1.454.CMB.1.raw
  modified_base (257)..(257): a, c, t, g, unknown or other
  misc_feature (257)..(257): n is a, c, g, or t
  modified_base (378)..(378): a, c, t, g, unknown or other
  misc_feature (378)..(378): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctccagatgtgtcctgtcccaggtgcagctgcaggagtcgggcccaggactggtgaacgtccttcacgacgaccctgtccctcacctgcactgtctcgtggtcgctcatcactagttgtatcactacgnggagctggactccgccaggaccacccggaaggggaacggccgtagggagtaggtagttacgggtaactatcgttaacgttaccggtgggacgtctaccttactaacccgacccgtacctanaacgttacgtcgaacgtaccaacgtacttctactaagtacaacctaacggttactaaaccggtaaacctgtttacccgtaccttaaggtaaacgtttacggtaaaccttcggttacgaccgtacgttcggacccggaccggtaaacggtcccgggttagtttacgtaaacgtttcggtaggccggtaccgtaacttacgtaaccggtagtaactacggtacggtcgtaaccgtaatctacccgactaagcctaaaggtagtttcgttacttttaagacgtttccgacgggtaaacggggg

SEQ ID NO: 271076 - DNA, 582 bp, Homo sapiens
  misc_feature: GYAE6OF01EYANT.25.4.A04.1.454.CMB.1.raw
  modified_base (172)..(172): a, c, t, g, unknown or other
  misc_feature (172)..(172): n is a, c, g, or t
tcagactgtacagtcacgaccggtgctcgatttagagtagtgatcagggggggagaggagccccagccgtgagattcccaggagtctccacttggtgatcagcactgaacacagaccaccaaccatggagtttgggcttaactgtcttttccttgttgctgttttaaaaggngtccaatgtgaggtgcaactggtggagtctgggggagcttggtacagccaggccggtccctgacactctcctgcacagccttccggactctacctttggtgagcatgctatgacctgggtccgccaggcctccgaggggaagggtctgggagtggcttgggttactagttaggaagcgaagtcctagtgggtgggcaaacacaagtaccgccgcggtctaggtaaaaggcaggattcagtcctctacaagacgatagtacttaaccaaaagcaagtccgacctatctgacacatgagcacgctgaaggaagcgaacggactcgacggtccgtagtaatttacgttcgttactttagttacttcgtaggacggttaggttaagttagggtttaatttaagttacttaaacg

SEQ ID NO: 271077 - DNA, 886 bp, Homo sapiens
  misc_feature: GYAE6OF01DHQ2C.25.4.A04.1.454.CMB.1.raw
tcagactgtacagtcacgaccggtgctcgatttagagtagtgatcagggggcagaagtctctctcagtcaggacacagcatggacatgagggtccctgctcagctccgtgggactcctgctgctctggcctcccagataccagatgtgacgtccagatcgacccagtcctccacttcctccctgtctgctattcgtggtaggagacaagaactcagctactctacgttcggccgggagacgtcgagggactagttagacttaatttacgttacgccgtagtactaacgaaacgaacgaaaccgtgggtaacgtacgttacctaacgtccttacctaggtacttacgtagttcgccgttaccgtaccccgttaccgtaaccgtttaccgtaccggtaccggtaaccggggttacccttacggtttacccggttaccggttaccgacggggtacggtaccgtaaggttaacggtaacgtttccgggtaacgggtacctaacgggttaccctttaccgtaacccttaccgttaacccttaaaccgtttaagacccgaaccggttaccggtacccgtaccccgttacggaacccgtttaacggtacccgtttaaagggaacttttacgggtttaaccgttaacgtaaaccgtttttaaaccgttttaacgttttaaccgtaaaaccgggtttaaaattaaaaacgggttttaaaccttaacccggtttaacccgtaccccgtttacccccgtttaccggttaaaccgggtttacccggggttttaacggggggaacccgggttaaacccggggtaaaacggttaaacggggttacggtaaacgtaacccggtttaaaaaccgaacccggtttagggtccggtaaacccgg

SEQ ID NO: 271078 - DNA, 555 bp, Homo sapiens
  misc_feature: GYAE6OF01AS7MK.25.4.A04.1.454.CMB.1.raw
  modified_base (398)..(398): a, c, t, g, unknown or other
  misc_feature (398)..(398): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgtggagacagaatcagcagtcacttggccgggcgagtcagggcattagctaattattagcctggtatacaacaagaaaccgagggacgtacgttacctaaagcctccgtagacttctaatcgtactcgtccctaccgtacgttacacctcgacggggtccacgtctcggtcagcgcagtgactcgtagggacagtactcgactctcactancagcagacctgcagcctagaagtactgtacgacttaacttacttactgttaaacttaaagtttcgaacgtgtaccggtaccgtggtaacgttccggtaccggaccgacgggtaaccgtagggtaaccgactacggtaaccaaacggtacgtggtacg

SEQ ID NO: 271079 - DNA, 769 bp, Homo sapiens
  misc_feature: GYAE6OF01DXD5F.25.4.A04.1.454.CMB.1.raw
tcagactgtacagtcacgaccggtgctcgatttagagtagtgatcagggtctgtgaaggcttcaccagtcctggacctcctgtgcaaagaacatgaaacacctgtggttctccctcctgctggtggcagctccagatgggtcctgtcccaggtgcagctgcaggaggtccgggcccaggactgggtagaacgtccttcacacgaccctcgtcccctcacctgccactgtctcgtggtcgcctccatccacgtaggttgttactcctactacgtggagtcgtggacctccgaccacgaccgaacccggaggggaacgggtccgtaggggtacggttagggtacggtttacgggtaactacgttaccggtttaaacgtttaccgggtaggggtacgtaccttaaccccgttttaccaaccccgttaaccccggtacccttaacgtaaacgtacggtaccgaacgtaccctaacctacttccttacgtaaacgtttaacgaaccgttaaccgttaaccgtaaaaccgtaaccttaccgtttaccctacccgttaggttaaaccgtttaacgacctttgtacgttacgtacgtacggcccgaacgggtaacccgtccggttcgttaagttaacgttcggacggttacggcgtaactaacgttaaccgtaactacgtaacgttgggtaccggtaaccctaatttaaccgacccaagtactaccgaacgttattcggtttactttagacttaccggttcgggcggggtaaaccgg

SEQ ID NO: 271080 - DNA, 697 bp, Homo sapiens
  misc_feature: GYAE6OF01EF6PW.25.4.A04.1.454.CMB.1.raw
  modified_base (203)..(203): a, c, t, g, unknown or other
  misc_feature (203)..(203): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcancatcactggccgggcgagtcgaggcattagactaattattagcctaggtactacaacgaagaaaccgagggtacgtaagttacctaacgtcctaccgtagtactcttagtcgtcctcggtaccctaccgtaccgttaacctaccgtacgtaccggggtcccctacgttccgttcggttacgacggtccggtacgtacggttacgtaaacggtccgttacgggaccgtaggtaacgttacctaccgttactaccgtaccttactaccgtatccgaaccgtccgttacgaccgacgtaccgtaaggtaagtagttcgttacgttaaccttaactttaacgttaacgttacgttaaaacgtaaacgttaactaacttaccgtacccgttaccccgtaccttccggttaaccggtttacggggaaccggggtaacggaacccgggttaagggtaacgggtaacgtacgtaaaccgtaaaacggtacggtggtaaccgg

SEQ ID NO: 271081 - DNA, 587 bp, Homo sapiens
  misc_feature: GYAE6OF01EQJFZ.25.4.A04.1.454.CMB.1.raw
  modified_base (194)..(194): a, c, t, g, unknown or other
  misc_feature (194)..(194): n is a, c, g, or t
  modified_base (374)..(374): a, c, t, g, unknown or other
  misc_feature (374)..(374): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttggccgggcgagtcgagggcattagactattatttagcctggtatacaacagaaaccgagggagagttccaagctccgtgatctatgctcgcctccacgttacactcgacgggtcccatcgtcgttcagcgcagtgagtcgtaggactaggtacgtccacttntaccgtactatccaagcctacgtcccgtgaccgtacgcccgttagaactcgttaggttctaacttaacctttagtttaaccttacggttaaactaaaacgttaattaaaccttacgtacccgttccccttacttccgttaccggtttccggggacggtaacggggtacctaagggtacggaagtactaaaccgaacgtaaagtcggttacggg

SEQ ID NO: 271082 - DNA, 501 bp, Homo sapiens
  misc_feature: GYAE6OF01AJHJ0.25.4.A04.1.454.CMB.1.raw
  modified_base (218)..(218): a, c, t, g, unknown or other
  misc_feature (218)..(218): n is a, c, g, or t
  modified_base (394)..(394): a, c, t, g, unknown or other
  misc_feature (394)..(394): n is a, c, g, or t
  modified_base (419)..(419): a, c, t, g, unknown or other
  misc_feature (419)..(419): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttgccgggnagtcagggcattagcaattatttagcctggtatcaacagaaaccagggagacgttcctaagctcctgatctatgctgcctccacgttacactcgacgggtcccatctcgttcagcggcagtgaatcgtggacagtagttcactctcactatcagtcacgtcctgcagcctagaagnttgttgacctaactttattaacgtntactaaagtataatactctccctctcgtacgttcggacggtaggaccgaaggtacgagtacaacgaaacgtacgtggtacgg

SEQ ID NO: 271083 - DNA, 659 bp, Homo sapiens
  misc_feature: GYAE6OF01AWAH8.25.4.A04.1.454.CMB.1.raw
  modified_base (281)..(281): a, c, t, g, unknown or other
  misc_feature (281)..(281): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccggtccctgacactctcctgcacagccttccggactctaccttttggngagcatgctatggacctgggtccgccgaggctccgaaggggtacgggtctgggtagtggtcgtttgggtcagttacgaagcgaaagccgttagtggggtcgggacaaacgacaacgtaccgccggtagttctaaggtaaaagggcctaagtacttcgacgtacccttactacgaagaagatacgaacttaccaaaaggtcaagtccgactatactcgacctaacacgtagagtcgaacgtaccgtagaacggaacggacggaagggtaccctacggtacggtacccggttagttaaaccgttttaccgtttacggtttaaccttttaacgttttaacttaccgttaggtaacggttaaagggtttggttttaaacggg

SEQ ID NO: 271084 - DNA, 688 bp, Homo sapiens
  misc_feature: GYAE6OF01EFG8C.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcatctgttggagacagaatcagcatcacttggccgggcgagtcgagggcattagctaattattagcctggtatacaacgacgaaaccgagggagtacgttacctaagtcctccgtagtactctatgctcgcctacctacgttacacgtcgacggggtccctacgtcgtcggttcgacggcggtacgaggtacgaacgttcgtacgggactacggtacttaccgacgttctacgtacttaacgtccgaacgtccgacgtcccgtcggaccgtaacggtaccccgtaaggaacgttagttcgggttaacgtaaccttaaaccgttttaacgtttaaccgttaacggttaaactaaaacgttaacgttaaaacgttaccccttaccgttacccccttacgttaccgttaacccgggtttaccgggaacggggtaaaccggggtaaaccggtaaagggttaacggtaacggtaacgtaaaccggtaaaacggtaacggtcgggtaaccgg

SEQ ID NO: 271085 - DNA, 524 bp, Homo sapiens
  misc_feature: GYAE6OF01C0VGO.25.4.A04.1.454.CMB.1.raw
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtgttancactactgganctggatccgccagcacccagggaaggcctggagtggattgggtacatctattaccgtgggancaccttcaccaacccgtcctanaatgtcagtcaccatctcattacgacacgtctaagaacctagttcctccctagtaacgtttgaaacttcgtagtcgacttcggccgtacggaccacggtccgtgttacttactgtgcggcactactacgatactagtcggccgatactcacatcacgattgtcttttgatatcgtggggaaccg

SEQ ID NO: 271086 - DNA, 574 bp, Homo sapiens
  misc_feature: GYAE6OF01C6PK4.25.4.A04.1.454.CMB.1.raw
  modified_base (220)..(220): a, c, t, g, unknown or other
  misc_feature (220)..(220): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtcagatcgaccagtctccatcctccctgtctgcatctgtgagacagatcagcatctacgttcgccggganagtcaggcattagctaattagttagtcctagtatacgaacagaaacgaggatagtacaagactccgtagatctatcgtctcctacctaccgacgtttaccacgtacgaacggggtccctagtccgtcggttcacggcgacgtagtgaattcggaggtacgagtcgttactactacctacacttaactcagacctcgcgtacgcgacgacgtagaagtgttacgtagtacttaatttacttactagtaaactaattactaactacctccacccgttactcgttaaccggttacgggacgggaacggttacggaacggttacggaacgttacgaacgtaaccgtagtggtacccgg

SEQ ID NO: 271087 - DNA, 628 bp, Homo sapiens
  misc_feature: GYAE6OF01CQ0LW.25.4.A04.1.454.CMB.1.raw
  modified_base (325)..(325): a, c, t, g, unknown or other
  misc_feature (325)..(325): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctccagatgggtcctgtcccaggtgcagctgcaggagtcgggcccaggactggtgaagccttcacagaccctgtccctcacctgcactgtctctggtgctcatcacagtgttatcactactggagctggatccgcagccacccgagggaacggcctggacgtggtattgggtactatcttaagttaccggtgggacnccgtaccttctaaccaacccgtcctacaatacgtcgaagtccaacctatctactaattacgactacgtactaacgaacctacgtttcctaccgtagtaaacgttacgtaacttccgttggtacgtacgttacggcccggtaccgggaaccgtaccggggtacccgtttacggttaactttaaccgtggttcgaccgggtactaacgttactaacggtacttaacggtacggtcggaccgtaattacgtccaactactaccgagtaattcgttcttttagattacgtcggtacggggtaaccgg

SEQ ID NO: 271088 - DNA, 602 bp, Homo sapiens
  misc_feature: GYAE6OF01BEQMD.25.4.A04.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttggccgggnagtcagggcattagcaattattagccttggtatacaacaagaaaccgagggaagacgttacctaagcctacctgatctatgctcgcctccacgttacactcgacggggtcccatcgttcggttcaggcgcagtgaatcgtagggactagagttccacgtcctacacttatccgagtccgacgtcccgtgacctacgtccgtagtaagattgttacgaccgttaaactttacttaacgttataacgtaaaagttaacttaaacttacctaccgtacccccttacgttccccgttaacggtttccggggtaaccgggaccgggtaacggtaaacggggttggaaacggtacgtaacgaaaaccgttaacggtcggttaccgggg

SEQ ID NO: 271089 - DNA, 743 bp, Homo sapiens
  misc_feature: GYAE6OF01DO3FA.25.4.A04.1.454.CMB.1.raw
  modified_base (211)..(211): a, c, t, g, unknown or other
  misc_feature (211)..(211): n is a, c, g, or t
  modified_base (315)..(315): a, c, t, g, unknown or other
  misc_feature (315)..(315): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctccagatgggtcctgtcccaggtgcagctgcaggagtcgggcccaggactgggtagaagtccttacacagaccctgtccctnacctgccactgtctcgtggtgctcatcacaggtgttatcactacgtgagcgtgactccgccagccaccgaggggaacggccgtggacgtggtagttacggtacnttctagttacccggtagggactaccgtaccttcctaaccgtaccccgtaccctacgtaaattacggtcgtaacgtaccaactactcttacgtaagtttaaacgactaaccgtacttaaaacgaacccgttacgtttaccctacccgttaaggtaacgtttacgaaacttccgtacgtacgtacgtaccggtcccggaccgggtaccgtaccgggtaccgtttacgttaacgtttaccggtaggtcggtaccgggtacttaaccgttaaccgttaacgtaacgttacggtaacggtacgggtaacccgtaacttaacgtacccgtaaaacccgtagttaaaccccgtaaacgggttacgttaccgggttttaactttttacgggtaaacttttacgggtcccggggtttaacggggggaaaaccccggg

SEQ ID NO: 271090 - DNA, 773 bp, Homo sapiens
  misc_feature: GYAE6OF01CQ1G1.25.4.A04.1.454.CMB.1.raw
  modified_base (196)..(196): a, c, t, g, unknown or other
  misc_feature (196)..(196): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccatccctccctgtctgcatctgtgganacagatcagcatctacgttcgggcccgggcgtacgtcgagggctaagttaacgacttaaagtttagtttacgtccgttggtaactaaccgaaacgaaacggaaaaccggagggggtaacgtaaccggtttaccctaaacggtcccttaccgtaggtacttactagttccgtccgtccgccccttaacccgtaacgtttaaccctaccggttaccggtaaccgggggtttacccctaccgtttaccggttaccgggttccgacggggaccggtacgtaaggttaacggtaacgttccgggtaaggggacctaacgggttaccgtttacccgtaccgtttacctacgttaacgtacgttaccgacgtcccgacgttcccgtacggtaccgacggtacgtaacggaggttagttcgttaaccgtaaactttacgttttaacgtttaccgttaaacgtaaacgtttaaagtaaccttaacgtaccttacccgtccccttacgtaccgtaaccgggtttccgggaacgggtaccggtacggtaagggtacgtacgtaaccgtagaaacggtcgtaggtccgg

SEQ ID NO: 271091 - DNA, 783 bp, Homo sapiens
  misc_feature: GYAE6OF01BFTEA.25.4.A04.1.454.CMB.1.raw
tcagactgtacagtcacgaccggtgctcgatttagagtagtgatcgagggggcagaagtctctctcagtcaggacacagcatggacatgagggtccctgctcagctcctgggactcctgctgctctggcctcccagataccagatgtgacgtccagatcgacccagtcctccactccctccctgtctagctatctggtggagtacagaactcagcatcctacgttcggcccgggatacgtcgagggtctaagttacgacttaaagtttacgttacgaccgttaggtaactaccgtaaaacgaacggaaaacccggtaggggtaactacgtttaccgaaacgtccttaccgtaagtacttacgttagtcgtccgtacgtcccgttacccgtaacggttaccaaccgtacggggtaacccgggttcccacgttccgtaccgggttacacgggtcgtacgtaggtacggtaactcggtacgggaactacggtacgttacctacgttactactacgttacgacgtacgtacgacgtccgtagaccgtacggtaccgtaaggtaacgttcgttacgtcgttaaaccgttaacgtttacgtttaaccgtaagttaaacgtaaaacgttactaaaccgttacccgttacccgttacccgtaaccggtttaaccggttaccgggtttacccggggaacggggttaaaccgggtaaacccgttaagggggtaaccgtaaaccggtaacgttaaacccgggtaaaaaccgtttccggggtggttaaaccccgg

SEQ ID NO: 271092 - DNA, 743 bp, Homo sapiens
  misc_feature: GYAE6OF01B0I8N.25.4.A04.1.454.CMB.1.raw
  modified_base (229)..(229): a, c, t, g, unknown or other
  misc_feature (229)..(229): n is a, c, g, or t
tcagactgtacagtcacgaccggtgctcgatttagagtagtgatcagggggcagaagtctctctcagtcaggacacagcatggacatgagggtccctgctcagctccgtgggactcctgctgctctggcctcccagactaccagatgtgacgtccagatcgacccagtcctccactccctccctgtctgctatcgtgttggagacagaatcagcatcacgtggccgggngagtcgagggctattagactaatttagttacgccgttaggtaatacgaaacgaaggaaaaccgagggtacgtaacggtttaccaaagtcctaccgtagtaacttacgtacgtcgtaccgttcgtacccttaccgtaacgtttaaccgaccgttacggtaacgggttccctaacgttccgttacgggttacgacggaccggtagtaacggttaaggtaaacgttccgggtaacggggaacctaaggttaccggtttactaaacccgttcccgtacttaaacctttaacgaccgtaacgtaccgaccgtcccgttagacccgaccgtaccgttaaggaagttacgttacggttactaaaccgtttaaacttttaacgttaacgtaacgttaaaactaaacggtttaactaaccgttaccgtacccggtacccctttacgtaacgttacccggtaacggggcgggtaaacggtaaccgtaagggtcgaaagttaccaaaggaactacggttgaccgg

SEQ ID NO: 271093 - DNA, 828 bp, Homo sapiens
  misc_feature: GYAE6OF01CP8AA.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgaccgtccagtactcgacccagtcctaccacttccctccctgtcctgcatccgtgttggagtacagaatccagctatcacgttcggccgggcgtaggtacgagggtactaattacgacttaattattttacggccttggtaaactaccgaaacgaacgaaaaccgtaggggaacgtacgttaccgaacgtcctaccctagtacttactagtcgtcctacgcccttaccgtaacgttacctacgtccggtaacggtccctacgttccgttaccggttaccgacggtccggtacgtaacggtacgtaacgttccgggtagggtaaccgacggttaaccgtttcccctaaccgtttccgtaaactacccgttaaacgtccgaaccggtcctaccggccccgttacgaacccgtaccgttaccgtaacgggtaaacggttctttaccgggttaacctaacccttttaaaacccgtttttacgtttaaaccggttaacggttaaaaacccgtttaaaaggttacccttttaaaccgtaccccttcccccggttaacccctttagttacccccggtttaccggggtttaacccggggaaccgggggttaaaccggaacccgggttaaaaaggggttccgaaaacggtaaacgttaaacccgggaaaaccgttaggtaccccggttaggg

SEQ ID NO: 271094 - DNA, 638 bp, Homo sapiens
  misc_feature: GYAE6OF01B54E2.25.4.A04.1.454.CMB.1.raw
  modified_base (196)..(196): a, c, t, g, unknown or other
  misc_feature (196)..(196): n is a, c, g, or t
  modified_base (355)..(355): a, c, t, g, unknown or other
  misc_feature (355)..(355): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatccctccctgtctgcatctgttgganacagaatcagcatcacttgccgggcgagtcagggcattagctaattatttagccttaggtatacaaacaagaaaccgagggagtacgttacctaagctcctagattactatgctcgccttacctacgttacactcgacgggtcccacttcgtcggttcncgcggactacgtagactcgtagggactaggtacgttcaccttactcctaacttaacgtccaacgtcgaacgtcccgtagaccgtaacgtcccgtaaggaacgtacgttgttaacgtaccttaaactttaacttttaacgacgttaaacttaaacgttaataacttaccgtccgtaccccttaccgtcgttaccggtttacggggaacggggtaccgggtaaccggtaaagggttacgggtaacgaaacgttaaacccggtaaacgtaaagggttcgtaccggg

SEQ ID NO: 271095 - DNA, 1045 bp, Homo sapiens
  misc_feature: GYAE6OF01EU96G.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccactccctccctgtctgcatctgttggagacagaatcagcatcacgttcggccgggcgagtcgagggactagttagactaattattacgccgtagtatacaacaacggaaaccgagggacgtacgttaccgtaacgtccttccgtagtacttactagtcgtcctcgtcccctaccgtaaccgttaccaccgtacggaccggggtccctacgttccgttaccggttacgacggcggtacgtaggttacgtaacgtcggtacgggaacgtacggtacgtttaccaccttaccgtacctactacgtacacgaccgtaccgtacccgtcgacccgtacggtacccgtaaggtaaacgttacgtttacggttaccgttaaacctttaaaccgtttttaacgtttaaaccgtttaaaccgggtttaaaaaccgtttaaaaaaacgttttaaaacccgttttaaaacccgttttaaacccccggttttaaccccccccggttttaaaccccccccccgttttaaaccccggggtttttaacccccccgggttttttaaaaccccccgggggggggtttttttaaaaccccccccggggggggggggaaaaacccccccgggggggggggggtttttaaaaaaaacccccggggggggggttaaaaaaacccccccgggggggggttttaaaaaaacgggggggggggtttaaaaaccccccgggggggtttaaaaaaaaccccgggggttttaaaaaacccccgggggttttaaaaaaaaacccccccgggggttttaaaaaaaaaccccccgggggggggtttttaaaacccccggggtttttaccccggggggggggtttttaaaaaccccccgggggggg

SEQ ID NO: 271096 - DNA, 672 bp, Homo sapiens
  misc_feature: GYAE6OF01EK1L5.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtgacagctcccagatgggtcctgtcccaggtgcagctgcaggaggtcgggcccaggactgggtgaacgccttcacagaccctgtccctcacctgcactgtctgtggtgctccatcacctaggttggttactcactacgtggagtctggactcccgaccagccacccgaggggaaggccgtgggaggtggagttgggtacatcttagtacgtgggatcctaccttcaaccgtaacccgtcctacgaattacggtcacgttacacctactctactaactacgactacgtactaaacgtacctacgttacctcccgtaggtaacttaacgaacttagtcggttaacgccgttcggacccggtaccgaacccgggtacgggttaccgttggttaaacgtttccggttcggtcgggtaccggtactaacgttaaccgtaccgtacgttaacgtaggttcgggacctaacttacgtaaccgtaacctacttacgaacgttacgttcggtttacctttaggtaccgttaaacggttccggtacggggtaaacccggg

SEQ ID NO: 271097 - DNA, 701 bp, Homo sapiens
  misc_feature: GYAE6OF01BCZSA.25.4.A04.1.454.CMB.1.raw
  modified_base (168)..(168): a, c, t, g, unknown or other
  misc_feature (168)..(168): n is a, c, g, or t
  modified_base (224)..(224): a, c, t, g, unknown or other
  misc_feature (224)..(224): n is a, c, g, or t
tcagactgtacagtcacgaccggtgctcgatttagagtagtgatcagggggtcgagaagtctctctcagtcaggacacagcatcggacatgagggtccctgctcagctcctggactcctgcctgctctggctcccgagataccagtatgtgacgtccagatcgacccngtctccatccgcctagtctgcatcctgtgagacagatcagctatcacttggccggnagtcagggactagttagacgtaattacttaggccttaggtactcaactaagaaacccgagggacgtacgtttaccgtaaacgccgttaccgtagacttacgtaagtcgccgtacgccccttaccggtaacgttacctacgtaccggacggggttcccagttccgtacggtacacggtcgactagtcgaacgtcgtacggacgtacgtaccgttacgtaccttaccgttacgaacttacgtacgtaccggtacgtaccgtacccgtcggtaccgttcgggtaccgttacggtaaggtacccgtttcggttaaccgtaaccgttaaccgtttaacgttttaccggtaaccgttaacgtaaaaggtaccttaaacgttccgtaccgttaccccgttaccgtaaccgtaaccggtttacgggaccgggtaacgggtacgtaagggtcgtaacgtacgtaacgaaccgttacgtggtaccgg

SEQ ID NO: 271098 - DNA, 644 bp, Homo sapiens
  misc_feature: GYAE6OF01E2XMJ.25.4.A04.1.454.CMB.1.raw
  modified_base (246)..(246): a, c, t, g, unknown or other
  misc_feature (246)..(246): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (377)..(377): a, c, t, g, unknown or other
  misc_feature (377)..(377): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtggttancactactggagctggatcccgccagccacccgaggggaggccgtggagtggattgggactagtctattaccggnggganccgtaccttcctaccaaccccgttccctagaactagtcgacgttcaaccgtntcctacaagttacgacctaacgttactaacgaacctacgtttcctacccgtagtaaagttcgaacttcgtcggtacgacgtcggcccggtacggaaccgacgggtaccgttagtaacgtttacgtcggtcggccggtactaagttaaccctagtaccttacgtaggtcgggtacccgaattaaccgtcctaacccgaacttccgaaaccgtacgttaccgttaccgtttttaggaacttaccggttccgggtcggggtaaacccggg

SEQ ID NO: 271099 - DNA, 738 bp, Homo sapiens
  misc_feature: GYAE6OF01CB8XD.25.4.A04.1.454.CMB.1.raw
  modified_base (299)..(299): a, c, t, g, unknown or other
  misc_feature (299)..(299): n is a, c, g, or t
tcagactgtacagtcacgaccggtgctcgatttagagtagtgatcaggggagctctgggagaggagccccagccgtgagattcccaggagtctccacttggtgatcagcactgaacacagaccaaccaaccatggagtttgggcttaactgttcttttccttgttgtcttagttttaaaaggtgtccaatgtgaggtgcaagtggtggagtcggtggggggaggtcgttggtacacgccgaggcccggtcctgaccacctctcctgcacgacgtctccggactaccgtaccgttttggngaacgtctaagtcgacttaggtacgacccggttcggggccccgtaccgacgggtcctaccgggaagggggtaacgggtcgtggggtaggtcgggttacggtttgggttacaaggtttacggaaggaccgtaacggtccgtaggttcgggggtacgggaactaaacgacctaaacggtccggtaccgtacgtacgtaaaggtaaaacgggcctaagtcgttacaccggtcctatacgaaaggaacgtatacgtaaccttaaccgaaactcaacgtcccgtactactatcggacacgatacggcaccgtacgcgtaagggacgggtaaacgccggtaacgggtacgtaccgacgggtttaccctttagttaacgtttttcgttacggtttttaaaccttagtttcgtaacgtgggtttaaagttaggtttggttttaaacg

SEQ ID NO: 271100 - DNA, 709 bp, Homo sapiens
  misc_feature: GYAE6OF01D2OO5.25.4.A04.1.454.CMB.1.raw
  modified_base (210)..(210): a, c, t, g, unknown or other
  misc_feature (210)..(210): n is a, c, g, or t
  modified_base (458)..(458): a, c, t, g, unknown or other
  misc_feature (458)..(458): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtccagatcgacccagtcctccactccctccctgtctgcatcgtgttggagacaagaactnagcatcacgttcggccgggcgagtcgagggcaattagctaatttagttacgcctaggtactacaaacgaacgaaaccgaaggggtatacgttacctaaacgccttacctgtactctatcgctcgtcctacctacgttaacacgtacgtacgggtccctagtccggtacggttacacggccggacgagttacggaagttcggacgggtacgtacggtacgttacctactctaccgtaactactacgacncgtaccgcgtacggactacgacccgtaggtaacggtacgtttaggtacgttaaccttaaacgttttaacgttaagttaaccgttaaacttaaaaacggttacttaaacgttacccgttaccgtacccccgtttaccgttaccgttaacccgggtttacggggacccggggtaaaccgggtaaccgggttaacgggtaacgggtaaaccggtaaacgttaacccggaaaacggttccggttaggtaaccggg

SEQ ID NO: 271101 - DNA, 721 bp, Homo sapiens
  misc_feature: GYAE6OF01BH6W0.25.4.A04.1.454.CMB.1.raw
  modified_base (513)..(513): a, c, t, g, unknown or other
  misc_feature (513)..(513): n is a, c, g, or t
  modified_base (575)..(575): a, c, t, g, unknown or other
  misc_feature (575)..(575): n is a, c, g, or t
  modified_base (601)..(601): a, c, t, g, unknown or other
  misc_feature (601)..(601): n is a, c, g, or t
tcagactgtacagtcacgaccggtgctcgatttagagtagtgatcaggggggggagaggacgccccagccgtgagattcccaggagtctccacttggtgatcagcactgaacacagaccaccaaccagtggtaggtttgggctttaactgttctttttccgttgttgcttagtttttaaaaggtgtacctaatgtgaggtgcaacgtgggtggagtcggtgggggagtctttaggacaggccgacgggccgttcccagacctcttcctcctgcctaacgacgtccgttccggacttcgtaccgtttggagacgctatgtctaagtcgccggttcgggcccgcggacggtcccacggggaggggtaacggttcgagggtaggtcggttcggtttgggtactaaggttaacggaacggtacgaacgtacgtaggttggggacggaacaaacgtacaagtcccggcgttcgtaacgtaaggtaaaacgctagtactcgaacctcgtacacgaaagntagtacgaacttaaaccgaaacgtctacgttacgaccttatcgtacacgtactataccggtnaaccgacgtcgaaggaacgaaccggngaaccgactaccggtacgttccggttaattaccgtttacgtttctttacgtttaagttcccttagtaggtaacggttaacgtttaggttaaggttttaattaaaccgtttaacttaaacg

SEQ ID NO: 271102 - DNA, 642 bp, Homo sapiens
  misc_feature: GYAE6OF01C1I5Z.25.4.A04.1.454.CMB.1.raw
  modified_base (475)..(475): a, c, t, g, unknown or other
  misc_feature (475)..(475): n is a, c, g, or t
  modified_base (522)..(522): a, c, t, g, unknown or other
  misc_feature (522)..(522): n is a, c, g, or t
  modified_base (636)..(636): a, c, t, g, unknown or other
  misc_feature (636)..(636): n is a, c, g, or t
tcagactgtacagtcacgaccggtgctcgatttagagtagtgatcagggggcagaagtctctctcagtcaggacacagcatggacatgagggtccctgctcagctccgtgggactcctgctgctctggcctcccagactaccagatgtgaccgtccagactcgacccagttcctcccacttccctccctgtctcgactatcgttggtacggagacagtaactcaacgcaatcctacgttcgggccgggacgtaggcgaagggtctaagttacgtacttaaagtttacgtttacgccgttaggtaactacgaaacgaacggtaaacggagggactacgttcccaagtcctcgtagtactctagtcgcgtccgcccttaccgtacgttaccacgtccggaaccggttcctacggttccgtcggttacgacggtcgacgtagtacggtagttcgggaggtactacggttcacccgttntaccacgtaatccgaagcgtccgactcgcgcctagtacgtagacgtnttactacaatttacttagtaacttacgtaaataacgttctaacgtcctacctccttacgcgttacggacgggacggtacggaacgtaggacgttacaaacgtagaacgtcggtntaccgg

SEQ ID NO: 271103 - DNA, 855 bp, Homo sapiens
  misc_feature: GYAE6OF01AN52L.25.4.A04.1.454.CMB.1.raw
  modified_base (659)..(659): a, c, t, g, unknown or other
  misc_feature (659)..(659): n is a, c, g, or t
  modified_base (682)..(682): a, c, t, g, unknown or other
  misc_feature (682)..(682): n is a, c, g, or t
  modified_base (691)..(691): a, c, t, g, unknown or other
  misc_feature (691)..(691): n is a, c, g, or t
tcagactgtacagtcacgaccggtgctcgatttagagtagtgatcaggggcgagaagtctctctcagtcaggacacagcatggacatgagggtccctgctcagctcctgggactctgctgctctggctccagataccagactgtcgaccgtccagacgtcgacccacgtccttccacttccctccctcgttctcgccacttctcggttacggacgtaaccaggtaactccgagtacctagtcctaacggttcggcccggggtacgtaacggttccggaacggggtacctaagtttacggtaaccttaaaattttaacggttttaccggtaccgttacgggttataacccgtaaaacgaaaccggtaaaaccggtaagggggaaccgttaaacggtttacccttaaacgggcccttaccgttaaggtacgtttaaccttaacgtacggtaccgttaccgtacccttacccggtaaccgttttaaccgaaaccgttccgggttaaaccggggtcccctacctttaccggttccggggttaacctaccgggacggttacccgtaagggttactaaaccgggttccgacggggttaacgtaccggtaacggtttccaaccgttcgttaacctacgtaagtccaacggtctaccggtccgttanccgacctcggtaactagttaacnccgtttaanaccttaagtttacgttaaccttaggaacttaaaacggtactttaacgaccgttccgttacccccgtagtttaaccgtcggttaacccggggtacgggtaaacggaaccccgttaaaggttccgggaaattaaccctaaccgggtaaactaaccgggttggtacg

SEQ ID NO: 271104 - DNA, 685 bp, Homo sapiens
  misc_feature: GYAE6OF01EUBAK.25.4.A04.1.454.CMB.1.raw
  modified_base (194)..(194): a, c, t, g, unknown or other
  misc_feature (194)..(194): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccatcctcctgtctgcatctggtganacagaatcagcatccacgttcggccgggacagtcgagggctattagactaattattagcctaggtatacaacaacgaaaccgagggagtacgttaccgtaacgtcctccgtagtactcgtatcggaccttccgtaccctaccgtaaccgttaccaacgtccggtacggggtaccctacgttccgtttcggtacgacggtacggcgtacggtacgtacgttccggtagggtaacgtacggtacgttaccaccgtttacctacgtactaacgtacgtaacggacctaccgtcccgtacggaccgtacgtccgtaaggaaccgtagtttcgtacgtaacctttaacgtttaacttaacgttaagttaaacgttaaaattacgttaacctaccgtcccttaccccttacgttaccgttacgggttaccgggaaccgggtacggtaaccgtaaggggtacgtaacgtaacggaaacgtaacgggtcgtgggtaccg

SEQ ID NO: 271105 - DNA, 779 bp, Homo sapiens
  misc_feature: GYAE6OF01DA6UZ.25.4.A04.1.454.CMB.1.raw
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
tcagactgtacagtcacgaccggtgctcgatttagagtagtgatcagggtctgtgaaggcttcaccagtcctggacctcctgtgcaaagaacatgaaacacctgtggttctccctcctgctggtggcagctcccagatgggtcctgtcccaggtgcagctgcaggacgtcgggcccaggactggtgaagccttacacacgaccctgtccctcacctgcacgttgtctctgggtcgcctcatcaccagttgttacncactacgnggactcgtaggactccgacacgaccaccggaggggaacggtccgtagggaggtcggtagttacggggtaactacgttaccgttaacgtttaccgggagggtaccgtacccttaaccctttaccgtaacccgtaaccccggttacccctaacgtaaaaacgttcggtaaccgtaacggttaacccaaccgtaacttcttaacccgtaaagtttacggaaacccttaccggttaacgttaaaacccggtaacccgttacgtttacccgttacccgtaagggttaaacgttttaccgaaaccgtttcgtacgttacggtaacccgttcgggacccggtacggtaacccgtaaccgggtcctttaaggttaacttacggttacggtaccgtacgggtaccttaacgttaaccgtaacgtactaaccgttaggaccggtaccgtaatacgtacccgtactagtaaccctagtactttacggtcttttaaacggctttaacggcggtacggggtaaaccggg

SEQ ID NO: 271106 - DNA, 878 bp, Homo sapiens
  misc_feature: GYAE6OF01CS5N0.25.4.A04.1.454.CMB.1.raw
  modified_base (292)..(292): a, c, t, g, unknown or other
  misc_feature (292)..(292): n is a, c, g, or t
  modified_base (636)..(636): a, c, t, g, unknown or other
  misc_feature (636)..(636): n is a, c, g, or t
tcagactgtacagtcacgaccggtgctcgatttagagtagtgatcagggtctgtgaaggcttcaccagtcctggacctcctgtgacaagaacatagaaacacctgtggttctccctcctgctggtggcagcctccagagtgggtcctgtcccaggtgcagctgacgaggacggtccgggcccgaggacgtgggtagaacgtcctacacgacgtaccctcgttccccacaccgtgacctacgtcgtcctcgtcggtcggacctcctaatccgaaccgttaggttggttttacnccgtaaccgtaggttacgggacgtaccggtacggaccgtaccccggaccgaaccggaccccgaacccgggaagggggtaaccggtccgtaggggtacggttagggtacgtttacgggtaactacgtttaccgttaacggtttaccgggtagggacttaccccgttacccgtttaccgtaaccccgtaacccccgtactaacgtaacggttaccgttaccggacctacctaccgtaacttacctacttaaacgtacgaacctaacgtaccgtaacgtaaccttaccgtttacccgtaccgttaagttaaacggttactaacccgttggttaccgtacgggtaccnccgggacccggtaccgtaccggtaacccgggttcgttaacgttaacgttcgggtacgtaccggtaccggtaacgtttacctaacccggttacgtaaggtttaacccggttagggaccccggtaacgttttaacgaaccttaacccggtaaccccttacaaacggtttaccgttacgtttaacgtttacccggttttaagtacccgtttacggggttacccgggtaaggggtaaaccccgggg

SEQ ID NO: 271107 - DNA, 646 bp, Homo sapiens
  misc_feature: GYAE6OF01B1QXM.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctcatcaccagtgttatcactactggagctggactcccgccagccaccgaggggacggcctgggagtggtagttgggtactagtctaagttacccggtgggacgtcctaccgtttacctaacctaaccccgttccctacaaacgttacgtacgaacgtccaacctatcctactatttaacgaacctaacgttactaaacgaaccctacgttcctacccgttagtaaacgttcgtaaccttcgttacgtcgtaccgtcggcccggtaccggaccgtaccgggtccggttagttacgttaccgtaggtcggacggtactacgttaaccgtacggtacttacgtacggtcggaccgtaattacgcctaactacgtccgaacgtagttcgttacttttgaattcgtcggtcggggtaaaccgg

SEQ ID NO: 271108 - DNA, 594 bp, Homo sapiens
  misc_feature: GYAE6OF01BJPY5.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcacctagtggttatcactactggagctggatccgccacgccacccgaggggaacgggccgtgggaggtggagttgggtaacattactattaccggtgggacgtcaccttcgtaccaaccccgtccttacaagtacgtcgagtcacgatctacattacgactacgtactaagtaacctagttcctaccctagaacgtttacgaacttctaggtcgactcggaccgtcggacgaccggtccgttagtacttcgtaggtggcgctattactacgtatacgtaggtacggaccgtaataccgtaccaacctatccaacggtactcggttcttttagattaacgttccggtacgggggtaacccg

SEQ ID NO: 271109 - DNA, 606 bp, Homo sapiens
  misc_feature: GYAE6OF01C00OK.25.4.A04.1.454.CMB.1.raw
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaacgccttcacagaccctgtcccctcacctgcactgtctctggtcgctccatcaccagtgttatcactactggagctggactccgccagccacccgagggaacggcctggagtggattgggacatctagtttacggnggacncctaccgttctaaccaacccgttccctactaagtcgtccgaagttccaacctatctacgaattacgaacacgttactaaacgaacctacgttcctacccgtagtaacgtttcgaacttcgtgtacgactcggccgacgtacgacggtccgttagttactacgtgtcggtccggactagttaactaaccgtattaacgtaggtacgaccgtaatacgtccaaccgtactaccgaacgttatcgtttacttttagaatttacgtcgggtcgggtaaacccgg

SEQ ID NO: 271110 - DNA, 530 bp, Homo sapiens
  misc_feature: GYAE6OF01CF8UE.25.4.A04.1.454.CMB.1.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactgggtggagtcgtgggggaggcttggtacagccaggccggtccctgacactctcctgcacagcttccggactcacctttggtgagcatgctatgacctgggtccgccaggcctccagggaagggtctggagtggcttggggttcattagaagcgaagcctagtgggtggggcaaacacaatacgccgcgtctagtaaaaggcagattcagcctctacaagagatgattaccaaaagcaatcgacctatctgcacatgagtcagcctagagaagcgaaggacctcgagtccgtagttacttcgtgtttacttattactctagagtagtggttag

SEQ ID NO: 271111 - DNA, 771 bp, Homo sapiens
  misc_feature: GYAE6OF01CSXMK.25.4.A04.1.454.CMB.1.raw
tcagactgtacagtcacgaccggtgctcgatttagagtagtgatcagggaccggcctggctgtaccaagcctccccagccgtgagattcccaggagtctccacttggtgatcagcactgaacacagaccaaccaaccagtggagtttgggcttaactgttcttttccttgttgcttagtttaaaagtgtccaatgtgaggtgacaacgtgggtaggagtcggtgggggacgtcttggacaggccagggccccgggttccctggaactaccgttccttccgtgaccacgacgtaccgtttcccggaacttccgtaaccgtttttggtacgtacgtacctagttacgtaccttaagttccggtaccggttccgggggtcccgaccggtaaccgggtaccgtaccgggtaaacgggggtacgggtttcgtacggggtaacggttcgggtaccggttttacgggtactaaacggtttacggaaacggtacgtaaacgttcccgttaggtacgggtacgggaaccaaacgtacgtaaacgtcccggccgtacgtacgtaaaggtaaacggctaagtactccgacgacccgttacacgtaagacgtacgtagtaacctaaacgaaacgctaaccgtctaccgttatcgtacgaacctagacgtacggacgtacgtacgtacgtaggaaacgaggacgaacggtcacgtacgtccgttaagtttaaccttacgtttacgttaactttacgttaacgtggttagtaagttggttaaagg

SEQ ID NO: 271112 - DNA, 618 bp, Homo sapiens
  misc_feature: GYAE6OF01BICDT.25.4.A04.1.454.CMB.1.raw
tcagactgtacagtcacgaccggtgctcgatttagagtagtgatcagggggggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggagcttggtacaggccaggccggtccctgacactctcctgccacagccttccggactctacctttggtgagcatgctatgaccgtggtcccgccaggcctccggagggaggtctggagtggctttgggtcagttagaagtcgaagtccgtagtcggggtgggacaaacgacaacgtacgcccgtcgtcgtaaggtaaaacggcaagtacttcgagtcctctacaagagtatgtaacttaaccgaaaagcaacgtccgacccttatcgtcgaccacgtatggacgcacggacctggaacggacgtacggaggacctcgacggtccgttagtaactttacgtcgtttactttaacgtttcctacgtagtacggtaagttaggttaggtttaactttagttaacctttaacg

SEQ ID NO: 271113 - DNA, 730 bp, Homo sapiens
  misc_feature: GYAE6OF01A6I7B.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacacgaccctgtccctcacctgcactgtctcgtggtgctccatcactagtgttatcactactggagtctaggactccgcacgccgacccgaggggaacgggccgtgggaggtggagttggggtactagtcgtaagttaccggtgggactcctaaccttcctaccgaaaccccgttccctacgaaacgttacgtacgtacgtaccaacctacttctactattaacgactaacgttaactaaacgtaaccctagtttacccttacccgtaggttaaacgtttacgaaaccgtttcgtacggttacgtacccggttcggacccggtaccgggtaacccgacccgggttacccggttaggtttaacgtttaccgttacgggtacggtccgggtactaacgtttaaccgtaaccgtacgttaacggtacggttaccggaccgtaaacgttaacgtaccgaacccgttaacgtacccgtaaacgttacttacggtttacctttttacggaatttacgttcggggttacccggggtaaacccggg

SEQ ID NO: 271114 - DNA, 675 bp, Homo sapiens
  misc_feature: GYAE6OF01AYN3N.25.4.A04.1.454.CMB.1.raw
  modified_base (195)..(195): a, c, t, g, unknown or other
  misc_feature (195)..(195): n is a, c, g, or t
  modified_base (243)..(243): a, c, t, g, unknown or other
  misc_feature (243)..(243): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctggttgganacagaatcagcatcacttgccgggcgagtcagggcattagctaaattntttacgccttggtaactcaaacgaagaaacccgagggagtacgttcctaaagtcctccgttagactctagtcgctcgccttccacgttacacgtcgacgggtcccagtcgtacggttacacggcgactagtacgaacgtcgtagggacctaggtactacctaacctttccgttacctaaccgtttaactaccgtaacggtaacccaccgggtacccgttaccgaaccgtaccggtcccgttaaggaacgttacgtttaacggtttcggaaacctttaacgtttaacgtttaccgttacgttaaaaccgttaaaagtactttaaaacctccgttacccgttccccttacgttaccgtacggtttacccgggcgggtaacggtaaccggtaaggttacccgggaatacgaaacgtaaacggtacgtggtaacgg

SEQ ID NO: 271115 - DNA, 780 bp, Homo sapiens
  misc_feature: GYAE6OF01CG0LN.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatccctccctgtctgcatctgttgagacagaatcagcatcacgttggccgggcgagtcgagggctaagttagactaaatttacgtttaacgccgttaggtaacttaccgaaaacgaacggaaaacccggtaagggggtaacgttaacggtttacccgtaaacggtcccttaccgtaggtaactttccgttaagttccgtaccgttccgacccctttaccgtaacggtttaacccaccggttaccgggacccggggttacccctagttcccggtttaccggttaccgacgggaccggtacgtaacggttacggtaaacgttcgggtaacgggacgtaacggtacgttaccgtaccgtacctactacgtactacgtacgacacgtccgtcgtacgtacgtcgtacgtaagtagttacgtacgtaaccttaactttaattaaccccccgttaagttaaacgttaaaacgttaacttaacgttaccgttaccgttaccccttaccttaccggttaccggttaccgggtaaccgggtaaccgggtaaaccggtaaggggtaacggtaaacggtaaccgttaaaccggtaaaccgttaacggttacggttaaccggg

SEQ ID NO: 271116 - DNA, 740 bp, Homo sapiens
  misc_feature: GYAE6OF01CRX26.25.4.A04.1.454.CMB.1.raw
  modified_base (147)..(147): a, c, t, g, unknown or other
  misc_feature (147)..(147): n is a, c, g, or t
  modified_base (167)..(167): a, c, t, g, unknown or other
  misc_feature (167)..(167): n is a, c, g, or t
  modified_base (241)..(241): a, c, t, g, unknown or other
  misc_feature (241)..(241): n is a, c, g, or t
tcagactgtacagtcacgaccggtgctcgatttagagtagtgatcgagggggcagaagtctctctcagtcaggacacagcatggacatgagggtccctgctcagctccgtgggactcctgctgctgtcggctcccagactaccagtntgtgacctcagatcgacccngtcctccactccctccgtgtacgtcgcctagtcgtggtacggagacagatcagctagtctaggtccggccgggngacgtcgaggtctaagttacgactaagtttgtttacgaccgtggtaactaccgaaagtaacggaaacccgaagggtacgtacgttacctaagtcctaccgtagtattcgtaagtcgtcctcgtccccttaacctcgttaaaccgccggttcggaacccggggttcccagtttccggttaccggtcgtaacggccggtaacgtgaacggttacgtcggttaacgggacgtacgttacggttaccctacttaccgaccttaaccgttacgtaccgtaacgcgttaccgacgtacgacgtaaccggccgtttaaggaacgttagttggttaacccggtaactttaaacccgttagttaaccgttaaagttaaaggttaaacttacggtaaaaccttccgttacccgtacccttacgtacggtttaccgggtacggtaacgggtaaccgggtaaccggtaagggacgttaaccggaataaccggtaaaccgttgtggtaaccg

SEQ ID NO: 271117 - DNA, 845 bp, Homo sapiens
  misc_feature: GYAE6OF01CYRXE.25.4.A04.1.454.CMB.1.raw
tcagactgtacagtcacgaccggtgctcgatttagagtagtgatcagggtctgtgaaggcttcaccagtcctggacctcctgtgcaagaacatgaagcacctgtggttcttcctcctgctggtggcggcgcccagatgggtcctgtcccagctgcgtctgcaggagtcgagcccgagggcaggtgaagccttcggacgaccctcgtccctcacctgcctctcgtctcgtggtcgtacctcctactaccaaccgtaagttaacgtcgtacctacgttaacgttacgggtcggggtcgttccggcccgtcccggaccgaccccggaccccgggaagggggaccgggtccggtagggtaggttacggtacgttcggtacggttagttttcgttaccgtttacgaaggtttacggggtacgggtacgttaccgttaacccgttaaccgtaaccgttaccccgtttacccccgtacccgtaacggtaaacggtaccggttaccggtaaccgttaacccttaaccgttttaccgggttttaccggtaaccgtaacccgtaccccggttacccgaacggtacgtacggttaccgtttacgggtttcttacccttacggtaactaacccgtagtaccggttaccggttcgtaccggtacccgacccggggtccccgaccggtaacccgacgggtttccccttaatttaccggttacggtggtacgacggtaagtacgccggaacgggtacccggtaaacccctaaaccctaccctaacccggtttagtacccggacccggttacgggcccgggtaaacggaaccggtcccgttagtccccacgtccctaccgg

SEQ ID NO: 271118 - DNA, 791 bp, Homo sapiens
  misc_feature: GYAE6OF01BNTWH.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgaccgtcagatcgacccagtcctcctactccctcctgtcctgcattctggttaggacgacagaactcagctactctacgtcggccggtacgaggtcgagggtactagttacgtactaaagttttacgttacgtccgttagggtaaactaccgaaaacggaaacggtaaacccgagggggtaacgtaaccgtttaccgaaggtccctacgttagtaacttctagtccgtccgtcgtacccctaaccgtaccgttaccgaaccgttaccggtacccggggttaccctgttaccggtccggttacgacggtccggtacgtaggttaacgtaacgttcggtacgggtaactacggttacgttccctaacgttcaacgttctaaacctcggaacgttaccaccggttccgtacgaccgtaaccggttacgtaaggtaacgggtttattcggtaacttaaaccgtttaacgttacgtttaaacggtaagttaaaaacctaacggttaactaaccccgttcgtaaccccggtttaccccttacggttacccggttacggggtaaacccggggtaaccgggtaccgggaaaccgttaagggtaaccgggttaaacaaaccgttaaaccgggaaacgttaccgggtcgtaaccgg

SEQ ID NO: 271119 - DNA, 760 bp, Homo sapiens
  misc_feature: GYAE6OF01BEN7I.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtagacgtccagatcgacccagtctccatccctcctgtctgctatcgtggttagagacagtaactcagactatcctaacgttgggacccggggcaggtccgaaggggtcctaagttaacggtaactaaacgttttaattaccggtaccgttagggttaactaaccgaaaaccgaaacggtaaaaccccgaagggggtaacgttaaaccgttaccctaaaacggtccgttaccgttaagtactacgttaacgtccggtactccggttccctaaccgtaccgttacgaaccgtacggtaccgggtccctacgtccgtttacggttcgacggacggtactaggtaacgtagtcggtaacgggtactacggttacgttcccgtacgttaccctactaaccgttagtaccctacggtaccaccggttccgacgttccgaacgtaccggtaagtacgttagtacgttaccggaactttaacgtttaacgttaacggttactaaaccgtaaagttactaaacttccgtacctcccgttacgttaccgtaccgggtttacgggaccggtaacggaaccggttaagtcgggaacgttacaaccgtaaacggttcgcggttaaccgg

SEQ ID NO: 271120 - DNA, 652 bp, Homo sapiens
  misc_feature: GYAE6OF01AJS6H.25.4.A04.1.454.CMB.1.raw
  modified_base (210)..(210): a, c, t, g, unknown or other
  misc_feature (210)..(210): n is a, c, g, or t
  modified_base (305)..(305): a, c, t, g, unknown or other
  misc_feature (305)..(305): n is a, c, g, or t
tcagactgtacagtcacgaccggtgctcgatttagagtagtgatcagggggcagaagtctctctcagtcaggacacagcatggacatgagggtccctactcagctcctgggactcctgctgctctggctccagataccagatgtgaccgtccagatcgacccagtctccatccctccctgtctgctatcgtgtaggagacagaatcagcntccacgttcggccgggagagtcgagggctagtagactaattattacgcgtagtatacgaacgacgaaacgaggagtacgttacagtctctgtatntagtcgtcgtctccctactacgtactacgtacgacggtccctacgttccgtacgttcgacggcgtacgtagtacgtacgtcggtaggacgtacgtcgttaccaccttccaaccgttactacgacgtacgacgcgtaccctacgaccgtaccgtacgtacggtagttcgtacgtttactaacgtttaaccttattaacgtaagtaaacttaaagttaactaaccgttacccgtaccgtacccttaccgtttaacccgtaccgggttaccggggaacgggtaacggtaacccggtaagggtacgtaaccgtaacgttaaacgtaaccgttacggtcggtcgggtaaccc

SEQ ID NO: 271121 - DNA, 710 bp, Homo sapiens
  misc_feature: GYAE6OF01C0HOT.25.4.A04.1.454.CMB.1.raw
  modified_base (647)..(647): a, c, t, g, unknown or other
  misc_feature (647)..(647): n is a, c, g, or t
  modified_base (686)..(686): a, c, t, g, unknown or other
  misc_feature (686)..(686): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagttggcttaactgttcttttccttgttgctagttttaaaaggtgtccaatgtgaggtgcaacgtggtggagtcgtggggagcgttggtacagccaggcccgtccctgacactctcctgcacagccttccggactcgtaccgttttggagagcagtcgactatcgacccgtgggtcccgccgaggcctaccgaggggtaacggtcgtagggacgtggtcgttgggtccaagttagacgtacgaagtaccgttagtgggtacggggacaaaccgaacgaactaaccggccgtaccgtacgttaaggtaaaacggacgtacgtacttacgacggtacccttacgtacgtaaacgtaaggtaactacgttaaacgtttaacccccgtaaaaagtacccgtaacgttacccgtaccccgtttacgttaccttacggtacccaaacgtagttacggaacgacgtacgacccgtagggacggaaacgaccggtaagaccgtcgtaacggacccggtttnttaacgttttacgttctttacgtttagttacctttacgnggttaaacgtggtttaaggtttag

SEQ ID NO: 271122 - DNA, 778 bp, Homo sapiens
  misc_feature: GYAE6OF01A8DCF.25.4.A04.1.454.CMB.1.raw
  modified_base (217)..(217): a, c, t, g, unknown or other
  misc_feature (217)..(217): n is a, c, g, or t
tcagactgtacagtcacgaccggtgctcgatttagagtagtgatcagggggcagaagtctctctcagtcaggacacagcatggacatgagggtccctgctcagctccgtgggactcctgctgctctggctcccagataccagatgtgacgtcagatcgaccagtctccatccctcctgtctgctatcgttggttaggacgtaacgagaactcgaacnctaacttcgtacgttccgggccggggacgtaaggtccggagggctaagttagacttaatttacgtttaggccttaggtactacgaaacgaacggaaaccggaagggacgttacgttaccgtaacgtccttaccgtgtaacgttactgtacgtccgtcgtacccttacccgtaccgttaaccgaccgttacgtacccggggttcctacgttcgttccggttcgacggtcggacgtgtaacgacgtcggtacgggactaacggtcttacctaccgtacctaactacttactacgacggtacctaccgtccgtggacccgtacgtaccgtagtaacgtacggttacgttacgtaacttttaacgttaactttaacgttaacgttaaacgttaaactaacgtttaacgtaccccgttaccgttccccgttaaaccgtttacccggtttaacccggggttaaccggggacccggggttaaccgggttaaaccgggtaacggggtaaacgggtacgggttaacccgttaaaaccgggttaaaccggtacgggttcgggtaacccggg

SEQ ID NO: 271123 - DNA, 832 bp, Homo sapiens
  misc_feature: GYAE6OF01CSN2B.25.4.A04.1.454.CMB.1.raw
  modified_base (219)..(219): a, c, t, g, unknown or other
  misc_feature (219)..(219): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctcccagactaccagatgtgaccgtccagtactcgacccagtcctccaacttcctccctgtctgctatcgttgttaggagacagtaatcanccatcaacgttcggccgggcgaggtcgagggtctaagtacgactaagtttatttacgcgtagtactacgaaacgaacgaaacgaggggtactacgttacctaagtcctacctagtacttaccgtagtcgtaccctctaccccgttacctaaccgtttacgacgtaccggtaccgggttcccattcccggttcggtacgacggtcggtacgtaacgtacgtaacgttcgggaacgggtaccgtaaacggttaccgtttacccgtaactttacccttaacccggttaaacttacggttaaacctcgggaaacccgtcccggtacccgttccggaaaacgttccggtaccggttttaggaaacgttacggttttaccgggttttaaccaaccttttaaaacggtttttaaccggttaaacgtttaaagttaaacccgtaaaaattttagttaaaacccttcccgggttaccccttaccccgtttacccggttcccggtttaaaaccgggggtcggggtaaaccccggggttaacgggtaaacccggtagggggttaaaaccgaaccgttaaacggtaaaaccccggtacggttaaaccggttgggttaaccccggg

SEQ ID NO: 271124 - DNA, 752 bp, Homo sapiens
  misc_feature: GYAE6OF01EIVV1.25.4.A04.1.454.CMB.1.raw
  modified_base (726)..(726): a, c, t, g, unknown or other
  misc_feature (726)..(726): n is a, c, g, or t
  modified_base (744)..(744): a, c, t, g, unknown or other
  misc_feature (744)..(744): n is a, c, g, or t
tcagactgtacagtcacgaccggtgctcgatttagagtagtgatcgagggggcagaagtctctctcagtcaggacacagcatggacatggagggtccctgctcagcctccgtgggactcctgctcgctcgtcggcctacccagactaccagtatgtcgaacgtcagatcgaccctgtcctccactccctcctgtctacgctatcgtggtagagaacagtactacagactactaccgtacggttcggccgggtacgtacggtcgagggtactaagttaaccgtaattaaatttagttaccgaccgttaaggttaacaaccgaaaagtaacggaaaacccggtagggtaacggtaccttaaccgtaacggtcctttaaccgtagtaacttcgtactcgtccgttacccgtaccccttaaccggtacctaaaccgcccggttaccggtaaccgggtcccctaaggttcccggttaggtaaccgcgtacgggaataccggtaagtacgtcggaagggtaacaggttcttacccctaatccttaaactaaccgtagtaccaacggttactaaccgccggtaccgtactacgtaacggtaagttaggtacgttacggttaccaaaccgtttagtttaactaagtaacgtaaacttaaagtactttaaccctaggtccccttccttaacgtaccgggttcgtacgggacggtaaggaaccggtagggtacganaaccgtaacggaaactgnggtaaccg

SEQ ID NO: 271125 - DNA, 631 bp, Homo sapiens
  misc_feature: GYAE6OF01DEQEM.25.4.A04.1.454.CMB.1.raw
  modified_base (546)..(546): a, c, t, g, unknown or other
  misc_feature (546)..(546): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcaacgttggccgggcgagtcagggcagttagcaatttatttacgcctggtaatacaaacaaggaaaccgaggggaagtagttacctaaggtcctacctgtaattctaagtcgactcgacccttaccaccgttaacacctcgacggggtcccattccgtcggttacgaggcggcgtagtacgaaagtcgtacgggactaacggttaacggttcctaacctctacacttaataccgtaaggaccacggtccttcggaccgtacgtaccgtacggaagttaccgttgtttacggtacctaaacgtttattacgttagtaactaaaagttactaataccgtcncccgtctacgttaccgtttcgggacgggtacggaaaccggtaagggtacggtagtaacgtaccaaaacggtccgttggtaccggg

SEQ ID NO: 271126 - DNA, 734 bp, Homo sapiens
  misc_feature: GYAE6OF01CRUJE.25.4.A04.1.454.CMB.1.raw
tcagactgtacagtcacgaccggtgctcgatttagagtagtgatcgagggggggagaggagccccagccgtgagattcccaggagtctccacgttggtgatcagcactgaacacagaccaccaaccagtggagtttgggcttaactgttcttttcttgttgtcttagttttaaaggtgtacaagtgtggaggtgacaagtggtggtagtcggtagggggagtcgttaggacacgccgacgggtcccggtcctagaccaccttcctcctgaccacgtagtccgttaccggacttccgtacgtttggagtacgcgtagtcgtacttagtcgtaccggttcgggacccgacgtaggtccgtaccggaaggggtacggtcgtaggtggtggtacgttggtactaagtaacggaacgcgaacgtcgttagggtgggtacggaacaaacgaacgaacgtaccggccggtacgtagtaaacggttaaacggctaaggtacttaccgaacgttcccttagaacgtaaagggtaactacggtacttaaaccgtttaaaccgaaaggtctaacgtacccgtactagtcgtacacgaataggtacgacgaccgtagacccgtagggaacgtaaccggaggacggttaccaacggacggttaccgttagttaacctttacgttgtttaccttacgttactacgttagacgggtatttaagggttatttaacttaattaccttaacg

SEQ ID NO: 271127 - DNA, 821 bp, Homo sapiens
  misc_feature: GYAE6OF01C4K37.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgagccttcacacgaccctgtccctcacctgccactgtctcgtggtcgctccatcacctagttgttactcactactggagctaggactccgccacgccacccggaggggaacggccgtagggtaggtaggtagtttacggggtaactacgttacgttaacgttaccgggtagggacgtacctaacccgtttaccgtaacccctaacccccggttcccttaaccgtaaacgttaccggtaccgtaaccgttacccaacccgtacctaccttacctaatttaaccggaaccgtaaccgtttaccgtaaacggtaacccttacggtttaccctacccgttaagttaacgtttacgtaacttacgttgtacgtaccgtccggtacccgggaccggtaaccgtaccgggtaccgtttaggtttaaccgtttaccgtggttacccggtaccggttaccgtaacgttaaccgttaaccggttaattaacccggttagggttaccgggtaaaccccgttaagttaaaccgttacccgtaaaccccttaccgtaaaccgttacccggttaaacgtttccggttttaaccggttttttacgaacgtttaccgggtttacccgggtaacgggggggtaaaacccccgggg

SEQ ID NO: 271128 - DNA, 860 bp, Homo sapiens
  misc_feature: GYAE6OF01EJGAR.25.4.A04.1.454.CMB.1.raw
tcagactgtacagtcacgaccggtgctcgatttagagtagtgatcagggtctgtgaaggcttcaccagtcctggacctcctgtgcaaagaacatgaaacacctgtggttctccctcctgctggtggcagctccagatgggtcctgtcccaggtgcagctgcagggagtcggggcccaggactggtgaagtccttcaactacgaccctcgtccctcacctgcactgtctcgtggtcgctccatccacctaggttgttatcctaactacgtggaagtcgtacgggactcccgaccgacgcccgaacccggtaagggggaacggccgttaggggacgtggggtaagtttggggtaacctagttaccgtttaacggtttacccgggtggggtaactcccttaaccctttacccgtaaaccccgtaacccccggttccccttaacgtaaaacgttacggtaccggtaacgttacccaaacccgtatttcccgtacttaacgttaaccggaaacctaccggttaaccttaaaacgtaaccccttaacgttttcccgtaccccttaaagggttaacgttaacgtaaccttcgttacggtacgtaaccgttccgggcccggtaaccgggaacccgtaccggggtccccgtttagtttaaaccgttcggtacggtcgggaccgggttactaaacgttaacccgttacggtaaaccgtttaccggtaacgggttacggtaccccggttaaatttacccgtaaaccttaccccttaaacggtcccggtaaaaccgtttaagtttacccggttttaccgttttaaggaaacccttttacgggttacccggggtacgggggggtaaaaccccg

SEQ ID NO: 271129 - DNA, 732 bp, Homo sapiens
  misc_feature: GYAE6OF01EXJ53.25.4.A04.1.454.CMB.1.raw
  modified_base (580)..(580): a, c, t, g, unknown or other
  misc_feature (580)..(580): n is a, c, g, or t
tcagactgtacagtcacgaccggtgctcgatttagagtagtgatcagggggcagaagtctctctcagtcaggacacagcatggacatgagggtccctgctcagctccgtggactcctgctgctcgtggcctcccagactaccagatcgtacgaccgtaccagtactcgaccctagtcctccacgtccctcctagtctgctagttcgtggttaggacacgaagtaactccgacgcctattaccgtacgttcgggaccgggtacgaggttaccggaggtacctaagttacgacttaatttcgttacgccgttaggtactaccgaacgtaacggaaaccgagggtaacgtaccgtttacccgaagtcccgttacgtagtacttacgtactcggtcctacgtaccccttaccgtaaccgttaccgccggtacggtacccgggttcctacggttccgttcggtaccgcggtacgacggtaacgtacgtacgtacgggtacgggaactacggtccttacctcgttaccacgtactagtaccggacgtccgacgtaccgtcggaccgtaccgtagtaaggaaccgtnttaacgttcctaaactttaacttgtaaccgttaattaacgttaaacgtcttaacctccggttccctaccccgtagttaccgtacggggtaccgggagggtaacacccggtaagtaacccggataaacgttaacgaacggttgtccgtaacgg

SEQ ID NO: 271130 - DNA, 707 bp, Homo sapiens
  misc_feature: GYAE6OF01CT5UQ.25.4.A04.1.454.CMB.1.raw
  modified_base (589)..(589): a, c, t, g, unknown or other
  misc_feature (589)..(589): n is a, c, g, or t
  modified_base (647)..(647): a, c, t, g, unknown or other
  misc_feature (647)..(647): n is a, c, g, or t
  modified_base (677)..(677): a, c, t, g, unknown or other
  misc_feature (677)..(677): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtccgggcccaggactggtgaacgcccttcaacacgtaccctcgtccctcacctgcctactcgtctcgtggtcgcctccatccaccgtaggttgttactcctaactacgtggacgtcgttacggactcccgacgaacgcccaacccggagggggaacgggtccgtaggggaggttcgggtaacgtttcgggtaacctaacgttcgttaacgttaccgggtagggacgtaccttaaccgttacctaccccgtaaccccgttcctaactaagttacgttaccggacgttaccaccctattcctacgtaagttacgaacctacgttactaaaacgtaccgttcgttacctaccgtaagtaacgttacgtaacttcgttgacctaacggtccgccggtaccggaacgtaccggtcttagttacttcgngtcgacgtactaacgttacgtaagtacttaacgtaggtcgactaagttccaaccctanacgttccaagttccgttatttaccgtttanaccgttagtcccgggtaagggtaaaccggg

SEQ ID NO: 271131 - DNA, 884 bp, Homo sapiens
  misc_feature: GYAE6OF01AX7TL.25.4.A04.1.454.CMB.1.raw
tcagactgtacagtcacgaccggtgctcgatttagagtagtgatcagggggggagaggagccccagccgtgagattcccaggagtctccacttggtgatcagcactgaacacagaccaccaacatggagtttggcttaactgttcttttccttgttgcttagttttaaaaggtgtccaatgtgaggtgcaacgtgggtggagtcggtgggggaggtcgttggtacagccgagggtccggtccctgacactcctcctgcacgacgtccttccggactcctaccgtttggtgagcagtgacttagtcgaccgtcgggtcccgcccgaggtccgtaccggaagggggtaacgggttccgtagggtagggttacgggtcggttttacggggtttacctaaggtttaacgggaaacggtaccgggaaacgtcccggttaagggttggggggtacggggaaccaaaacccgtaacgtaaaccgttaacccggcccggtaccggttaacgtaaacgggtaaaaacggctaagtacgttacgacgtccctactacgaaaggtagtaactacggtaaacttaacccgaaaagtcctaaacgttcccgtaccttacgttaccgtacgacctaacgtaagttaccggaacgtacccgtaacgggttacccgtaagggaaacgggaacgggtaccgtaaccgggtacccgttaaccggtaccgggttacccggtttaagttttaaccggttttaaccgtttaccggtttttaaaccgttttaacggtttaaacccgtttaccgggttaaacggttaacggggtttaaacgggttttaacgggtttttaaagttttttaaactttttaaacccggttttaaccttttaaaaacccgg

SEQ ID NO: 271132 - DNA, 620 bp, Homo sapiens
  misc_feature: GYAE6OF01EF69L.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtccagatgacccagtcctccatccctcctgtctgcatctgttggacgacagaatcagcatcacgttggccgggcgagtcgagggcattagactaatttatttacgcctggtatacaaacaacgaaaccgagggacgaacgttacctaaacggtcctaccgtgacttcctaatcgtctcgtcccttacctaaccgttacaccgtaccgacggggtacccacgttcgtcggttcgacggcggtaccgaggttacggaacgttcggtaacgggactaacggtacgtttaccacttcctactaacttatcctacgcacgcctgccgagcctagagtagttagtcgaacttaacgtttattaacgttacgtaacgtaaattaactaactacctcgtcccttacgtacgtaccggtttcgggacgggtacgggaccgtaagggtcgaacgtactaacgaaacgtacgtggtaccgg

SEQ ID NO: 271133 - DNA, 833 bp, Homo sapiens
  misc_feature: GYAE6OF01DJDXC.25.4.A04.1.454.CMB.1.raw
tcagactgtacagtcacgaccggtgctcgatttagagtagtgatcagggggcagaagtctctctcagtcaggacacagcatggacatgaggtccctgctcagctcctggactcctgctgctctggacctcccagcctatcagatggtgcatccagatcgacccagtctccatccctcctgtctgcctatcgtagttggacaaccgaggtactccaacctgtctaacgtttcgggccggtacgtagtccgagggtctaaggttaggtaaatttacgtttcggccgtaggtaactccgagacctaacggaaaaccgaacgggttaaacttacccgtaacctccttacgacttactacgtacgtcctacgctaaacgttcctacgtttagtccttaaggtttccgggttacccgtagttccgtaaactttccggaaacgtccggcggttaacgggttccgggttcgtacgggggaactacgggttaaaactttcccgtacccgttaccgttaccaaaccgttacttaccgaaacggttccgaacccgttcccgtacgtaacccgtacgtacccgtaaggttaaggtaaccttggtttaccgtaaacgttaaccgttttaacggttacgttaacgttaaaccgtttaaagtttaccggtaacgttaacggggtttaacccggtaaccggttaccgggttaaccgtttacccggggtccccgggtttaaaccccggggaaccgggttaaaacccgggtaacgggggtaccttaaaaccccggtaaggttaaaaccccgtaaaccgggtttaaccccgtgggtttacgggttaaacccc

SEQ ID NO: 271134 - DNA, 745 bp, Homo sapiens
  misc_feature: GYAE6OF01C2IEZ.25.4.A04.1.454.CMB.1.raw
tcagactgtacagtcacgaccggtgctcgatttagagtagtgatcgaggggggcagaagtctctctcagtcaggacacagcatggacatgagggtccctgctcagctcctgggactcctgctgctctggctcccagataccagatgtgacgtcagatgaccagtctccatcctccctgtctgcatctgttggagacagaatcagcatcacttcggccgggcgagtcgagggtccattacgactaaatttatttaacgccttaggtaatacgaacaaggaaaaccgagggagtaacgttcctaaaggccttaccgtgattcgtaatggtactcgacctccgtaacgttacctcgtaccggaacggggttccccaacggttccgttacggttacgacgggaccggactacggtaggaaaccgttacggtacggggaacgtaacgtacggtttaccaaccgttacttacctacccgttaataccgtaacgaccctacgtccgtggtaccaacggtcccgtttaagggaacgtagtttcgggttaacgtacccttaaacggttttaacgtttaacccgttaaggttaaaaccgttaaaaaggtttacttaaacgttaaacccgtacccgtacccccgtttattaacccggttaacccggttttaccggggacgggttaaaacccggggaacgttaacggggtagtaacgggtaaactaacggtaaaaccgtaggttacggtaacccggg

SEQ ID NO: 271135 - DNA, 987 bp, Homo sapiens
  misc_feature: GYAE6OF01BVE66.25.4.A04.1.454.CMB.1.raw
tcagactgtacagtcacgaccggtgctcgatttagagtagtgatcagggggagctctgggagaggagccccagccgtgagattcccaggagtctccacttggtgatcagcactgaacacagaccaccaaccatggagtttgggcttaactgttctttttccttgttagcttagttttaaaaggtgtaccaagtgtggaggtgacaacgtgggtggaggtcggtggggggaggtcgttgggtaacacggcccgacggggtcccggttccctaggaacctaccgttcctccctggacctaaccgacggtcccgtttacccggggtacctttacccgtttaacccggtttttggggttacggaaacggtcctaaacgttcggtaacctttaacgttaccgggtaaccccgggtttccggggggtaccccggtacccggaacggggttacccgtacccggggaaaggggggggttaaccggggtttccgggttagggggtaacgggtttcgggtttaccgggttttagggggttttacccgtaaaaggtttaaacgggaaacgggtaccggtaaacggtaccggtttagggttcggggggtacggggaaccctaaaaccgtaaccgaacggttaacccgggcccggtacggtttacgtaaagggttaaaaacggcgtaaaggtactttaaccgacggtaccccttacggtaaacgaaagtaacggtactacgggtaaaccttaaccgaaaaacggtcctaacgttcccgtaacccgtttacgttaccgacgtaaccctaaggaacgttacggacggtaccgtacgtaacccggtagggaaaccgaacgggtacgggaaccggttaccttaccgggtaaccgggttaccggtttaagtttaacgttttacccggtttacgttttaactttttaaaccgtttacgttaccgttaaggggtaacggtttaaacgggtttcggttttaaacgggg

SEQ ID NO: 271136 - DNA, 840 bp, Homo sapiens
  misc_feature: GYAE6OF01AZYAS.25.4.A04.1.454.CMB.1.raw
  modified_base (784)..(784): a, c, t, g, unknown or other
  misc_feature (784)..(784): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctccagatcgggtcctgtccgaggtgcagctgacgaggaggtccgggcccaggtacgtggtagaacgtccttcaccacgacccttcgtcccctcaccgtcgcctactgttcctcgttgggtacggtcctcctacgtcctaaccgtaggttcgtttactaccgtaacgttacggtcgggacgtcgttagggaacctcccggaccaacggacccgaacccgggaagggggacgggtccgtaggggtacggtacgggtaggtttacgggtacacgtttcgttaacgttacccgggtagggactcccttaacccgtttacctaacccgtaacccccgttacctaacgttaacgtacggtaccggtaaccgtaccctaacctaactttaccgtacgttaacgttaacccgaacttaccgttaaacgtaaccgttaaccgttcgttttaccctaccggttaaacgttaaacggttactaaccgtttacgggttcctaacgggttccgtacccgggacccggtaaccggtacccgtacgggttaccgtttagttaccgtttacgtcgggttacggccgtaacttaccgttaacgaaccgttacggttactccgggtacgtaacgtacttaccggtacccaacgttcgtaaaccgttacggttntttaccggttttacttagggttaccctaggggttacccgggttcgggggaaacccg

SEQ ID NO: 271137 - DNA, 709 bp, Homo sapiens
  misc_feature: GYAE6OF01AFCW5.25.4.A04.1.454.CMB.1.raw
  modified_base (193)..(193): a, c, t, g, unknown or other
  misc_feature (193)..(193): n is a, c, g, or t
  modified_base (411)..(411): a, c, t, g, unknown or other
  misc_feature (411)..(411): n is a, c, g, or t
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatcgacccagtctccatcctccctgtctgtatctgtgganacagaatcagcatcacgttcggccgggtcgaggtcgagggctaattagactaatttagtttagcccttggtaactacaaaccgaacggaaaaccgaggggtaacgtacggtttaccctaaacggtccttacccgtaggtaacttcttaatcgtccttacggtccctacccttaacgttaccaccgtcggtacggggtccctagttccgtcggttaacncggcggtactaggtagaagtccggtagggtacacggtagtttacccacttcctactaaccgttatacgaacgaccgtacgtaccctggaccaccggtaccgtaggtaaacgtagtttcgtacgtaacttaaaccgttttaagttaacgtttaacgaaacttaaaacgttaactaaaccttaccgtcccgtaccccgttcgttacccgttaacgggttcccgggtaacggggtaacggtaacgggtaaacggtaacgggtactaaacggtaacctaaaacgggtctgggtactacccgg

SEQ ID NO: 271138 - DNA, 759 bp, Homo sapiens
  misc_feature: GYAE6OF01E3529.25.4.A04.1.454.CMB.1.raw
  modified_base (325)..(325): a, c, t, g, unknown or other
  misc_feature (325)..(325): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgtcttttccttgttgcttagttttaaaaggtgtccaatgtgaggtgcaacgtggtggagtcgtggggggagcttggtacagccagggcccggtccctgaccacctctcctgccacagtccttcccggacttcctacccgttttgggtgagcagtgctatcggaccgtcggggtcccnccgaggcctaccggaggggtaacgggtctggggagttcgggtcgtttggggttactagttaggaacgcgaaacgtcctaaggtggggtcggggacaaacgactaacgtaccggcccgcgtactaaggtaaaacggcaagtacttccacgccctatacgaagagattcgaacttaacccgaaaagcctaacgtcccgtaccttacttccgtacgacctaacgtaagtacggacgaccctacggtacccgttagggaaaccgggaaacggtacccgggaaacgggttaaacctacccggtaacgggttacccccgggtttaaggtttaaaccctttttaacccgggttttacgtttttaaaccccttttttaacgttttaacccgttacgggttaaagggttaaggtttaaacgggtttaagggtttttaaacggg

SEQ ID NO: 271139 - DNA, 573 bp, Homo sapiens
  misc_feature: GYAE6OF01BZ2W6.25.4.A04.1.454.CMB.1.raw
  modified_base (254)..(254): a, c, t, g, unknown or other
  misc_feature (254)..(254): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggccaggactggtgaagccttcacagaccctgtccctcacctgcactgtctctggtggctccatcacagtgtatcactactgganctgatccgcagcaccgaggaaggcctggagtggattgggtacatctattacggtgggagctaccttactaaccgtaaccccgtcctacaaatacggtcgaacgtacaccgatctactattaacgactacgtactaagaacctagttcctaccgtagtaagttacgtaactcgtgtcgtacgtcgccgacggacacggtcgtacgttaacttaacgtgtcggtcggactaacgtaaccttacgaactaaccgtaggtacggaccgtaagtactccaacctatcaacgtatcgttcttttagattagtcgtggggtaaccg

SEQ ID NO: 271140 - DNA, 798 bp, Homo sapiens
  misc_feature: GYAE6OF01DPIFJ.25.4.A04.1.454.CMB.1.raw
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtcagatgacccagtctccattcctccctgtctgcatctgttggacgacagaatcagcatcacgttggccgggnagtnagggctatagactaatttattacgcttaggtactacaaacgaaggtaaaccgagggtatacgttacctaacgctaccgtagtatcttaagtcggtctcgaccctacctacgttaccacctacggtaccggggtaccctcgtaccggtcggttaccgacggtacggtaccgaggttacgtaagttccggtaacgggtacgtaaggttaccgttaccttaaccgttaccgttactaaccgtttacaccggtaaacgtcccgaacgttcccggacgtaccggtaaccggtaccgttaaagggtaaacggttggtttaaccggtttaacgttaaccgtttaaacccgttttaaacgtttacggttaaaccggtttaaacccgttaaaaaagttttacgtttaaaaccctttaacccggtttacccgtaaccccccgttacccgttaaccggtttaaaccccggggttttaccggggaacccgggggttaaaccgggtaaaccggttaaacggggttacgggtaaaccggttaaccgttaaaccggtaaaccgttacgggttcgggttaacccgggg

SEQ ID NO: 271141 - DNA, 757 bp, Homo sapiens
  misc_feature: GYAE6OF01EQ6AL.25.4.A04.1.454.CMB.1.raw
  modified_base (198)..(198): a, c, t, g, unknown or other
  misc_feature (198)..(198): n is a, c, g, or t
  modified_base (521)..(521): a, c, t, g, unknown or other
  misc_feature (521)..(521): n is a, c, g, or t
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtcagatcgacccagtcctccatcctccctgtctgcattctggttgganacagaatcagcaactctacgttcggccgggacgtaggtcgaggggtcaattaggtactaagtttatttacgacctggtatacaaaccgaagaaacccgaggggaagtacgtttaccgtaacggccttaccctggacttaccgttagtcgacgttcctaccccgttaaccctaccgttaccgtacctaccggtaacggggttacccctagtttcccggttacggtttaccgacggcgggtaaccgtaggttaacggtaacgttcggtacgggaacctaggtacgttacctactacgttacaacttacgtcacgaccacgtccgnggacctacggtacctagggtaacgtaggtttactaccggtaactttaaacgtttagtttaaacccgttaaggtaaaacgtttaaaacggttaaacttaaaccgttaccgttaccccgggttacccttacccgttacgttacccggggttaccggtaacgggggtaaccggtaaaccgggtaagggttaacggtaacgtaaacgtacccggtaaaacgttcggtcgggttaaccggg

SEQ ID NO: 271142 - DNA, 683 bp, Homo sapiens
  misc_feature: GYAE6OF01CBXMV.25.4.A04.1.454.CMB.1.raw
  modified_base (280)..(280): a, c, t, g, unknown or other
  misc_feature (280)..(280): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtctttttccttgttgctgttttaaaaggtgtccaatgtgaggtgcaactggtggagtcgtgggggagcttggtacagccaggccggtcctgaccactctcctgcacacgcttccggactcaccgtttggngagcatgctatcgacctgggtccgccgaggcctaccgaggggacggtcgtggacgtggtcgttgggttcagttagagcgaagcctagtggtgggacaacacaagtacgccgtcgtactagtaaaacgggctaagacttacgacgtccctacgtaccgaaaggtaagtacgttacgaactttacccgaaaaagtcctaacgttcccgtacccttatccgttacggacctaacgtaagttacggacgtaccgaacggtacccgtagggaacggaacgggacgggtaaccggtacccgttaccggacggttacccggtttaggtttaaccttttacgtttccgttttactttaaccgttttaccgtccggttaaggtaacgggttaaggtttagggttttaaacgg

SEQ ID NO: 271143 - DNA, 738 bp, Homo sapiens
  misc_feature: GYAE6OF01BIRSW.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctcccctcctgctggtggcagctcccagatgggtcctgtcccaggtgcagctgcagggagtccggggcccagggactgggtagaaacgtcccttacacgacgaccccttgtcccctcaccgtgccacttgtctcgtgggtcgacctccatcaccgtagttgttatcactacgtggagcgtcggactccgcacgaccaacccggaggggaagggtccgtaggaggtcggtagttcgggtactagttacttacgttaccgggtagggacgtcctaacccgttaccaacccgtaaccccgttcccgtaactaacgttacggtacgtaacgtacctaacctacttccgtaactaacttaaccggaacctaaccgtaacgtaaaccgtaacccgttaaccgttcccttaaccgttacgtaaacgtttacggaacttcgtacgtacggtacgtccggacccggtaccggaaccgtcccgggtacgttagttacgttacgtcggttacggaccgggttactaacgttaccgtaacgttacgtaacgttcgggacgtaccgtactactccgtaacctactacgtaccgtagttaccgtttatttacgagttacggtccggggtaacgggtaacccggg

SEQ ID NO: 271144 - DNA, 633 bp, Homo sapiens
  misc_feature: GYAE6OF01C4ZNS.25.4.A04.1.454.CMB.1.raw
  modified_base (169)..(169): a, c, t, g, unknown or other
  misc_feature (169)..(169): n is a, c, g, or t
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
  modified_base (457)..(457): a, c, t, g, unknown or other
  misc_feature (457)..(457): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagactaccagatgtgacgtccagatcgacccagtccnccattccctccctgtctgctatctggtgganacaggtntacacctatcgacttcggaccgggtcgagtcgagggtctagttaggtaaactttagtttcggaccttaggtatcgagacaaggaaaccgaagggtaacgtttacccctaacctccgtacacttcattcgcctagcctactcctactttggaccttaacgttttcggggtcccctactcgtacttcgacggtacggcgtaggtgggtctagggacaagtactnacctcncacctatnagcacgcctgctanccgttagaagtgttagtcgtaacttaactttaattaacttaagtaaacttaaattcgaactacggtacgtacccggtaaggtacgtcgggtacccgtaaccggtaaccgggtaccggtaaaggtacggaacctaagtaaacccaaaccggtaaactcggtaacggccgttcgaacc

SEQ ID NO: 271145 - DNA, 715 bp, Homo sapiens
  misc_feature: GYAE6OF01BN6WZ.25.4.A04.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
tcagactgtacagtcacgaccggtgctcgatttagagtagtgatcgagggggcagaagtctctctcagtcaggacacagcatggacatgagggtccctgctcagctcctgggactcctgctgctcgtggcctcccagataccagatgtcgacgtccagactcgaccctagtcctccacttccctcctgtctgctatcgtgtagganacagaatcagctatctacgttcggccgganagtcgagggactaattagtacttaagtttacgttacgtaccgtaggtaactaccgaaacgaacggaaaccggagggtaacgtacgttaaccgaacgtccttaccgtataccgtttctaagtcgtccgttaccgtaccccttacgtaaccttaccggtacgtaccggggtaccggtaccccttagttccggttaccggtcgacggaccggactaggtacgtaacgtggtacgggaactacggttctaccgtacctctaactacgtactccgtacaccgtcgtccgtacgtacctacgaacgttacgaagttcttaggttaactacctttaacgttactttaagttaacgttaaaagtaaccgttaatacgttcctaccccgttaccctaggtttaccgtacgggttaccgggaacgggtaaccgggaacgtacggggaactaacgtaaccggaaacgttaccggtaagtccggtaaaccg

SEQ ID NO: 271146 - DNA, 685 bp, Homo sapiens
  misc_feature: GYAE6OF01BS06J.25.4.A04.1.454.CMB.1.raw
  modified_base (515)..(515): a, c, t, g, unknown or other
  misc_feature (515)..(515): n is a, c, g, or t
tcagactgtacagtcacgaccggtgctcgatttagagtagtgatcagggggcagaagtctctctcagtcaggacacagcatggacatgagggtccctgctcagctccgtgggactcctgctgctctcggctcccagactaccagatgtgacgtccagtatcgaccctagtcctccactccctccctgtctcgctagtcgtggttaggagacagtaactcacgctactctacgttcggcggggacgaggtcggaggctaagttacgtactaatttagttacgtccgttaggttaactaccgaaacgtaacggaaacccggtaagggtacgttacgttaccctaacgtccgttaccgtagtacgttctacgtcgtaccgttccgtacccttaacccgtaccgttaacgaccgttacggtaccgggtaccctacgttcgttcggtacgcggtccggactaggtagtacgtcggtaggactacgttacgtcctactcctactctaacgtcacgtcgacncgtacgaccgacgtacctaggtactcgttcgtacgtaccttaacgtttattaccgtaagtaaacgttaaactacgtacttaccgccgttaccctcgttacgtccggttacgggaccggtaacgggacgtaaggggtacgtaacggtactaaccggaacgtcgtcggtacg

SEQ ID NO: 271147 - DNA, 924 bp, Homo sapiens
  misc_feature: GYAE6OF01DQFVB.25.4.A04.1.454.CMB.1.raw
  modified_base (145)..(145): a, c, t, g, unknown or other
  misc_feature (145)..(145): n is a, c, g, or t
  modified_base (162)..(162): a, c, t, g, unknown or other
  misc_feature (162)..(162): n is a, c, g, or t
tcagactgtacagtcacgaccggtgctcgatttagagtagtgatcgagggggcagaagtctctctcagtcaggacacagcatggacatggagggtccctgctcagctccgtgggactcctgctgctcgtggcctcccagataccngatgtcgaccgtccagntcgaccctgtcctccactccctccctgttcctgactattcgtggtaggaacgacaagtactcgaagtccaagtcctacgttcgggacccgggtgtaacggtccggtacgggactttagttaacgtaacttaaagttttacgtttacggaccgttaggttaactaaccgaaacggtaaaacggaaaccgggtagggtaactaaccggtttcccgtaaacgtcccttacgtaacgttacttccgtaagtccgtaccgtccgtacccccgtttaacgtccgtttaaaccgacccgggtttaccggaacccggggttacccttacggtttcccggtttacccgggttacgaacggggtacccggttacgtaacgggttacggtaaacggtttccgggtaaccggggaacgttaaccggttcggtttacctaaccggttcctaacccgttacttaccgacgtacgtaacccgtcgtacccgtacgtacccgtacgtacggtaacgggtaagttacgttacggttacctaacgtttaaccgtttaacgttaaaccggtttaacgttaaaacgttaaaaccggtttaaaccttaacccgttttaccccgtaccccgtttccccggtttaaccgttcccgggttttaaaccgggtacccgggggtaaaccgggtaacccggggttaaacccggggtaagggttaaacccgggtaacggttaaacccggttaaacccgggtaaccgggtttaaacggcggggttaaccccg

SEQ ID NO: 271148 - DNA, 671 bp, Homo sapiens
  misc_feature: GYAE6OF01EJY8P.25.4.A04.1.454.CMB.1.raw
  modified_base (245)..(245): a, c, t, g, unknown or other
  misc_feature (245)..(245): n is a, c, g, or t
  modified_base (357)..(357): a, c, t, g, unknown or other
  misc_feature (357)..(357): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacacgaccctgtccctcacctgcactgtctctggtgctcatcactagtgttancactatggatcgtaggactccgcagcccaaccggagggacggcctgggagtggagttcggactgtactagttaccggtggactaccaccttccaaccgtaacccctccgtanaacgtcggtacgacgtaccaaccgacgttcctacgtaacgttaccgaacgtaaccgttaccgtaaacgtaacccgttagtttcccctaacccgttaaggtaaacttacgaaacttcgtcggttacgaaccgttcggacccggacggaacccgtacgggtacccgtttagggttaactccggttaggtccggtaccgtaacgtaaccgtttaaccgtaagttaacctaccgggttaaggtccggtaaccctaagtactaccgaactacgttacacggtattcgttactttagatttcggcggtcggggtaaaccg

SEQ ID NO: 271149 - DNA, 569 bp, Homo sapiens
  misc_feature: GYAE6OF01ASMOF.25.4.A04.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctggttgganacagaatcagcatcacttggccgggngagtcgagggcattagctaattatttagcctggtatacaacaacgaaaccagggagtacgttacctaagtctcctagactctatgctcgcctaccacgttacactcgacgggtcccagtcgtcggtcagcggctagtgatcgtaggacagtacgtcactctcactatacacgacacgtcctgccacgtcctaggaatagttgttacgacttaactttattactacgttaaataaacgttaataacttacctccgtccccttactaccgttccggtttacgggccgggtaacggtaaccggtaagggtacggtaacggtactaaacgaaacggtaacgttcggtacggg

SEQ ID NO: 271150 - DNA, 871 bp, Homo sapiens
  misc_feature: GYAE6OF01DMR69.25.4.A04.1.454.CMB.1.raw
  modified_base (230)..(230): a, c, t, g, unknown or other
  misc_feature (230)..(230): n is a, c, g, or t
tcagactgtacagtcacgaccggtgctcgatttagagtagtgatcgagggggcagaagtctctctcagtcaggacacagcatggacatgagggtccctgctcagcctccgtgggacctcctgctgctcgtggcctcccagactaccagatgtgacgtcagactcgacccagtcctacctacttccctccctgtctgctattcgtggtaggaacgaacgaagtaactcganactactcgtacggtcgggaccgggcgtagcggaggtctaacgttacgtacttaaattttacgttacgaccgttaggtaactaaccgaaaacgtaaacggaaaacccggtagggggtaaccgttaaccggtttaacccggtaacgtacccgtttacgacgttacttaccgtacgttccgtcctaccgtacccccgttaaccgttaacctacgtaacccgtccgggtaacccgggttccctacgtttccggttaccggtcgacgggtccgtacgtagggtacgtaacggtcggtaacggaacgtaaggtttaccgttaccgtaaccttacgtaaccttaaccgttaacgtaccgtaaccggtaccgtaccgtacccgtacgtaaccgaccggttaacccgtaggtaacgtttacgtttacgttaaacgttaacctttaacggtttaaacttacgttaaacgttaaaacgttaaacgtttaccttaaccgttacccgtttaccccggtacccttaccggtttaaccggttacccgggtaacccgggggaacgggttaaacccggggaaacgggttaaccgggggtaacgtaaaccgggtaaaaccgttaaccgggtaaaacccggttggttccggtaacccggg

SEQ ID NO: 271151 - DNA, 888 bp, Homo sapiens
  misc_feature: GYAE6OF01CZI8J.25.4.A04.1.454.CMB.1.raw
  modified_base (152)..(152): a, c, t, g, unknown or other
  misc_feature (152)..(152): n is a, c, g, or t
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
tcagactgtacagtcacgaccggtgctcgatttagagtagtgatcagggtctgtgaaggcttcaccagtcctggacctcctgtgcaaagaacatgaaacacctgtggttctccctctgctggtggcagctccagatgggtcctgtccaggtncagctgcagggtacggtccgggacccaagggtactggtagaacgtccttcaacgacgacccttcgtccctcacctgcctacgttcgtcttcgtagggcnccttaccatccgacctaggtttgttaactccaacttacgnggacgtcgtacggactcccgacgaccgaccgaacccggaggggaacgggtccgtagggacgttacggggtaacgtttacgggtaactacgtttaccgttaagtttaacccggggtgggaccgtaccttaacccgttacctaaccccgtacccccgtttcctaaacgttaacgttacgggtaccgtaacgttacccaaccttacgttacccttataaaacgttttaaccgaaaccgttaaccggttaacgttaaaaaccggtaaacctttccgtttaacccgtttaccgtaacggtttaaaacgtttcgaaaccgtttaccgtaggtttaccgaccggttaccgggaccccgggtacggtaaccccggttcggggttaaccccgttttaagttaccgttttaaaccgtcgggtaacgggtacccggtaacttaaacctttacccgggtaaaccgttacgttaacccggttacggggtacccgtaacgtaaactttacccggaaccctaaccttaacgtaccgttaacggtttatcccgtttttaaacggttacttaggtttaacccgggtaacggggtaccgggggtaaaacccgggg

SEQ ID NO: 271152 - DNA, 836 bp, Homo sapiens
  misc_feature: GYAE6OF01CFOSD.25.4.A04.1.454.CMB.1.raw
  modified_base (181)..(181): a, c, t, g, unknown or other
  misc_feature (181)..(181): n is a, c, g, or t
  modified_base (192)..(192): a, c, t, g, unknown or other
  misc_feature (192)..(192): n is a, c, g, or t
tcagactgtacagtcacgaccggtgctcgatttagagtagtgatcagggggcagaagtctctctcagtcaggacacagcatggacatgagggtccctgctcagctccgtgggactcctgctgctctggctccagataccagatgtgacgtcagatcgacccagtctccactcctcctgtcngcatctgtganacagactcagctactacgtacttcggggccgggcgtacggtcgacgggtactaacgttaggtaccttaaattttacgtttaccggccgttaggttaactaaccgaaacgtaacggaaaccggtaggggtacgtaaccggtttaccaacgtccttaccgtagtactacgtacgttcgtccgttacctcccgttaccgtaaccgttaccgtaccggttaccgggtaaccgggttcccctaacgttccgttaccgggttcgaacgggtccgtaacgtacggttaacggtaacgttcgggtaacgggtaaccgtacggttacgttaccaaccgttctaacctacgttacgtacgaccggactcggtaccgtacggtaccgacgtaccggtaaggtaccgttaggtttcggtaaccgttaacctttaaaaccttttacggttaaccgttaacggttaaaacttaaaaccggtttcttaaaacccggttccctttaccccgggtaaccccttttacggtaaccccgggttttaaccggggttacccgggggaacgggggtttaaaccgggaaaccccgggttaaggggtaacccgtaaacggttacccgtaaaacccgggtaaaccggttcgggtttaacggggtacccg

SEQ ID NO: 271153 - DNA, 646 bp, Homo sapiens
  misc_feature: GYAE6OF01BRMSG.25.4.A04.1.454.CMB.1.raw
  modified_base (251)..(251): a, c, t, g, unknown or other
  misc_feature (251)..(251): n is a, c, g, or t
  modified_base (530)..(530): a, c, t, g, unknown or other
  misc_feature (530)..(530): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggctggtgaacgccttcacacgtaccctcgtccctcacctgcctactgtctcgtggtcgctccatcacagttgtancactacgtggagcgtgactcccgcacggccaaccccggaggggaacgggccgtagggaggtggtagttagggtacctagtaccgttagttacggtggggactcctaccgttaccgtaacccgtaacccgtcccgtaactaacgtacgtccgtaagtcccaaccgtactactctagtacgaacgtactactaaacgacctacgtttacctcccgttagtacgttacactacgttgtcgtacgtcgaccccgggacgaccgaccggtccttagtacttcgnggtcgacgtacgtattaccgtacgtactggtaacgtcggtaccgtatacgtccaaccgtagtccgaactagtttcggttactttacggaattacttcggggtaggggtaaacccgg

SEQ ID NO: 271154 - DNA, 980 bp, Homo sapiens
  misc_feature: GYAE6OF01CW8YY.25.4.A04.1.454.CMB.1.raw
  modified_base (969)..(969): a, c, t, g, unknown or other
  misc_feature (969)..(969): n is a, c, g, or t
tcagactgtacagtcacgaccggtgctcgatttagagtagtgatcgagggggcagaagtctctctcagtcaggacacagcatggacatgacgggtccctgctcagcctccgtgggctcctgctgctctggctctcgaggtcgacaggaggtgaaccactccacacgtacgaccctagtcctacctactccctcctgtacctgcctattcgtagggtaggacgacacggacgtccaacctacttacctacgttacgccgtacgacgtacctacgaacgtaactacttaaccttaaactttaaacgtttttaagtcgtaactaccgaacgtaaaccgtaaaccggtgggtaacccgttaccccggtaaacccttaactccgtacgtaaccgtttcccgtaacggtccgtacttaaccgttaaccggtttaagggtttaaaccggaaacccgggttaccgggtaacctttacgtaacgggttaaacgggttgtaaagggttaacgggaaggttaggtacgtttaaacggggtcgtttaaaactttaacgttttttaaccgttttaacctacccgaacgttaaccgttaacgacggtaaccgttaccggtacgtaacccgggtaaccgaaaccgggtttaaaccgggttaagttttaccgtttaaccggtaacccttaaaacgttaacgttttaaaccgttacccgttaaccggttaaacccttaaacccgttttcccgtttaacccgttttaccccgttttaacccgttttccccgtttacccccgggtttttaccgggttttacccgggttaacccgggggtaacccccggggttaaacccggttaccccccggttaaaaccgggggtaccgtaaaccgttaaaccggtaaaaccccggtttaaaggttcccgggaccgggtttaccgtaacccgttacccgaccggtttacctaccggtttaccggtttntttaacccccg

SEQ ID NO: 271155 - DNA, 743 bp, Homo sapiens
  misc_feature: GYAE6OF01BW9FS.25.4.A04.1.454.CMB.1.raw
  modified_base (204)..(204): a, c, t, g, unknown or other
  misc_feature (204)..(204): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctcccagactaccagatggtgacgtccagatcgacccagtcctccacttcctccctgtctgctatcgttgtagganacagatcagcactctacgttcggaccgggcgagtcgagggactattacgacttaaatttacgtttacgccgttaggtaactaccgtaaaacgaacggaaaccggtaggggaacgtacgttacctaacgtcgttaccgtagtacttactagttcgccgttcgtaccccttaaccgtacgttaaccgacggttaccgggtaccggggttacccctacggtttccgttaccggttacggtacggtcgggataacggttaggtaaccgtacgggtacgggtaccgtaagtacggtttaccaccgtaccttacgaaccgttaactacgtacgtcgcggtaccctacgacgtaccgtacgttaaggtacgttctagtaccgttaaccttaacttttagttaacctaggttaaactaaacgttactaaccgtttacccaccgtttacccgttacgtaacccggtttcggttaccgggaacccgggtagggaaaccgttaagggtacggtaaaccgacgttaaacccggaaggttacggcggttacg

SEQ ID NO: 271156 - DNA, 653 bp, Homo sapiens
  misc_feature: GYAE6OF01DCLUI.25.4.A04.1.454.CMB.1.raw
  modified_base (258)..(258): a, c, t, g, unknown or other
  misc_feature (258)..(258): n is a, c, g, or t
  modified_base (331)..(331): a, c, t, g, unknown or other
  misc_feature (331)..(331): n is a, c, g, or t
  modified_base (359)..(359): a, c, t, g, unknown or other
  misc_feature (359)..(359): n is a, c, g, or t
tcagactgtacagtcacgaccggtgctcgatttagagtagtgatcagggtctgtgaaggcttcaccagtcctggacctcctgtgcaaagaacatgaaacacctgtggttctccctcctgctggtggcagctcccagatgggtcctgtcccaggtgcagctgcaggagtcgggcccaggactggtgaagccttcacagaccctgtccctcacctgccactgtctctggtgctccatcaccagtgttatcactactgganctggactccgccagccacccgaggggaacggcctggagtggagttgggtacattctaagttaccggtgggacncctaccgttctaaccaacccgtccctanaatcgtcacgtcaccatctacattacactacgtactaaacgaacctacgttacctcccgtagtaaacgtttacgaacttcgtgtcgtaccgttcggacccggtaccgggtaacctaccgggtcccgtttagttaactttaaccggtggttaccggtaccgggtactaacgtttaaccgttaacggtacttaaaccggttacggtacgggtacccgtataaccgtaccaacctaacgtccgaacgttattacgttactttttagactttaacggtcggttacgggggaaacccgg

SEQ ID NO: 271157 - DNA, 781 bp, Homo sapiens
  misc_feature: GYAE6OF01EAQP4.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttcctccctcctgctggtggcagcctcccagagtgggtcctgtcccgaggtgcagctgcgaggacggtccggggaccagggactggtgaacgtcccttacaccgacgacccttcgtcccctccacctcgcctacttgtcctcgtcgggtcgcctccactaccacgtaggttcggttactaccacgttacgtgggacgtcgtggacctcccggaccaccggaccgaaccgggaggggaacgggtcgtagggtaggtcggtagttgggtaactgtacgttacggttccgggaggacctcgtaaccgttcccaaccgtaccccgtcctagtaaactcgtactacgtaacccactactcgacttagtacgaacctaccgtaactaacgtaacctcgttacctacgttaaggtaactacgaaccttgtgtacgtacctcgggacccgtacggtacccgtacggttcgtacggttaacgttcggtacgggtcgaccgggttaactaaccgttaaccgttaacggtaacgttaacggttaccgggtaccggtaaacccgttattaacccgtaacccgtaaccgtacggtacccgtaaccgggtttaaggttttaccgtttacggtttttaacgtaaggtttaacccggggtttcgggggaaacccggggtaaaacccggggg

SEQ ID NO: 271158 - DNA, 799 bp, Homo sapiens
  misc_feature: GYAE6OF01AWTDQ.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggcctcccagactaccagatgtgacgtccagatcgacccagtctccactccctcctgtctgcatcgtgtggaagacagaatcagcatccgacgttcggcccggggcgagtccgagggtctaattacgactaaatttatttaacgccgttaggtaactaccgaaaccgaaaggtaaacccgaggggtaagtaacgttaccgtaagtcctctagtactacgtagtcgaccttcggacccctaccgtaaccgttaccaacgtccggtaaccgggttaccctacgttccgttccgggttaccgaacgggtccggtacgtaggttacggtaacgtacggtacggggaacttaacggttacggttacctaccgttacctaacccgtaacttaacgtaccgaaccggtcctaccggtccgtaacggcccgtaacggtaccgtaagggttaactaagtttcgttaaccgtaaacgttaaaccgttttaactttaaccgttaaacggttaaaacccttaaaaagtttaccttaaaccgttaccccgttacccgttacccccgtttaccgttaacccggttaccggttaacccggggaaccggggttaaaccgggtaacccggtaaggggttaccggaaacgtaacccgttaaaccggaaacccggttcggttacgggtaccgg

SEQ ID NO: 271159 - DNA, 776 bp, Homo sapiens
  misc_feature: GYAE6OF01CWTJ9.25.4.A04.1.454.CMB.1.raw
  modified_base (188)..(188): a, c, t, g, unknown or other
  misc_feature (188)..(188): n is a, c, g, or t
  modified_base (232)..(232): a, c, t, g, unknown or other
  misc_feature (232)..(232): n is a, c, g, or t
  modified_base (736)..(736): a, c, t, g, unknown or other
  misc_feature (736)..(736): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctcccagactaccagatgtgacgtcagatcgacccagtcctaccatccctccgtgtcctnctatcgtgtaggacacgagaatcagcagtctacgtcgggccggngaggtcgaagggtctaagttagacttaaattacgtttaacgccgtaggtaactaacgaacgaaaccgaaacggaacggggtacgtaaccgttaccgtaacgtccgtacccgttggaacttaccgtagtccggtaccgtccgtaccccttaccgtaaccgttttaccaaccgttacgggtacccgggttacccctcggtttctaccgggttcgaacggtcggtcctaaaggttcgtaaacgtcggtagggacgtacgtacgttacgaaccttctacaacttcgataacgcttaaccggccgtaagccacggtacggtaacgtaagttaccgtacggtttactaacctttaacgttttacgttaaacgtaaacgtttaaaacggtaaaactttaataaccccggttattcccccggacccttttaacgtaaacccgggtcccggttttaaccggggacggggtaaacccggtaacggggttaagggacgtaaaaacccgggtttanaaacccgggttaaaccggtcgggttaacccggttaccggg

SEQ ID NO: 271160 - DNA, 669 bp, Homo sapiens
  misc_feature: GYAE6OF01DWO1N.25.4.A04.1.454.CMB.1.raw
  modified_base (230)..(230): a, c, t, g, unknown or other
  misc_feature (230)..(230): n is a, c, g, or t
tcagactgtacagtcacgaccggtgctcgatttagagtagtgatcagggggcagaagtctctctcagtcaggacacagcatggacatgagggtcccctgctcagctccgtgggctcctgctgctctggctcccagatacagatgtcgacgtccagatgacccagtcctccatccctccctgtctgcatctggttggagactagaactcagcatcgtacttggacccgggngagttacgaggtactaagtttagacttaatttactttagcccgttaggtactacgaacaaggaaacccgtaggggtaacgtacgttaccgtaaacgccttaccgtagacttctagtcgtccttacggaccccttaccgaacgttaccacgtacggtacgggtcccacgttctcgggttacacggtcggacgtaggttacgaattggtacgggactaggttacttacaacctctaccgtactacctacgacgaccaccgtcgttacacgtacctaggtaactaaggttgtacgttaccgttaactttacgtttactaaacgttacgttaaagtaattacgtactacccgttccaccctttacgtaccttacggggttacaacggggtaaccgttaacggaggttaaccgagtaaccgtaaggtaacggttcgaggtaccg

SEQ ID NO: 271161 - DNA, 736 bp, Homo sapiens
  misc_feature: GYAE6OF01A0SE4.25.4.A04.1.454.CMB.1.raw
  modified_base (667)..(667): a, c, t, g, unknown or other
  misc_feature (667)..(667): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctccagatgggtcctgtcccaggtgcagctgcaggagtcgggcccaggactggtcgaacgccttcacagaccctgtccctcacctgcactgtcctcgtggtcgctccatccaccagtggttatcactacgtggacgtctaggactcccgaccacggcccaaccccgagggggaacgggtcccttaggggacggttcggtaagttttcgggggtaacctagttccgttaaacggttttacccgggtaggggaaccgtaccctaaacccgttttcctaaaccccgtaaacccccggttcccctaacgtaaaacgttacggtacccggtaacgtacccaaccgtacttccgtactaagttacgaacctacgttactaaacgaccctaggtttccctacccgtagaactttacgaaccttctaggtacgaccttcggacccgtacggtaccgaacgggtcccgttagtaactttaccgtaggtacggaccggtactaacggttaacctaacgtacgttaactagggtccgtaccgaattaccnccgtaacacgttccgaacgttaatcgtttaacctttacggaatttaccggtacggtcgggggaaacccg

SEQ ID NO: 271162 - DNA, 664 bp, Homo sapiens
  misc_feature: GYAE6OF01AY8NB.25.4.A04.1.454.CMB.1.raw
  modified_base (189)..(189): a, c, t, g, unknown or other
  misc_feature (189)..(189): n is a, c, g, or t
  modified_base (233)..(233): a, c, t, g, unknown or other
  misc_feature (233)..(233): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (504)..(504): a, c, t, g, unknown or other
  misc_feature (504)..(504): n is a, c, g, or t
tcagactgtacagtcacgaccggtgctcgatttagagtagtgatcagggggcagaagtctctctcagtcaggacacagcatggacatgagggtccctgctcagcctcctgggacctcctgctgctcgtggcctcccagataccagatgtgacgtccagactcgacccatcctccactccctcctgtctncatcttggtagagtacagaatcagctactcctagtcggccgggnacgtcgaggactagttagacttaatttacttacgtcgtacgtacacgtaacgaacggaaccggaggtacgtacgttaccgacgtctccgntactntactcgtctaccgtaccttaccgtacgttacctaccgcgtacgggtccctacgtccgttcggtcacggtcgacgtgggtaaccagttcggacggtactaggtacttacctacctctacctactacgacgtanaccgtcnccggtcnccgtacggtcgtaagtacgtactttacgtntaaccgtttaactaaccttaggtaacttaaaacgtaacttacgtacccttaccgtaccgttcccgtaccgttacggtaaccgggtccgggtaacgggtaaccggtaacgttaggaacggtacccgaaaccgttaaccgggacgtaagggtcccgtaacgg

SEQ ID NO: 271163 - DNA, 690 bp, Homo sapiens
  misc_feature: GYAE6OF01A7AYI.25.4.A04.1.454.CMB.1.raw
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (648)..(648): a, c, t, g, unknown or other
  misc_feature (648)..(648): n is a, c, g, or t
tcagactgtacagtcacgaccggtgctcgatttagagtagtgatcagggtctgtgaaggcttcaccagtcctggacctcctgtgcaagaacatgaaacacctgtggttcttcctcctgctggtggcgcgcccagatgggtcctgtcccagctgcgtctgcaggagtcgagcccagggcaggtgaagccttcggacgaccctgtccctcacctgctctgtctctggtnactcatcacgtagtggttacncactacgtggacgtcgtaggactccgccaagtccaaccccggaggggaacggccgtgggacgttcggacgtttgggtaactagttaccttacgttacccggtgggactaccgtaaccctttcctaacccgtaaaccccgtccctaaacgaacttacggtaccgtaacgttcccaaacctacttcctaacgtaagtttaacgaacctaacggttactaaaacggaacccttaggtttaccctacccgttaaggtaacggtttacaaccgttcgttacggtacgtaaccgttccggacccggtaccggaaccgtaccgggtcccgtttagttacttacggtcgtcggccggtatacgtactacgattacgacgtaggacctatacctcacctataccgtagnttcggttactttaggacttagtcggacgggtacgtaaacggg

SEQ ID NO: 271164 - DNA, 791 bp, Homo sapiens
  misc_feature: GYAE6OF01DGIE6.25.4.A04.1.454.CMB.1.raw
  modified_base (551)..(551): a, c, t, g, unknown or other
  misc_feature (551)..(551): n is a, c, g, or t
  modified_base (565)..(565): a, c, t, g, unknown or other
  misc_feature (565)..(565): n is a, c, g, or t
tcagactgtacagtcacgaccggtgctcgatttagagtagtgatcagggggcagaagtctctctcagtcaggacacagcatggacatgagggtccctgctcagctccgtgggacctcctgctgctctcggcctccagactacagtatgtcgacgtccagagtcaccgatcctcctactccctccctgtctagctacgtcgtaggttggaagaacctagtaactcgacgtactacgtaccgtccgttcgggcccggggacgtacggacggtacgggtactaagttacgtaacttaacgtttagttaccggtcgttaccggtaaataaccgtaaaacgaaaacggaaaacgggtacgggtaacggtacgtttaacccgaaacgtcctacgtatacttcacgtcgtaccgtccgtaccttacccgtaccgtaaccgtacccggtaaccgggtccggtaccctacgtttccggtaccgtcggacggcggtacctaggtacgtaaccggtggtaccggaacgttgtacgtacctaccgtctacacttagacgtacncggtactccgtacnccgtaacgtaacgtacggtacgtaaattcgtttaacgaaccggtttaacttaacgttaaacgttaacgtaaaacgttaaagttacctaaacccgttacgtacccgttacccgtaaccgttaccggttaccggggtacggggtaaacccggtaaagggtaacccgggtaaagggtacgggttaaccttaaaccggaaagtttaaacccggtgggttaacggtaccgg

SEQ ID NO: 271165 - DNA, 744 bp, Homo sapiens
  misc_feature: GYAE6OF01EZ3CS.25.4.A04.1.454.CMB.1.raw
  modified_base (289)..(289): a, c, t, g, unknown or other
  misc_feature (289)..(289): n is a, c, g, or t
  modified_base (536)..(536): a, c, t, g, unknown or other
  misc_feature (536)..(536): n is a, c, g, or t
  modified_base (616)..(616): a, c, t, g, unknown or other
  misc_feature (616)..(616): n is a, c, g, or t
tcagactgtacagtcacgaccggtgctcgatttagagtagtgatcaggggagctctgggagaggagccccagccgtgagattcccaggatctccacttggtgatcagcactgaacacagaccaccaaccatggtaggtttgggacttaactgttcttttccttgttgtcgttagttttaaaggtgtacctaattgtgaggtgactaagtgggtaggagttcggtagggggaggtcgtttaggtacacgccgtacgggcccgttacccagacctaccttcctccacgacnccgagtccctttaccggacttaccgtccggttttggtacggatacatcgaactgtaccggaccggttccgggcccgacggtacgtaccggtaccgggaggggtaacgggtcgtgggtacggttggttcggtttaggttactaagttaggacggtagtaacgtcgtaggtcggggacggaactaaacgacaaccgtccggtaccggtaccgttaggtaacgtaaacggctaaggttaccacgttaccnccgttacgaaacgtagaacgtacgtagtaaacctaaaccgaaagacctacgtccctaacttcgtacctgaccctaaagtntacggacgacgagtaacgagggtaacgagggaaccgtaacgacccgtagtcccggttacgtttattaacctttgtttcctttaatacgttttaccgtagtaaggtaggtttaaacgttggtttaacgg

SEQ ID NO: 271166 - DNA, 870 bp, Homo sapiens
  misc_feature: GYAE6OF01EX2WL.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctccagagtgggtcctagtcccaggtgcagctgcgaggacggtccgggacccagggtacgtggtacgaacgccttacgacgacgtaccctcgtcccctacacctgacctacttcgtcttcgtggtcgctccagtccacgtagttgtactcacgtcgtggactcgtaggactccgacacgaccgaaccgggaggggaaccggtcgtagggtacggtcggtagtttacgggaactcgttaccgttaacggttaacccggggtagggtaccttacccgtaacccgtttaacccgtacccgttaacccccggtacccttaaggtaaacggttaaccggtcgtaaacccgttcccaaaccgtttacttacccgtaagtttaaacggtttaaccggaaaccgttaacccgttaaacgttaaaacccgggtaccctttacggtttaccccttaaccggttaaaggttaaacggtttaaacctaaccggtttcgttaacggtaccgtacccggttaaccggacccgggttacccgtaaacgggtcccggtttacgttaagttaaccgttccggtcgggtaacggaccccggttaataacccggtttaaagtaccgttaacgtttccggacggggttaccggtacctaaattaaccgttcggaaaacccttacggttaacgaacccgttttagggtttccctttaaggttaacgtaacgttccgggttcccgggggaaaggtaaacccggg

SEQ ID NO: 271167 - DNA, 713 bp, Homo sapiens
  misc_feature: GYAE6OF01EF3YL.25.4.A04.1.454.CMB.1.raw
  modified_base (211)..(211): a, c, t, g, unknown or other
  misc_feature (211)..(211): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (600)..(600): a, c, t, g, unknown or other
  misc_feature (600)..(600): n is a, c, g, or t
  modified_base (694)..(694): a, c, t, g, unknown or other
  misc_feature (694)..(694): n is a, c, g, or t
  modified_base (702)..(702): a, c, t, g, unknown or other
  misc_feature (702)..(702): n is a, c, g, or t
tcagactgtacagtcacgaccggtgctcgatttagagtagtgatcagggtctgtgaaggcttcaccagtcctggacctcctgtgcaagaacatgaaacacctgtggttctccctctgctggtgcagctccagatgggtcctgtcccaggtgcagctgcagggagtccgggcccaggactgggtgaacgtccttcacacgaccctgtccctnacctgcactgtctcgtggtcgcctccatcaccgtagttggttatcacgttacnggtancgtcggactccgaccacgaccaaccggtaggggaacggtccgtagggacggtgggagtttacgggaactagtttacgttaacgtttaccgggtgggacgttacctaaccctttccgtaaacccgtaaacccccgttccctaactaaacggtttaccggctaacggtaacccaaccgtattccgtaactaacgttaccgaaactaccgttaacgttaaacgaacccgttacgtttacctaccgtaagggttaacgttcgtaaacctttcgtacggtcgtaaccgtcgtcccgggtacgtaaccggtcggtacggttagttaactttaccggnggtaccggccggtacgacttacgtacgatttaacgacggttcggacctaatccgtaccaaccttagccgtaactagtccgttactttgaacttnttaccggngggtaaacccg

SEQ ID NO: 271168 - DNA, 753 bp, Homo sapiens
  misc_feature: GYAE6OF01A5OQE.25.4.A04.1.454.CMB.1.raw
  modified_base (245)..(245): a, c, t, g, unknown or other
  misc_feature (245)..(245): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagtccttcacacgaccctgtccctcacctgcactgtctctggtgctcatcacagtgttanctactacgtggatcgtggactcccgcacgccaccggaggggaacggccgtgggtaggtggtagttgggtactaggttcctaagtttacccggtagggacctaccgttacctttacctaaccgtaaacccccgttccgtaacgtaaacggtacgttacgacgttaccaaccctattccgtaactaacgtttaacgaacctaccggttaacgtaaacgtaacccttacggtttaccccttacccggtaagttaacgtttacggaacctttcgtacggttaccgtaccgtacgggtacccgggacggtaacccgtaccgggttccgtttacgttaacgtttcccgtagggtccgaccgggtacttaacgttaccgtaacggtacgtttaacccgtagggtacccggtacgttaaattccggtaaacccacccgtaaattccccgaagttaacgtttccgtttaaccgttttggtaaacgttccgttccgggggtaacggggtaaaacccgg

SEQ ID NO: 271169 - DNA, 804 bp, Homo sapiens
  misc_feature: GYAE6OF01AOHP9.25.4.A04.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgtganacagaatcagcatcacgttggccgggngagtcgagggcattagactaatttatttacgccttaggtatacgaaacgaacgaaaaccgaggggtaacgtaacggtttaccctaaaggtccctacccgttaggtaacttaccgttaagtcgtccgttacgcccctttacccgtaaccgtttaacctaccgtttaccggaacgggggtttaccccctaagtttccgtttccgggtttaccgacggtacccgggtacgtaacgggttacgtaaacgttccggtaggggaacctaaggttaacgttacctaccgttcctaactaacttacgtaccgaacggcccaacggtcccgttacgaccgtacgttacccgtaaggttaaggtaacgtttcggttacgtaacctttaaaccgttttaacgtttaaccgttaagttaaacgtaaaacgttaacgttaaaccgttaccgttacccggtaccccctttaacgttacccggttaaccggttttaccgggggaacccggggttaaacgggtaaaccccggtaaggggtaacggttaaacgggtaaccgttaaaccggtaaaacggttaacggttcggtttaaacccgggg

SEQ ID NO: 271170 - DNA, 759 bp, Homo sapiens
  misc_feature: GYAE6OF01EG529.25.4.A04.1.454.CMB.1.raw
  modified_base (258)..(258): a, c, t, g, unknown or other
  misc_feature (258)..(258): n is a, c, g, or t
  modified_base (320)..(320): a, c, t, g, unknown or other
  misc_feature (320)..(320): n is a, c, g, or t
tcagactgtacagtcacgaccggtgctcgatttagagtagtgatcgagggggcgagaagtctctctcagtcaggacacagcatggacatgagggtccctgctacagcctccgtgggacctcctgctcgcctcgtcggtcctacccagacttaccgagtagtgtcgaccgtccagtactcgaccctagtcctccatccctccgtgtcctgctacgtctggtaggagacaagtaatccaagcaacttcagtcggaccggngacgtcgaggactagtacgataactttacgtacggcctagtaactcaaacacggaaacccgnggaacctagtttaccaaggtcctactagacttacgtagtactccgtccgtacccgtaccgttaacgtacaacccggtaccggtacggttacccacgttccgtaacggttccgaaggtcgaaccgtggttaacacgtacggttacggaacgtcttaccgggtactaaccttccgtaccgtaattacggaccaacggttacacgttaccggtctacgtacggttacaacgtaacgtatttacgaacgttaccgttaaacttacgttaacgaaacggtaactttaaacggtaactttaacccgtacccgttaccggtaccccctttaaacggtaccggtttaaacccgggtaggggtaaccccggggttaaaggttaaacccgggtaacgggtaacgggttaacaaccggttaaaaccgaaacgttcggtagggtaccccgg

SEQ ID NO: 271171 - DNA, 899 bp, Homo sapiens
  misc_feature: GYAE6OF01E1LV3.25.4.A04.1.454.CMB.1.raw
tcagactgtacagtcacgaccggtgctcgatttagagtagtgatcgaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgacaactggtggagtcgtgggggagtcgttggtaccagccagggcccggtccctagaccactcctcctgccacacgtccttccggactctaccgtttggtgagcatgtctatcggaccgtcggggtccgccgtacggtccgtaccggaggggtaacgggttcgtagggtacggttggttccgttttgggttactaaggttaacggaacggtaccggtaaacggtcccgttaaggtcggggttaccggggaacctaaacccgaaccgtaaacgttaccccggacccggtacccggttaccggttaaacggttaaaaaaccgggtccgtaacggttacgttacccgtacccggtaccccgtttaccgtaacggaaaacggtaacggtaaacgttaccggtaaacccgtttaaacccggaaaaacggtaccctaaaccgttcccgttaacccgttaacgtttacccgtaccgtaacccgtaaccgtaacggttaccggaaccggtaccgtaaccggtaccgttaacgggaaaccggtaacggacccgggtaacggttaacccgtacccggtaaccgggtttccccgtttaagggtttaacctttttaaccggttttaaccggttttaccttttttaaaacgtttaaccccggttacgttaacgggttaacgggttttaaacgggtttaacgggttttttaaacggg

SEQ ID NO: 271172 - DNA, 960 bp, Homo sapiens
  misc_feature: GYAE6OF01AM95C.25.4.A04.1.454.CMB.1.raw
  modified_base (178)..(178): a, c, t, g, unknown or other
  misc_feature (178)..(178): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
tcagactgtacagtcacgaccggtgctcgatttagagtagtgatcagggggcagaagtctctctcagtcaggacacagcatggacatgagggtccctgctcagctccgtgggacctcctgcttctcgtggcctacccagacttaccagatggtcgaccgtccaagtactccgaacccngttcctccactccctcctgtctagctattcgtggtggagacagtaatcagactatccgtacgttcggccgggngtactacggngggtactaagttacgacgttaatttacggttccgtacgttagtaactaccgaaaaccggtaaacggtaaaccgggtaacggggtaacttttaaccggtttaaccccgtaacggtttcccgttaacccggtacttaaacgtttaccgtttaaacggtccgttaccccgtacccggttaaccccctttacccgtaaacccggggtttaaccctaaccgggttccccggggttaacccggggtttaaccccttaccgggtttaccccgggtttccgggtaaaacccgggcgggtaccgtaacccgggttagttaaccgggtaaacggtttccggggtaaggaaaccgttaacggggttaccttaacccggtacctttaccggtaccttaaccgttaccgtaccgtaacgccggttaaggtcccttacgggaccttacgggaacccgttaggtaaccggttagttaccgttaaacgttacctttaaacttttaacccgggtaactttaaacgttaaaacgttaaaccgttacttttaaaaccgtcccggtttacccctaccgtttacccggttaccgtttaaccccggggttcgggaaaacccggggttaccgggttaaacgggtaaacggttaaccgggtaaataaccccggggtttaaaccctaaaaggggttcccggtttacgggaaaccggttacccgg

SEQ ID NO: 271173 - DNA, 797 bp, Homo sapiens
  misc_feature: GYAE6OF01DE76K.25.4.A04.1.454.CMB.1.raw
tcagactgtacagtcacgaccggtgctcgatttagagtagtgatcgagggggcagaagtctctctcagtcaggacacagcatggacatgagggtccctgctcagcctccgtgggacctcctgcttgccttctcggcctacccagtaactacccagtattggtacgtaccgtaccaggtactccggacccaggttcctccctaccttcccgtcccgttgtctagctacttcgtggtaggactaacagaactcgactcgtactacgtacggtcgggcccgggtatacggtaccggacggtattaagttaacgtacttaaatttacgtttacggacttaggtaaacgtaacctaaacggaacggaaaaccggtagggtaacgttaaccggttaaccgtaaacgtccgtaccgtagttacctacgttacgtctaccgtacccgtacccttacgtaccgtacgtaccgtacggaccggtaccctacggttcgttacggaccgtacggacgtacgtaagtaacggtaacgttcgggtaacggacgtacgttacgtacctaccgtactaccttaataccgttaagacctacgttacgaccgtagtaccgacgtaaccgtaagtacgtaacggttacgtacttaaccgttaacgtttaacgtattaaacgtaagtttaaactaacgtaaccgttccgtaccttaccccgttacgtaaccggtttacggggaccggtaaggggtaacccgtaaacggtacggttaacgaccgtaaacgttaacggaccgttaaaggttcgaaccgg

SEQ ID NO: 271174 - DNA, 818 bp, Homo sapiens
  misc_feature: GYAE6OF01DE47T.25.4.A04.1.454.CMB.1.raw
tcagactgtacagtcacgaccggtgctcgatttagagtagtgatcagggtctgtgaaggcttcaccagtcctggacctcctgtgcaaagaacatgaaacacctgtggttctccctcctgctggtggcagctcccagatgggtcctgtcccaggtgcagctgcaggacgtccgggccaggactggtagaacgtccttacacacgacccttgtccctcacctgcactgtctcgtggtcgtcctaccatccactaggttaggttactcaaccgttacgtggacgtccgtggtactcccgccgacgaccgacccggaaggggtaacgggccgtagggtacggtagggtacgttacggggtactacgttaccgttaacgtttaccgggtagggtaccgacccttaacccctttaccgtaaacccgtaaccccgttcccttaacgtaaacgttacggtaccggtaacgtacctaacctacttcctactaacgttaacgtaaccgtaaccgttaacgtaactaaccttacgtttacccttaacccgttaggttaaacgtttacgaaccgttacgttcggtacgtaaccggttccggaacccgggccggtaacccgtaccgggttaccgttacgtttaacggttaccgtacgggttccggaaccggttactaacgttaaccttaacggttacgttaaccggttacgggtaccgacccggttaattaaccgttacccgaacgttaacttaccggaccgtttaggttaccgtttttaccgtttaaggttaaccgttttacggtaccggggtccggggtaaaaccgggg

SEQ ID NO: 271175 - DNA, 872 bp, Homo sapiens
  misc_feature: GYAE6OF01BYW9F.25.4.A04.1.454.CMB.1.raw
tcagactgtacagtcacgaccggtgctcgatttagagtagtgatcagggggcagaagtctctctcagtcaggacacagcatggacagtgagggtccctgctcagctcctgggactcctgctgctctggcctcccagactaccagtatgtagacgtccagatcgacccacgtcctccacgttcccttcctgtcgtcgcctagttccgtggtttaggacgtaacgaagaactcgacgacctactccgtaccgttcgggcccgggcgtacggtacggacgggtctaagttacgacttaaatttacgttacgtaccgttaggtaactacgaaacctaacggaaaccggaagggtacgtacgttaccaacgtccttcctagtacttcgtagtcgtaccgttccgtaccccgttacgtaaccgttaacgacgttaccgggaacccggttcccgtacgtttccggttaccgggttcgacggtaccgggtacgtacggttacgtacgttaccgggtacggtaaccgtagttaacccgtttaccgaacgttaccctaacgtaacgttccgtaacggacgtacccgtcgtacccggagtaccgtaacggtaccggtaggttaaccgttaacggtttcggttaaaccttaaccgtttaaacgttttaccgtttaaaaccgttaccgtttaaaacgttaaaacgtttaccgttaaaccccgttaccgttaccccgtttacccgttaacccgggttttaccgggtttaaaccccgggggtacgggttaacccggggtaaaaccggggtaacgggtttaaacggtaaccgggtacgttaaaacccggtaaacggggtaaacccgtttcgggttccggtaaaccggg

SEQ ID NO: 271176 - DNA, 742 bp, Homo sapiens
  misc_feature: GYAE6OF01BWIOQ.25.4.A04.1.454.CMB.1.raw
  modified_base (517)..(517): a, c, t, g, unknown or other
  misc_feature (517)..(517): n is a, c, g, or t
tcagactgtacagtcacgaccggtgctcgatttagagtagtgatcgaggggagctctgggagaggagccccagccgtgagacttcccaggagtctccacttggtgatcagcactgaacacacgaccaaccaaccagtggtagtttggcttaactgttcttttcttgttgcttagtttaaaggtgtactaatgtgaggtgacaacgtggtggagtcggtagggggagtcgttaggtacacgaccgacgggcccgtcctgacctactacctcctgacacgacgtccgttccggactcttaccgtttggacgtacgcagtcgacgttaacgtccgtaccggtcggtaccccgaccgtaacggtccgaaccggtaaggggtaacggttcgtgggtacggtggtcgtttagggtactaagttaggaacgtacggacgtccgtaggtcgggtacggaacaacgaactaacgtaccgaccgtacgtaagtaacggtaaacgcgtagtaactccgacgtccgtanaacgaagtaactagtactaaacctaacgaaacgtcaaccgttcgtaaccctagttcctacgaactaactagtacggaccgtaggaccgtcgtaacggaacgtaagaccggtaacgtaaccgtaaccggtcggtaacgggtttaacttacggtttaaacgtttcgttttaacttaaaccgttacgttaccggtaaaggttaagggttaacgttagggtttttaaac

SEQ ID NO: 271177 - DNA, 897 bp, Homo sapiens
  misc_feature: GYAE6OF01A4F8J.25.4.A04.1.454.CMB.1.raw
  modified_base (197)..(197): a, c, t, g, unknown or other
  misc_feature (197)..(197): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgaccagtctccacttccctcctgtctgctatctgttgganacagaatcagcatcctacgttcggccgggtcgaggtcgacggggtactaagtttaggacttaagtttacgtttacgccttaggtaactacaaaacgaacggtaaaccgaggggtaacgtacgtttaccgtaaacgtccttaccgtaggtacttctaacgtcggtacttccgtacccttaccgtaaccgtttaccgtaaccggttaccgggtaaccgggggttacccctaacgtttccggtccgggtttaccgaggtccgggtacgtacggttaacggtaaacgtaccgggtaacggggtaaccgtaagggtaaccgtttaccgtaccttacccttacgttaaacccgttactaccggaacggtaccgtaaccgttacccggtacggacccggtaaccgtaccggttaagggtaacggttaaggtttaccgggtttaacgtaaacccgttttaaacgttttaaaccgtttaaccggtttaaacgttaaaaccgtttaaaaaagggttaccttaaaacccgtttaacccgtaccccgttttaccccccgttaaccgtttaacccgggttaccccgggtttaacccgggggaacccgggggtaaaccggggttaaaccgggtaaaacggggttaccgggtaaaaccggttaaacccgttaaaaccccggtaaaacggttaaccgggttcgggttaacccgggg

SEQ ID NO: 271178 - DNA, 703 bp, Homo sapiens
  misc_feature: GYAE6OF01A1W2R.25.4.A04.1.454.CMB.1.raw
  modified_base (200)..(200): a, c, t, g, unknown or other
  misc_feature (200)..(200): n is a, c, g, or t
  modified_base (467)..(467): a, c, t, g, unknown or other
  misc_feature (467)..(467): n is a, c, g, or t
tcagactgtacagtcacgaccggtgctcgatttagagtagtgatcagggggcagaagtctctctcagtcaggacacagcatggacatgagggtccctgctcagctccgtgggactcctgctgctcgtggctacccagataccagagtgtgacgtccagatcgaccctagtcctccatccctcctgtctgcatcgtgtganactagaatcagctactctacgttcggccgggcgtagtccgagggtactagttaagacgttaatttagtttacgccgttaggtactacgaacgaacggaaaaccggagggtacgtacgttaccgtaacgtcctacgtagtactacgttagaccggtctccggtacccttaccgtacgtacgtaccctggaccgggtcctacgtacgtccggtcgacggtcgagtgtacgtacgcgtaggactagtcgtaccgtctctacgtacttacncgtacgccacgtacttcggaacctcgtccgtaagttagacggtttcgtaacgtaactttaaccctttaagttaccgttaaacggtaaactttaaacttaaccgtaacgttaccccgtacccggtaccccttacggtaacccgtttaccggggttacgggaaaccccggggtgggaaacccggttagggtaccggtaaataacccgggttagtaaaaccggtcggtcggtaaccggg

SEQ ID NO: 271179 - DNA, 663 bp, Homo sapiens
  misc_feature: GYAE6OF01DX30S.25.4.A04.1.454.CMB.1.raw
  modified_base (225)..(225): a, c, t, g, unknown or other
  misc_feature (225)..(225): n is a, c, g, or t
  modified_base (433)..(433): a, c, t, g, unknown or other
  misc_feature (433)..(433): n is a, c, g, or t
  modified_base (484)..(484): a, c, t, g, unknown or other
  misc_feature (484)..(484): n is a, c, g, or t
  modified_base (512)..(512): a, c, t, g, unknown or other
  misc_feature (512)..(512): n is a, c, g, or t
tcagactgtacagtcacgaccggtgctcgatttagagtagtgatcagggggcagaagtctctctcagtcaggacacagcatggacatggagggtccctgctcagcctcctgggacctcctgctgctctggcctcccagataccagatgtgacgtccagactcgacccagtcctacctacttccctccctgtctagctattcgttgttaggacgaacagaatcganctacgtcctaccgttcgggccgggcgtacggtcgagggtactaacgtttacgacttaagtttagtttacgcgttagtataacaaacgaacgaacggaggacgtacttacgtaaacgtccttactagtacttacgttagtccgtctccgtacctccttaactaccgtacggtccggtacggtccctacgtcggtttcgtagcggtacgntagtacgagtacggtagacgtacgtcgttaacctactcgtaactacgttanaccgtacgcccgtacgttacgcgaccgngtaccgtaagtataccgtttgtactaaccttaagtttacctaagttaagaaacttaaattacgtaacctccgtcccctcccttacgtccgttcgggttaaccgggacggtaagaaccggtaggacgaagttacgaacgaactcggtaggcc

SEQ ID NO: 271180 - DNA, 755 bp, Homo sapiens
  misc_feature: GYAE6OF01A2IRM.25.4.A04.1.454.CMB.1.raw
  modified_base (573)..(573): a, c, t, g, unknown or other
  misc_feature (573)..(573): n is a, c, g, or t
  modified_base (604)..(604): a, c, t, g, unknown or other
  misc_feature (604)..(604): n is a, c, g, or t
tcagactgtacagtcacgaccggtgctcgatttagagtagtgatcgagggggggagaggacgccccagccgtgagattcccgaggagtctccacttggtgatcgagcactgaacacacgaacccaccaaccagtaggtaggtttgggactttaacgttgtttcctttttccttgttcgtactttaaggtttttaaaaggtcgtcctaaatggtggtggtgacaacgtgggtggagtggtgggggagtcgttggaccgagaccgcgggccccggtaccccgactacctccgtcctcgaccacgacgtccgttaccggacttaccgttacgtttggacgacgactagtcgacttacgtaccggtacccggtacgggtccccgaccggcggtaccgtaccgggaagggggtacgggttcgagggtcggttaggtcggtttagggtacttaaggtaacgaacggtaccggagtacgtacggtagggtacggaaccaaacgtaacgaacgtaccggccgtacggtacgtaaggtaaacgcgtaagtcttaccgaccgtactacgtacgtaagactaanacgttaactaaacaacgactacgtctacgtntacgacgtacagtaagtcgacgtaaccgacgtacggaaggacgacgacgtacgcgtacgtacgtcgtaacttagttaccgttattacttagttactggtacggtaagtttaggtaacgggttttaattaacttaacttaccttaaagtacc

SEQ ID NO: 271181 - DNA, 1072 bp, Homo sapiens
  misc_feature: GYAE6OF01E5D8T.25.4.A04.1.454.CMB.1.raw
  modified_base (326)..(326): a, c, t, g, unknown or other
  misc_feature (326)..(326): n is a, c, g, or t
tcagactgtacagtcacgaccggtgctcgatttagagtagtgatcagggagctctgggagaggacgccccagccgtgagacttcccaggagtctccacttggtgatcagcactgaacacagccaaccaccgatggatttggattaactgttcttttccttgtatcttagttttaaaacggtgtaccctaagtcgtgtaacggttcgacgtaaccgttgggttaggacgttaccggttaggggggtaacggtccgtttacgggtaccaacggtcccggaaccgggttccccgggttcctacgtaaccgtacccgttcctttacccgnggtacccttacgaaccgggttcccgtttacccggtaaccctttaccgttaccggttttacgggtacgtaacgtaccgtacgttacgtaccgttaacgttccggttaccggttaccgggtacccccgtaccgttaaccggtaccgtaaccgggtaaccggggttaacggtttacggtacggtacggtttcggttacggttttacgggttaacgttaacgttaacggtaaccgtaccggtaaacgttaccgttaacgggttaccggggtaacggtaacccctaaaccggaaccgtaaaccggttacccgggacccgttaaccggtttaaacggtaacgggtaaaacgtccggtaaaccgttaaccgttacccgtacccgttaccgtaaccgttaacggtaaacgtaaaccggttaacgtaaaccgttaaacccgtaaccggtaaaacggtaccgtaaacccgtttacccgggttaaccctttaccggttaccgttaccggttaaccgtaaccggttaaccgtacgggtaaccggtaaaccggttaaccggtaaccggtaacgggtaaccgggtaaaccgggtaaccgggtaaccggttaaaccccgttaccggtaacccggttacccggtttaacggtttaacccggttttaaccttttaacccggttttacttttaaccggtttaaccgttaaccgggtttaaaccgtttaacgggtttaaaccgggttttaaacgggtttaaacgg

SEQ ID NO: 271182 - DNA, 784 bp, Homo sapiens
  misc_feature: GYAE6OF01DUX86.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacatccagatcgacccagtcctccacttccctcccttgttctgcacgttcttggttggaacacaagaaatcacgtacactcctacgttcgggaccggggacgaggtcggagggctattagacttaatttagtttacgcgttaggtaactacaacgaacggaaaccgaggggtacgtacggtttaccacgtcctcgtgtactcttatcgcgtacctaccctcctaacctttacgaccgttcgggaacccgggtcctacgtttccgttacggttaccgacggcggtaccaggttacgtaacttacggggtacgggacgtaacggttccgttaaccttacctttaccgtaccgttaaccgttactaccggaacccgttccaacccggttccggtcgacccgtacggttacggttaaagtacggtagttacgttaacgtaccgttttaaacgttactttaaacgttacgtaaaacgtttaaacgtaacttaaaccggttccctacccgtttaccccgttacgtttaaccccggtttaacggggttcccggggaaacgggttaaaccccggggttaaacggaacggggttaacgggaaacgttaacccggtaaaacccgaaaccgggtttaggtaacccgggg

SEQ ID NO: 271183 - DNA, 746 bp, Homo sapiens
  misc_feature: GYAE6OF01BMKEE.25.4.A04.1.454.CMB.1.raw
  modified_base (116)..(116): a, c, t, g, unknown or other
  misc_feature (116)..(116): n is a, c, g, or t
  modified_base (421)..(421): a, c, t, g, unknown or other
  misc_feature (421)..(421): n is a, c, g, or t
  modified_base (490)..(490): a, c, t, g, unknown or other
  misc_feature (490)..(490): n is a, c, g, or t
tcagactgtacagtcacgaccggtgctcgatttagagtagtgatcagggggcagaagtctctctcagtcaggacacagcatggacatgagggtccctgctcagctcctgggcttcngctgctctggctcccgaggtgccaaatgtgccatcccagttcgacccacgtctcccattcccctccctgtcctcgccttcgtgttccgagtacatacgtaccaacactcaccgttggtccgggtactaggtcggtactacgtgggcctaggtgtcctttacgcgttggtatcgacgacaacggaaaccgacgggaacgtctaccgaacgtcctcctagtacttcgttgacgttcgtccttaccgtaaggttttagggaaacgttcggtaacgtaccctagtacggttaaagtccgaggtaccggngtaggtacggtagtaccgtagggacctaagtactttccgtacctccgtaccaccgtactccgaacccgngtccgtaccgtcggaccgtacggtccgttaagaacgttacgttacgaccgttaacctaaccgtttaattaacctaccgttaaccgttaaacgttaacgtttaaacgtacccctttaccccgtactttccccggtttccgggtaaccgggtaccgggtaaccggggtaaacccggtaagggttaaccgggtacttaaaccggtaacccgtaaaggtaacccgttcggaaccggttccgtaccgtaccgttaccccgg

SEQ ID NO: 271184 - DNA, 623 bp, Homo sapiens
  misc_feature: GYAE6OF01DQTT3.25.4.A04.1.454.CMB.1.raw
  modified_base (220)..(220): a, c, t, g, unknown or other
  misc_feature (220)..(220): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttgccgggnagtcgagggcattagctaattatttagctaggtatacaacaagaaaccgagggacgagttacctaagctcctgatctatgctcgcctacctacgttacacgtcgacgggtccacttcgtcggttcaggcggctaggtacgaactcgtagggacaggtacgttccactcgtcacgttacacagtccacgtcctgaccgacggtaccgtaggaaacgtagtttacgttacgtaaccgtaacttttaagttaacgtaacggttaaacttaaaaggtttacttaaacgttaccctaccggttacccccttcttaacccggttacccggttttaccggggacgggttaaacgggaacccgtaagggtacggtaacgtaacgtaacgaaaccggtacgttggtaaccgg

SEQ ID NO: 271185 - DNA, 756 bp, Homo sapiens
  misc_feature: GYAE6OF01A9WSG.25.4.A04.1.454.CMB.1.raw
  modified_base (220)..(220): a, c, t, g, unknown or other
  misc_feature (220)..(220): n is a, c, g, or t
  modified_base (705)..(705): a, c, t, g, unknown or other
  misc_feature (705)..(705): n is a, c, g, or t
  modified_base (734)..(734): a, c, t, g, unknown or other
  misc_feature (734)..(734): n is a, c, g, or t
tcagactgtacagtcacgaccggtgctcgatttagagtagtgatcagggtctgtgaaggcttcaccagtcctggacctcctgtgcaaagaacatgaaacacctgtggttctccctcctgctggtggcagctcccagatgggtcctgtcccaggtgccagctgcgaggagtccgggcccaggactgggtgaacgccttacacgacgtaccctcgtcccctnaccgtgccactgtctcgtggtcgcctccactccaccgtaggttggttactacctaacttacggtaggacgtcgtaggtacctaccgccaccgccgaaccccggaagggggacggccggtgggtacggtaggtacggttacgggtaactacgtttcgttaaccggttaccgggtagggaccgtaccgtacccgtttaacccgtaaacccgtaacccccgttacccgtacgtaaacgttaccggtacgtaacgttacccacctactttacctacgtaatttaaccggaaccttaccgtaacgtaaacgtaaccgtacgtttaccctacccgttaaggttacgtttaacgtaccttacgttacggacgtaccgccggacccggtaccgaccggtaaccggttccggtagttacgtcgtacggtccggtcgtacgttactaaccgtaacgtacgtaaccgtggtacggacctatacgtccaaccgtacnccgtaagtgttacgttacttaggttaccncgttaccggccgggtaaacggg

SEQ ID NO: 271186 - DNA, 718 bp, Homo sapiens
  misc_feature: GYAE6OF01EZPEZ.25.4.A04.1.454.CMB.1.raw
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (542)..(542): a, c, t, g, unknown or other
  misc_feature (542)..(542): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctcggcctcccagataccagatgtgaccgtccagactcgaccctagtcctcctactccccttcctgtctcgcctagttccgtggttaggacgaacctagtaactccagtcctaacttccgtaccggttcgggcccgggtactaggtaccggaggtactaacgtttagaacttaaattttcgtttaccgacgttagtaactacgaaacgtaacggtaaccggaggtaacggttaccgtttaccgtaaacgtccttaccgtagttaacttccgttaagtccgtactcccgtaccctaccggtaacctaccgtcgtaccggtaccggtcctacgttccgtcggtcgngtaccgngtagtacgaacgtggaacggaacctgtacgttccacttcctacattaccgagactcgactcgtagccncggtacagtacgttagcgtttacaactttacgtttagtaaccgttattaaaaccggttacttaaccgttaccgtaccctccgttacccctcgttacggtttacccggacgggaccgggttaacgaaccgggttaaggtacgaacggttacctaaaggtacccgtggtaccgtaccg

SEQ ID NO: 271187 - DNA, 678 bp, Homo sapiens
  misc_feature: GYAE6OF01CI0OE.25.4.A04.1.454.CMB.1.raw
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
  modified_base (482)..(482): a, c, t, g, unknown or other
  misc_feature (482)..(482): n is a, c, g, or t
tcagactgtacagtcacgaccggtgctcgatttagagtagtgatcagggggcagaagtctctctcagtcaggacacagcatggacatgagggtccctgctcagcctcctgggactcctgctgctcgtggcctcccagactaccagatgtgacgtccagatcgaccctagtcctcactccctcctagtctgctattcgtgttgagacagaatcacnctatcacgtcggccggngagtcggaggtactagttacgacttaagtttaattacggctagtactacaacgaacgaaccgagggtaactacgttacctacgtcctctagtacttcttagtcgtcctccgtccctaccgtacgttaccgacgttaccggtacggtaccctagttccgttccggtcgacggtccggacgtagttacgacggtggtacggaccgtagttacttccgtacctctactaactcgtacgacgtcaccgtaccgnacgtccgtagtaagtacgttatagttccgtaacttaactttaacgttacgtaacttaaagttaaacttacgtttaaccgtcccttaccccgttcccgttaaccgttacccgggttccggtaacccgggggtacggaaccgggttaacggtaaaggttacgtaacggtaaacaaccggtaacggtcggttcgtaccg

SEQ ID NO: 271188 - DNA, 734 bp, Homo sapiens
  misc_feature: GYAE6OF01A10H1.25.4.A04.1.454.CMB.1.raw
  modified_base (198)..(198): a, c, t, g, unknown or other
  misc_feature (198)..(198): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctccagataccagatgtgacgtccagatcgacccagtctccattccctccctgtctgctatctgttgganacagaatcagcatctacgtggccggacgagtcgaggctattagactaattagttacgcctgtaactacaacgaacgaaaccggagggaacgtacgttaccgtaactaccgttccgtagacttactatccggtctaccggtcccttacctaaccgtttaccgacgttccggtaccgggtcccctagttccgtcggttccaggcgtacgaggtagtaacgtcggtacgggtaacctaggtacgttacctacctactacctaaccgttacgtacgtacggaccaccggtacccgttcgaccgtacgtacccgtagtaacgttagtttacgttaaccgttaacgtttaaacctttacgtttaaccgttaacgttaaacgtaaaagtttaacctaaccgttacccgtaccccgtttccccgttacccgttaacccggttaaccggtttacccggggaaaccggggtaccggggtaaacgggtaagggtaacccggtaggtaaacccttaaacggggtaaacccctagggttacggtaccgg

SEQ ID NO: 271189 - DNA, 861 bp, Homo sapiens
  misc_feature: GYAE6OF01E02YD.25.4.A04.1.454.CMB.1.raw
  modified_base (185)..(185): a, c, t, g, unknown or other
  misc_feature (185)..(185): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatggtgacgtccagactcgacccagtcctccactcctcctgtcngctatctggttgagacagaatcagcatccgacgttgggccgggtcgaggtcgagggtataagttagaaccttaagtttagtttacgccgttaggtaactaaccgaaacgaacggtaaaccggaggggtaagtacgtttaccgtaacgtccgttacctacgtacttacgttacgtacggtaccgttaccgtaccccgttacccgttaaaccgttaaccccgtaccggtttacccgggtaacccggggggtttacccctttaaccggtacccgggttttaccgggttaccgtaaccggggccgggttaccggttaaacggttacggttaaccggtttacgggtaccgggtaacggttaacgtacgggttttacccctaacgttacctttaaccctaacttaacgttcacggtaccgtaccggttcgaccgaaccgtacgtaccgggttaagtaaacgttcggtttaatacccggtttaaacttaacgtttaaccgtttaaaccgttacgttaaaacgtttaaacgttaacgtttacggtaccccgtcccgtttaaacccgttccgttaaaccgggtttcccggggttaccgggggtaaaccgggacgggtaaacgggtaaggggaacccgttaaaacggtacggtaaaaccccggtaaggtaaccgttgggtaacccg

SEQ ID NO: 271190 - DNA, 787 bp, Homo sapiens
  misc_feature: GYAE6OF01EZOHD.25.4.A04.1.454.CMB.1.raw
  modified_base (291)..(291): a, c, t, g, unknown or other
  misc_feature (291)..(291): n is a, c, g, or t
tcagactgtacagtcacgaccggtgctcgatttagagtagtgatcagggggggagaggagccccagccgtgagattcccaggagtctccacttggtgatcagcactgaacacacgaccaccaaccatggagtttgggcttaactgttcttttccttgttgcttagttttaaaggtgtccaatgtgaggtgacagtggtggagtcgtgggggagtcgttggtacaggccgaggcccgtccctgaccgtactctccgtgccacacgtccttaccggacctcgttacgtttggngacgtcgtatcgtactagtcgtaccgtcgggtccccgacgaggtcctacggagggggtaacggttcggtaggacggtttcgggtacggtttcgggttacaagtttacggaacggtacgaaacggttccgttaaggtcggggtaacggacctaaacgacgtaacgtccggccgtacgtagtaacggtaaaacgctacgtacgttccgacgtaccttacgtaacggaagtacgtacgttaacggttaaacgttaaacccgaaagttccaccggtttacgtaacctttacgtaccgttacgaactacgttaacgagtaacggtccaacggtaccgtagggaacgaaccgtacgggaaccgttacgtaccgaaggttacccgtttagtttaaacccgttttgtttaccgttttaacgttaatttaccccggtagttaaacgggtcggttttaaacgggttagttttaaacgtttttacctttaaagtttccctttaaagg

SEQ ID NO: 271191 - DNA, 737 bp, Homo sapiens
  misc_feature: GYAE6OF01C090F.25.4.A04.1.454.CMB.1.raw
  modified_base (644)..(644): a, c, t, g, unknown or other
  misc_feature (644)..(644): n is a, c, g, or t
tcagactgtacagtcacgaccggtgctcgatttagagtagtgatcgaggggggggagaggacgccccagccgtgagattccccaggagtcctccacgttggtgatcagcactgaacacagaccaccaacagtggagtttggacttaactgttcttttcgtgttgtcttagtttaaaggtctccaagtgtgtagttgacgtaagtgggaggtacggtcggtaggggggagtcgttagggaccacgcccgaacgggtccccggtccctagaacctccttccgtcctagccacgtcgtccgttacccgcttaccgttcgttgggtcgaagctagtcgtcttacgtccggtacccggtcggggtacccgacggacggtccgtaccgggaaggggttaaccgggtcgttagggtacggtcggtttccggtttagggtataacggttaaggaacggacggtaaacgtcgtagggtcgggacggtaaccaaacgaacgtacgtaccggtcgtacgtagtaacgtaaacggctaaggtacctacgacgtcctacgtaacgagtacgtagacgtaacgtaacaacgtctcgtccctaacgtcctgcgaactaggacgtcgaaccgtacgtaacggtcgaaggacgttaccggngtaccgataccggtacgtcgtatttcgttaccgtttgttaccttactagtcgtaagtacggttactttagtattttaactaacgttaactaac

SEQ ID NO: 271192 - DNA, 720 bp, Homo sapiens
  misc_feature: GYAE6OF01CAFDS.25.4.A04.1.454.CMB.1.raw
  modified_base (199)..(199): a, c, t, g, unknown or other
  misc_feature (199)..(199): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctcggctcccagactaccagatgtgaccgtcagatcgaccagtcctccactccctcctgtctgctatcgtgtgganacagaactcagcatcacgttcggccgggcgtagtcgacgggtactagttacgacttaattagtttacgccgtaggtaactacgaaacaacgtaaaaccggagggtacgtaacgttaccgtaacgtccttacgtagtacttacgtacttcggtaccttaccggtaccccttacccgttaaccgttacctaccgttaccggtaccggggttaccctacgttacccgtacggttcgaacggtcggacgtacgtagtacgtcggtacggactacgttacgttacctactacctacgtaactacctacggaacgtccgtaaccgtcgtaaccgctaacggtaccggtaagtaacgttacgttcgtacgttaacctttaactttaacgtttacggtaacttaaaacgtaaacgttaaccttaacgtaccgttaccccgttcccgttaacgttcccgttaccgggtttacgggaacgggtaaccggacggttaaggacgacgtaacgtaaccgaacgtgtcggtaccg

SEQ ID NO: 271193 - DNA, 851 bp, Homo sapiens
  misc_feature: GYAE6OF01B54D0.25.4.A04.1.454.CMB.1.raw
  modified_base (216)..(216): a, c, t, g, unknown or other
  misc_feature (216)..(216): n is a, c, g, or t
  modified_base (308)..(308): a, c, t, g, unknown or other
  misc_feature (308)..(308): n is a, c, g, or t
tcagactgtacagtcacgaccggtgctcgatttagagtagtgatcgagggggcaagaagtctctctcagtcaggacacagcatggacagtggacgggtccctgctcgagctccgtagggactccgtgtctgacctcgtcggcctcccaagactaccgagtatcggtacgacgtaccagtagtacaccctatcctaccacttcccgtccgtagtccngtactacttcgtaggttacggacaacgtaagaactcgaacgcctactacgtacgttgggcccgaaggtcgttacgaacggtctaaagttacncgtttaaaagttaccgttcggacttttaacgggaaacttaccgaaaacgtaaaccgggaacgtaaggggttaccttaacgttaaccctggtacccttacggattaaaccttcgttaccgagtcctttacccgaccccttaacgggttactaaaccccgtaggttaaccggggttaccggtttaaccccgtacgttttccggtacccgggtaaaccggtcgggaaaaacttttcggaacggtttaacgggttaacccggtgggtacccgggtaaaccggtaagtccgttacctaccgtttccggtaacttaaccctaggtaaccgaacggtaccgacgtaacccgctaacgtccgtaaccgttaaggtaaccgtacggttaacggtttccaagtttaaccttagtaaaccgtaagttaaacgttaacgttaacgtaaccgtccgttaccgtaccctgtttaacccggtacgggttaacggccgggtaaacgggtaacgtaaggaacgtaaacgtaccgttaacggtaacgtggaacgttaccgg

SEQ ID NO: 271194 - DNA, 822 bp, Homo sapiens
  misc_feature: GYAE6OF01BKMST.25.4.A04.1.454.CMB.1.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
tcagactgtacagtcacgaccggtgctcgatttagagtagtgatcagggggcagaagtctctctcagtcaggacacagcatggacatgagggtccctgctcagctcctgggactcctgctagctctggcctaccagactaccagattggtcgacgtcagatcgaccctagtccactacttcccgtcctagtcncgcctatctggttagatacagtaactcgaacncaattccgtacgtcggccggggactagtcggaggctatagactaatttacgttacgccttagtactaccaacggtaacaaaccggagggtacgttaccgtaacttaaccggctttacccgacggttacttaccgttaagtcgggttacccttccgttacccgttaccccggttaacctttaaccggtaccgttaccgggggttaaacccggttccccgtacgtttaaccgggtttcccggtttaaacgccggggtaccgttaccggtagttaacgttaacggtttcggaacggggttaaacgtccggtttaacgttaccgttaccttaaccgtacgttaacgtttacgaccctaaggttacccacccgggttcgttaacggccgtaacccgtaaggtacgttacgggttaatacggttacgttaacgttaacccttttaagttacccgttaaattaaacgttaaagtttactaaacgtttcccctaccggtttaccctacgtttaacccggttaccggtacccggggttaacggtaccgggtaaccggtaacgggtacgtaaacgtaaccgtaacgttaaacccgtggtacggtcgg

SEQ ID NO: 271195 - DNA, 490 bp, Homo sapiens
  misc_feature: GYAE6OF02GTBDS.25.4.A04.1.454.CMB.1.raw
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (433)..(433): a, c, t, g, unknown or other
  misc_feature (433)..(433): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcaggacattagcaattatttagcctggtatcaacagaaaccagggagagttcctaagctcctgatctatgctgcctccacgttacactcaggggtcccatctcgttcagcggcagtgaatctgggacagagttcactctcactatcagcagcctgcagcctgaagntgttnactaacttattactgtacaaaagtataatactcgccctntcctactttcggcggtacggaccgtaaggtacggagatacgaaacgtactggtacgg

SEQ ID NO: 271196 - DNA, 493 bp, Homo sapiens
  misc_feature: GYAE6OF02HOSJD.25.4.A04.1.454.CMB.1.raw
  modified_base (389)..(389): a, c, t, g, unknown or other
  misc_feature (389)..(389): n is a, c, g, or t
  modified_base (434)..(434): a, c, t, g, unknown or other
  misc_feature (434)..(434): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcaggggtcccatctcggttcagcgcagtgaatctgggacagagttcactctcactatcagcagcctgcagcctgaagntgttgactaacttattactgtacaaagtataattactgacccctntccgtactttccggcggaacggacccgaaggtcggaagacgtacaaacgtactgtacgg

SEQ ID NO: 271197 - DNA, 588 bp, Homo sapiens
  misc_feature: GYAE6OF02J0BUK.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattattagcctggtatcaacagaaaccagggagagttcctaagctcctgatctatgctgcctccacgttacactcacggggtccatctcgttcagcggcagtgaatcgtggacagagttcactctcactatcagcagcctgcagccctgaagtacgttgttacgactaacgtttaacttaccttagttaacctaaaagttaacttaaacttaaccgttaccgtaccccttaccttaccgttaaccgtttttacccggggaccggggtaaaccggggttaacccgtaaacggggttacgggttaaacggtaacgttaacccgtaaaaccgggtaaccgttggggttaacccggg

SEQ ID NO: 271198 - DNA, 491 bp, Homo sapiens
  misc_feature: GYAE6OF02F84IB.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctcacgttacactcaggggtcccatctcggttcagcggcagtgaatctgggacagaattcactctcaccatcagcgcctgcaacctgatgattttgctaacttattactgccagcagtattaatttttactcttgtcgtttcccttttggcctagggggaccctagggtggagaggcaaggcgaacgtgtcggg

SEQ ID NO: 271199 - DNA, 497 bp, Homo sapiens
  misc_feature: GYAE6OF02JZSD8.25.4.A04.1.454.CMB.1.raw
  modified_base (370)..(370): a, c, t, g, unknown or other
  misc_feature (370)..(370): n is a, c, g, or t
  modified_base (386)..(386): a, c, t, g, unknown or other
  misc_feature (386)..(386): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccagggagagttcctaagctcctgatctatgctgcctccacgttacactcacggggtccatctcgttcagtcgcagtgaatctgggacagagttcactctcactatcancagcctgcagcctgantgtgctacttattactagtacaaagtataatactcgtaccctctcgtaaccgtttcggacgggtaacggtacccgaaggtacggtagacttacgaaacgtactaggtacgg

SEQ ID NO: 271200 - DNA, 486 bp, Homo sapiens
  misc_feature: GYAE6OF02G96A4.25.4.A04.1.454.CMB.1.raw
  modified_base (219)..(219): a, c, t, g, unknown or other
  misc_feature (219)..(219): n is a, c, g, or t
  modified_base (469)..(469): a, c, t, g, unknown or other
  misc_feature (469)..(469): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagcaattatttagcctggtatcaacagaaaccagggagagttcctaagctcctgatctatgctgcctccacgttacactcaggggtccatctcggttcagcgcagtgaatctgggacagagttcactctctactatcagcagcctgcagcctagaagatgttgactaacttattactgtactaaagtataatactcgccctctctacgttcggacggtacggacgaaggtggagtanacgaacgacgtgtacgg

SEQ ID NO: 271201 - DNA, 473 bp, Homo sapiens
  misc_feature: GYAE6OF02GERYC.25.4.A04.1.454.CMB.1.raw
  modified_base (428)..(428): a, c, t, g, unknown or other
  misc_feature (428)..(428): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctcacgttacactcaggggtcccatctcggttcagcggcagtgaatctgggacagagttcactctcactatcagcagcctgcagcctgaagatgttgcaacttatactgtacaaagtataatactgccctntcactttcggcggagggacaaggtggagagtcaacgactgtacgg

SEQ ID NO: 271202 - DNA, 490 bp, Homo sapiens
  misc_feature: GYAE6OF02F89MH.25.4.A04.1.454.CMB.1.raw
  modified_base (392)..(392): a, c, t, g, unknown or other
  misc_feature (392)..(392): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcacggggtcccatctcggttcagcggcagtgaatcgtgggacagatttcactctcactatcagcagcctgcagcctgaagntgttgcaacttattactgttacaaaagtataaatactgccctctcactttcggacggtaggacccgaaggtggagtacgtacaaacgtacgtgtacgg

SEQ ID NO: 271203 - DNA, 494 bp, Homo sapiens
  misc_feature: GYAE6OF02F0C41.25.4.A04.1.454.CMB.1.raw
  modified_base (219)..(219): a, c, t, g, unknown or other
  misc_feature (219)..(219): n is a, c, g, or t
  modified_base (336)..(336): a, c, t, g, unknown or other
  misc_feature (336)..(336): n is a, c, g, or t
  modified_base (391)..(391): a, c, t, g, unknown or other
  misc_feature (391)..(391): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaattatttagcctggtatcaacagaaaccagggagagttcctaagctcctgatctatgctgcctccacgttacactcaggggtcccatctcggttcaggcgnagtgaatcgtgggacagagtcactctcactatcagcagcctgcagcctgaacgtntgttgactaactttattacgtgtacaaagtataactactcgccctctacgtactttcggacggaacgggacctaagggtcgagacgtacaacgtacgtgtacg

SEQ ID NO: 271204 - DNA, 485 bp, Homo sapiens
  misc_feature: GYAE6OF02IEEBN.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctcgcctcacgttacactcagggtccatctcggttcagcggcagtgatcgtgggacagagttcactctcatactcacgcagcctgcagcctagaagatgttgactaacttattactgtacaaagttataatactgaccctctacgtcttacggcggaggtaccgaggtagagatacaaacgtcgtagtacgg

SEQ ID NO: 271205 - DNA, 487 bp, Homo sapiens
  misc_feature: GYAE6OF02JXH75.25.4.A04.1.454.CMB.1.raw
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgagacagaatcagcatcacttgccgggcgagtcagggcattagcaattattagcctggtatcaacagaaaccagggagagttcctaagctcctgatctatgctgcctcacgttacactcgacgggtccatctcgttcagtcgcagtgaatctgggacagagtcacgtctcactatcagcancctgcacgcagantgtgactacttattactntaactaaagtataatactgccctntacttacgttacggacggacggtaacgaaggtaggaacgtatacgaaacgtacgtgtacgg

SEQ ID NO: 271206 - DNA, 509 bp, Homo sapiens
  misc_feature: GYAE6OF02GD58Z.25.4.A04.1.454.CMB.1.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctggggggaggcttgggtacagccaggccggtccctgacactctcctgcacagcttccggactcacctttggtgagcatgctatgacctgggtccgccaggctccgagggaagggtctggagtggcttgggttcattagaagcgaagcctatggtggggcaacacaatacgccgcgtctgtaaaaggcagattcagcctctcaagagatgattaccaaaagcatcgcctatctgcacatgagcagcctgagaagcgagactcagccgtatattactgttcttattactctgagtagtagttag

SEQ ID NO: 271207 - DNA, 506 bp, Homo sapiens
  misc_feature: GYAE6OF02F7301.25.4.A04.1.454.CMB.1.raw
  modified_base (388)..(388): a, c, t, g, unknown or other
  misc_feature (388)..(388): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccagggagagttcctaagctcctgatctatgctgcctccacgttacactcaggggtcccatctcggttcagcgcagtgaatctgggacagagttcactctcactatcagcagcctgcagcctgaagntgttgactaactttattactgttacaaaagttataaactactacgtcccctctactacgtttccggcggaacgggtacctaagggtacggagtaacgtacgaaacggtactagtacgg

SEQ ID NO: 271208 - DNA, 536 bp, Homo sapiens
  misc_feature: GYAE6OF02IUB1C.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcaggggtcccatctcggttcagcggcagtgaatctgggacagagttcactctcactatcagcagcctgcagcctgaagatgttgacctaactttattactgtacaaaagtacttaaatactacgtcccctacttaccgtaccgttttaccgggaccgggtaacgggtacccgtaaagggttcgggaacggtacgtacccgaaaaacggtaaccgtggttaccggg

SEQ ID NO: 271209 - DNA, 501 bp, Homo sapiens
  misc_feature: GYAE6OF02JY6L5.25.4.A04.1.454.CMB.1.raw
  modified_base (197)..(197): a, c, t, g, unknown or other
  misc_feature (197)..(197): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacngaatcagcatcacttgccgggcagtcaggcattagcaattattagcctggtatcaacagaaaccagggagagttcctaagctcctgatctatgctgcctcacgttacactcagggtccatctcgttcagtcgcagtgaatcgtagggacagagtcactctcactatcagcagcctgacagcctagaacgtatcgttgacctaacttattactgtacctaaagtataactatcgccctactacgtacgtttcggacggtacgggacctaaggtacggtacgaactacgaaacgtactacgtacgg

SEQ ID NO: 271210 - DNA, 492 bp, Homo sapiens
  misc_feature: GYAE6OF02ILYXE.25.4.A04.1.454.CMB.1.raw
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcacggggtcccatctcggttcagcgcagtgaatcgtgggactagagttcactctcactatcagcagcctgcacgcctgaagattgtnactaacttattactntacaaaagtataaactctcgccctctctacgtttcggcggtagggaccaagggtcggagatacgaaacgtacgtgtcgg

SEQ ID NO: 271211 - DNA, 522 bp, Homo sapiens
  misc_feature: GYAE6OF02I0QPF.25.4.A04.1.454.CMB.1.raw
tcagactgtacagtcacgaccggtgctcgatttagagtagtgatcagggaccggcctggctgtaccaagcctccccagccgtgagattcccaggagtctccacttggtgatcagcactgaacacagaccaccaaccatggagtttgggcttaactgtcttttccttgttgctgtttaaaaggtgtccaatgtgaggtgcaactggtggagtctgggggagcttggtacagccaggccggtccctgacactctcctgcacagcttccggactcacctttggtgagcatgctatgacctgggtccgccaggctccgagggagggtctggagtggcttgggtcattagagcgaagcctagtggtgggcaacacaatacgcgcgtctagtaaagcagattcagcctctcaagagatgacttaccaaagcatcgcctatctgacacatgacgcacgctagagagcgaggactcgacgtccgtgtaacttacgttgtttacttatttacctcgtagtagtaggttagg

SEQ ID NO: 271212 - DNA, 501 bp, Homo sapiens
  misc_feature: GYAE6OF02GPG7L.25.4.A04.1.454.CMB.1.raw
  modified_base (444)..(444): a, c, t, g, unknown or other
  misc_feature (444)..(444): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccagggagagttcctaagctcctgatctatgctgcctccacgttacactcaggggtcccatctcggttcagcggcagtgaatcgtgggacagagttcactctcactatcagtcagcctgcagcctagaagatgttgactaactttattactgttaacaaaagttataaattactcgccccttntccgtactttcgggacggagggaacctaggtaggagtatacgaaacgtactgtacgg

SEQ ID NO: 271213 - DNA, 490 bp, Homo sapiens
  misc_feature: GYAE6OF02JGLN3.25.4.A04.1.454.CMB.1.raw
  modified_base (391)..(391): a, c, t, g, unknown or other
  misc_feature (391)..(391): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcaggggtcccatctcggttcagcggcagtgaatcgtgggacagagttcactctcactatcagcagcctgcagcctgaagntgttgctaacttattactagttacaaagtataatactcncccttacnctactttcggacggtacggaccgaaggtggagactacgaacgactggtacgg

SEQ ID NO: 271214 - DNA, 500 bp, Homo sapiens
  misc_feature: GYAE6OF02G6MGX.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcaggggtcccatctcggtcagcgcagtgaatcgtgggacagagttcactctcactatcagcacgcctgcagcctagaagatgttgctaacttattactatactaaaatttgaactagtcgaccgtggagtggttaccggccgtacgggaccgtaagggtcggaacagtaccgaaacgtacgtggtacgg

SEQ ID NO: 271215 - DNA, 495 bp, Homo sapiens
  misc_feature: GYAE6OF02JBWO0.25.4.A04.1.454.CMB.1.raw
  modified_base (269)..(269): a, c, t, g, unknown or other
  misc_feature (269)..(269): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccaggganagttcctaagctcctgatctatgctgactcacgttacactcacggggtccatctcgttcgngcgnagtagactcgnggacagtacgtcactctctactactcancacgctcgcgacgcgtagagtagtgtcgtactactacttactactaactaataataatactactcctctacgtcgtacgtacggacgacgtaggtacgacgacgtacgaacgtacgtagtcg

SEQ ID NO: 271216 - DNA, 679 bp, Homo sapiens
  misc_feature: GYAE6OF02JAU48.25.4.A04.1.454.CMB.1.raw
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatcctccctgtctgcatctgttgganacagaatcagcatcacttggccgggcagtcagggcattagcaattatttagcctggtactcaacagaaaccagggganagttaccaagctcctgatcgtatgctgcctcacgttacactcgacgggtccatctcggttcagcggactagtcgaatcgtagggactagtacgttcactcgtacacttatccgaagtccaacgtccttagacctacggccttaaggaaagtcgttacgggttacaaccgtttaaacgttttaacgtttaacccgttagggttaaaaccttaaaaacgggtttaactttaaaaaccgttacccgttaccggttacccccctttaagttaccccgtttaaccgggttttaacccggggaacccgggggttaaaccgggtaaacccgggtttaacgggggttaaccggttaacggtaaaccccgtttaaaccgaaaaacccgggttaaccggttcgggttaacccgggg

SEQ ID NO: 271217 - DNA, 494 bp, Homo sapiens
  misc_feature: GYAE6OF02FXZWD.25.4.A04.1.454.CMB.1.raw
  modified_base (219)..(219): a, c, t, g, unknown or other
  misc_feature (219)..(219): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttggccgggngagtcagggcattagcaattatttagcctggtatcaacagaaaccagggagagttcctaagctcctgatctatgctgcctccacgttacactcgacggggtccatcgtcgttcagcgcagtgaatcgtgggacagagttcactctcactatcagcagtcctgcagcctagacgatgttgactaactttattactgtacaaaagttataatactcgtccctctcctacgtttcggcggtaggaccgaggtcggacgtatacaacggtactggtacg

SEQ ID NO: 271218 - DNA, 570 bp, Homo sapiens
  misc_feature: GYAE6OF02HTBM2.25.4.A04.1.454.CMB.1.raw
  modified_base (274)..(274): a, c, t, g, unknown or other
  misc_feature (274)..(274): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcgagggcattagactaatttattagcctggtatcaacagaaaccaggganagttcctaagctcctgatctatgctcgcctctacgttacactcgacgggtcccatctcggttcaggcgcagtgaatcgtagggacaggtacgttcacttctctaacttatcagccagcctgccagtcctagaagtagttgttacgacttaaactttacttacgttaagtaaactaaaaagttaactaaacttaccttacgtacccccttacttaccgttaaccggtttaccggggacgggtaacgggaaccgtaagggtcggaacgtacgttaaccgaaacgtacgtaggtaccgg

SEQ ID NO: 271219 - DNA, 516 bp, Homo sapiens
  misc_feature: GYAE6OF02IHXGC.25.4.A04.1.454.CMB.1.raw
tcagactgtacagtcacgaccggtgctcgatttagagtagtgatcagggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggaggcttggtacagccaggccggtccctgacactctcctgcacagcttccggactcacctttggtgagcatgctatgacctgggtccgccaggctccgagggagggtctggagtggcttgggttcattagaagcgaagcctatgggtgggcaacacaatacgccgcgtctagtaaaaggcaagattcagcctctacaagagatgattaccaaaagcatcgcctatctgcacatgagcagcctgagaagcgagactcgacgccgtagtacttactgtttcttattactctagagtagtagttag

SEQ ID NO: 271220 - DNA, 499 bp, Homo sapiens
  misc_feature: GYAE6OF02GYJR3.25.4.A04.1.454.CMB.1.raw
  modified_base (443)..(443): a, c, t, g, unknown or other
  misc_feature (443)..(443): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattattagcctggtatcaacagaaaccagggagagttcctaagctcctgatctatgctgcctccacgttacactcgacgggtccatctcgtcagcgcagtgaatcgaggacagtacgtcacgtctcactatcagcacgccttggcagccgtagaagtatgttgacctacttattactgtaactaaagtataactactcgtacccttntacgtacgttcggacggacggtaacgtaggtaggacgagtacaacgtactgtacgg

SEQ ID NO: 271221 - DNA, 559 bp, Homo sapiens
  misc_feature: GYAE6OF02I78TL.25.4.A04.1.454.CMB.1.raw
  modified_base (384)..(384): a, c, t, g, unknown or other
  misc_feature (384)..(384): n is a, c, g, or t
  modified_base (474)..(474): a, c, t, g, unknown or other
  misc_feature (474)..(474): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcaggacaattagctaattatttagcctggtatcaaacagaaaccgagggagagttacctaagcctcctgatctatgctgccctcctacgttacactcgacgggtccatctcggtcaggcgctagtgaatcggtagggacagtagttcactcctcaacttntcagcacgcctgcacgcctagaagtattgtagtaccttaactttacttacttacgtaaactaaaagtacttaaactactccgtacccctnttaccgttaccggtttaccgggacgggtaacgggtaacgtaagggtacggaacgtaacgtaaccgaaacggtacgttggtacggg

SEQ ID NO: 271222 - DNA, 510 bp, Homo sapiens
  misc_feature: GYAE6OF02G52X2.25.4.A04.1.454.CMB.1.raw
  modified_base (219)..(219): a, c, t, g, unknown or other
  misc_feature (219)..(219): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaattatttagcctggtatcaacagaaaccagggagagttcctaagctcctgatctatgctgcctccacgttacactcgagggtccatctcggtcagcgcagtgaatcgtgggacagagttcactctcactatcagcacgcctgcacgcctagaagatgttcgactaactttattactagtactaaaagtataactactcgcccttctccgtacgtttcgggacggtacgggaaccgtaagggtcggaacgtactaacgaaacggtactaggtacgg

SEQ ID NO: 271223 - DNA, 508 bp, Homo sapiens
  misc_feature: GYAE6OF02GWTND.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctcacgttacactcaggggtccatctcgttcacgcggcagtgaatcgtggacagagttcaactctcactatcacgcagcctgcgagcctagaagtatgttgactaactttattactgtaacaaaagttataattactcgtccctctactaccgtttcggaccggaggtaaccgaaggtaggtaacgacgtacgaaacgtacgtaggtacgg

SEQ ID NO: 271224 - DNA, 503 bp, Homo sapiens
  misc_feature: GYAE6OF02IWVUX.25.4.A04.1.454.CMB.1.raw
  modified_base (258)..(258): a, c, t, g, unknown or other
  misc_feature (258)..(258): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagtggttatcactactgganctggatccgccagcacccagggaaggcctggagtggattgggtacatctattaccgtgggagcaccttcaccaacccgtcctcaatacgtcgagtcaccatctcattacgacacgtctaagaccagttctccctgaagttgaactctgtgactgccgcgacacggccgtntattacngtgcgcatactacgatactagtcggcatacgtcacatcacgtatcgtcttttgatactcgtgggaccg

SEQ ID NO: 271225 - DNA, 547 bp, Homo sapiens
  misc_feature: GYAE6OF02GRNFB.25.4.A04.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttggccgggngagtcagggcattagctaattatttagcctggtatcaacagaaaccagggagagttacctaagctcctgatctatgctcgcctcctacgttacactcgacggggtcccagtctcggttcacggcggcagtgaatcgtagggacagtagttcacttctacactatcagcacgctcgcacgcctagaatagtgttagacttaacgtttacttacgtagtaactaaaagtattaaactacctacgtaccccttctacgttaccgtttcgggaccggtaacgggaacccgtaagggacggtacgaacttaaccggaaacgtacgtgtacgg

SEQ ID NO: 271226 - DNA, 521 bp, Homo sapiens
  misc_feature: GYAE6OF02IAAPN.25.4.A04.1.454.CMB.1.raw
tcagactgtacagtcacgaccggtgctcgatttagagtagtgatcaggggagctctgggagaggagccccagccgtgagattcccaggagtctccacttggtgatcagcactgaacacagaccacaaccatggagtttgggcttaactgtcttttccttgttgctgtttttaaaaggtgtccaatgtgaggtgcaactggtggagtctgggggaggcttggtacagccaggccggtccctgacactctcctgcacagcttccggactcacctttggtgagcatgctatgacctggtcccgccaggctccgagggaagggtctgggagtggcgttgggttcattagaagcgaagcctagtggtggggcaaacacaatacgccgcgtctagtaaaacggcagattcagcctctacaagagatagattaccaaaagcatcgcctatctagcacatgagcacgcctgacgaagcgagactcgagccgtagtattactgttcttattctctagtagtagtagttag

SEQ ID NO: 271227 - DNA, 634 bp, Homo sapiens
  misc_feature: GYAE6OF02INX5W.25.4.A04.1.454.CMB.1.raw
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctccagatgggtcctgtcccaggtgcagctgcaggagtcgggcccaggactggtgaagccttcacagaccctgtccctcacctgcactgtctctggtcgcctaccatcaccngtgttatcactactggactctggactccgccagcccaaccgtaggggacggtcctgggagtcggatttgggaaccnttcgttaacgttacggnggggacncctaaccgtttcaaaccaaccccggttccctagaaacttggccgaattcccaacctagtcctactaatttacggaacctacggtaacttaaacgaactacgttacctccctaggtaacttcgaaacttcgtagttacgactacggtccgtacggaccgaccgggttctgttaaacgttcgtaggtcgccgtatacgttactaccggtaattacgtacggttcggactagtacttccaactacgtaccacgttaacttgttaccttttagacttacggtcgtaccgggtaaccgg

SEQ ID NO: 271228 - DNA, 551 bp, Homo sapiens
  misc_feature: GYAE6OF02GM6RJ.25.4.A04.1.454.CMB.1.raw
  modified_base (312)..(312): a, c, t, g, unknown or other
  misc_feature (312)..(312): n is a, c, g, or t
  modified_base (456)..(456): a, c, t, g, unknown or other
  misc_feature (456)..(456): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtggttatcactactggagctggatccgcagcaccagggaaggcctggagtggattgggtacatctattaccgngggagctaccttctacaacccgtcctacaatagtcgagtcaccatctcacttagacacgtctaaagaacctagttcctccctagaacgttgaacttctgtcgacttgccgcggacaccgggccgtgtacttacgtgtggccgtnaacttacgtaacgataacctagtcggaccgattacgtccaaccatccgaacggtattcggttcctttttagatttacgttcgtgggggtaacccg

SEQ ID NO: 271229 - DNA, 557 bp, Homo sapiens
  misc_feature: GYAE6OF02HTOEY.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaaacagaaaccagggagagttcctaagctcctgatctatgctgcctcacgttacactcaggggtcccatctcggttcagcgcagtgaatcgtgggacaggagttcacttctacactatcagcagcctgcacgcctagaagtatgttagactaaacgtttattaccttagtaactaaaagttactaaattaccgtacgtaccccttctaccgtaccgttttaccgggaccgggtaacggggtaacccgtaaaggggtacggtaacggaaacgttaaccgaaaacggttaccgtacggtaacggg

SEQ ID NO: 271230 - DNA, 555 bp, Homo sapiens
  misc_feature: GYAE6OF02GBKWZ.25.4.A04.1.454.CMB.1.raw
  modified_base (378)..(378): a, c, t, g, unknown or other
  misc_feature (378)..(378): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttgccgggcgagtcagggcattagcaattatttagcctggtatcaacagaaaccagggagagttcctaagctcctgatctatgctgcctccacttacactcacggggtccatctcggttcagcgcagtgaatcgtgggacagagttcactctcactatcagtcagtccngcacgcctgaagattgttgacgtaactttagttaacttagttaacaaaagttattaaacgttactaccgtaccctaccgttacgtaaccggttttaccgggaccgggtaacgggtaacccgtaaggggttacggtaacggtaacgttaacgaaaaccgtaaccggtggttaaccggg

SEQ ID NO: 271231 - DNA, 691 bp, Homo sapiens
  misc_feature: GYAE6OF02IUCQ4.25.4.A04.1.454.CMB.1.raw
tcagactgtacagtcacgaccggtgctcgatttagagtagtgatcaggggcagaagtctctctcagtcaggacacagcatggacatgaggtccctgctcagctccgtgggactcctagctgctctggctcccagataccagatgtgacgtccagactggaccctaggtcctccatcccgtccagtctgacattcgtgtcgacactagaatcgagtcatcgagttcggacgggtcaagtcgaggtctaatcgctaattcgttacgccgttaggtactccgtaaagtacgaaccgtagggtacgtacgttcctaaaggtcctaccgtacggtacttaccgttacgacggtcccttaggtaccccttacggtaacgttaccgacgttacggtaccggggttaccctaaggttcccggttacggttaccgaggttaccgggtactaacgggttactaacgttccggtaaggtaccgtagtaaccgttcgtacgtcgtcaacgttacgacgtacgtacgaccgtcggttactacgtaacgtccgtaaggttacgtacgttacgtacgtacgtaactttacgtaccgtacgtaacggtaactggtaacctacgttccgaccttacgtacgcggtttacggacgtaaccgtacggtaagttcggtaacgtacgttacgaaccggttgtcgttaaccgg

SEQ ID NO: 271232 - DNA, 561 bp, Homo sapiens
  misc_feature: GYAE6OF02H2EW2.25.4.A04.1.454.CMB.1.raw
tcagactgtacagtcacgaccggtgctcgatttagagtagtgatcagggggcagaagtctctctcagtcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggacgtccatcgaaggttcagcggcagtggatcgtgggacagattttcatcctcaccatcagcagcctgcagcctaggaatcttctgacctaaaccttatttaacttgtactaaactaagttttaacggaactttaacccctcttaccttccgttaccgggaccgggtaacgggaacccgtaaggggtcgggaacgtagtaacccgtaaacgaacgttggtaccgggacttacggccaacccgttaacg

SEQ ID NO: 271233 - DNA, 534 bp, Homo sapiens
  misc_feature: GYAE6OF02GV4XQ.25.4.A04.1.454.CMB.1.raw
  modified_base (219)..(219): a, c, t, g, unknown or other
  misc_feature (219)..(219): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaattattagcctggtatcaacagaaaccagggagagttcctaagctcctgatctatgctgcctccacgttacactcacgggtccatctcgttcagcgcagtgaatctgggacagagttcactctcactatcagcagcctgcacgcctagaacgatgttacgactaactttattaacgttagtaacctaaaaaggttactaaacttacctacgtaccccttacttccgtaacgttttccggacggggtaacggtaaccgtaagggtacggacggattaaccgaaacgtacgtggtaccggg

SEQ ID NO: 271234 - DNA, 522 bp, Homo sapiens
  misc_feature: GYAE6OF02F27ME.25.4.A04.1.454.CMB.1.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctggggggaggcttggtacagccaggccggtccctgacactctcctgcacagcttccggactcacctttggtgagcatgctatgacctgggtcccgccaggctccgagggagggtctggagtggcttgggttcagttagaagcgaagcctagtgggtgggcaacacaatacgccgcgtctaggtaaaaggcagattcagcctctcaagagatgattaccaaagcatcgcctatctgcacatgagcagcctgagaagcgaggactcgacgccgtagtacttacttgtttcttacttactctagagtagttagttagg

SEQ ID NO: 271235 - DNA, 516 bp, Homo sapiens
  misc_feature: GYAE6OF02H7R0E.25.4.A04.1.454.CMB.1.raw
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgtacnctcgngggtccatctcggttcagcgcagtgatcgtgggacagacgttcactctacactatcagcacgcctgcagcctagaagattgtcgactaacttattactagtaactaaaagtataaatacctacgtccccttctacgttacgttccgggacgggtaacgggaccgtaagggtcggtaacgactaacgaaacgtacgtggtacgg

SEQ ID NO: 271236 - DNA, 595 bp, Homo sapiens
  misc_feature: GYAE6OF02JI0OK.25.4.A04.1.454.CMB.1.raw
  modified_base (319)..(319): a, c, t, g, unknown or other
  misc_feature (319)..(319): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacttggccggggcagtcgagggcattagctaatttattaagcctggtatcaaacacgaaaccgagggagacgttcctaagctcctgatctatgctgccctccacgttacncttcgacgggtcccatccgtacggttcacgcggacaggtgaattccgtagggacagtagttaccaacgttcactaacgtatcgaagcctacgccttgaccacgtccgtagaaagtacttggttacgaaccttaactttaacgttacttacgttaaactaaaaagttacttaaacttaccgtcctaccccttatacccgttaacgggtttacgaccggggtaacggtaaccgtaagggtcggtaaggtaccaaccgtaaacggtacgttaggtacgg

SEQ ID NO: 271237 - DNA, 581 bp, Homo sapiens
  misc_feature: GYAE6OF02IMQ9Q.25.4.A04.1.454.CMB.1.raw
  modified_base (193)..(193): a, c, t, g, unknown or other
  misc_feature (193)..(193): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgtgganacagaatcagcatcacttcggccgggcgagtcgagggctagttagactaatttatttacgcctaggtatacaaacaagaaaccgaggggagtacgttacctaagcctaccgtagtactctatcgctcgcctccgtacgttacactcgacgggtccatcgtcgtcacggcgacagtagatcgtagggacagtacgttacactctacattatcagacacgctgcacgcctagaagtgttgttcgaacttaactttattacgttagtaactaaaagtacttaaacgtactaccgtaccccttactaccgttaaccggtttccgggacgggtaacgggtaaccgtaaaggggtcggtaacgtacgttaaccgaaacgtacgttaggtaccgg

SEQ ID NO: 271238 - DNA, 586 bp, Homo sapiens
  misc_feature: GYAE6OF02J2U3K.25.4.A04.1.454.CMB.1.raw
  modified_base (192)..(192): a, c, t, g, unknown or other
  misc_feature (192)..(192): n is a, c, g, or t
  modified_base (270)..(270): a, c, t, g, unknown or other
  misc_feature (270)..(270): n is a, c, g, or t
tcagactgtacagtcacgaccggtgctcgatttagagtagtgatcagggggcagaagtctctctcagtcaggacacagtatggacatgagggtccctgctcagctcctgggactcctgctgctctggctcccagataccagatgtgacgtccagatgacccagtctccatcctcctgtctgcatctgtgganacagaatcagcatcacttgccgggcagtcagggcattagctaattattagcctaggtatacaaacagaaaccaggganacgttacctaagctcctgatctatgctgcctccacgttaccactcgacgggtccatcgtcggttcaggcgcagtgaacgtcgtgggacaggtacgttcacgttctacactataccgagccaagtccgtgaccgtacggcccgttagaagttattaggttacacttaacctttataaccgttagtaaactaaagtaacttaacgaccttaccgtcccttacgtaccgtaccggtttacggacggtaaaccgggtaaccggtaaggtacggtaaacggtacgtaaaccgtaaacggtacgttacgggacggttacccg

SEQ ID NO: 271239 - DNA, 651 bp, Homo sapiens
  misc_feature: GYAE6OF02F06TE.25.4.A04.1.454.CMB.1.raw
  modified_base (498)..(498): a, c, t, g, unknown or other
  misc_feature (498)..(498): n is a, c, g, or t
  modified_base (530)..(530): a, c, t, g, unknown or other
  misc_feature (530)..(530): n is a, c, g, or t
tcagactgtacagtcacgaccggtgctcgatttagagtagtgatcgagggggcgagtaagtctctctcagtcaggacacagcatggacatgagggtccctgctcagctcctggggactccgtgcgtgcctcgtggcctcccagactaccagtatgtgaccgtccagagtcgacccgagtctccatccctccgtgtctgcatcctgttggagacagaatcagtcatcctacgttcggcccgggacgacgtacgaggggacctaagtttacgacctaagtttatttaacggcctggtactacaaccgaagaaaccggagggagtacgttaccgtaagtcgtaccgtagtactactagtcggctcgtccctcctaacgttaccactcgaacggggtccactccgtcggttacacggcggacagtacgaatacggtggactacgtacggttcacttcctacgtactactcgtagccgacgccttgcgaacgccgtagaacgnttagtgacgttaactttagttacgtccgtaanaaaacgtacttaaagtaccgtccgttccctacgttaccttaccggttttccggacggggtaacggtaacccgtaaggggtacggaacggtagttaaccgaaacggttaccgtaggttccgg

SEQ ID NO: 271240 - DNA, 665 bp, Homo sapiens
  misc_feature: GYAE6OF02HK54D.25.4.A04.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
tcagactgtacagtcacgaccggtgctcgatttagagtagtgatcgagggggcagaagtctctctcagtcaggacacagcatggacatggagggtccctgctcagctcctgggactcctgctgctctggcctcccagataccagatgtgacgtccagatcgacccagtcctccatccctccctgtctgcatctgttgganacagaatcagcatccacgttcggcccggggngacggtcgagggctaagttacgactaatttatttagccgttggtactacaacaacgaaaccgagggagtagttaccgtaacgcctcctagtactctagtcgtctcgtccctacctaccgttacaccgtcggaccggggtccctacgttccgtcggttcgacggcgacgtagtagactcggtacgggacagtacgttcctaccttcctacctactataccgacgaccgtacgtccgtacgaccgtacgtccgtaagtaacgtacgttggttacgtaccttaaacgtttactttaaccgttacgttaaactaaaacgttaacttaaactacctacccgtaccccttacttacccgttaaccggtttaccgggacgggtaaccgggtaaccggtaaggtacggtacgtaacgtaaccggtaacgtacgtcggtacgg

SEQ ID NO: 271241 - DNA, 509 bp, Homo sapiens
  misc_feature: GYAE6OF02GGW54.25.4.A04.1.454.CMB.1.raw
  modified_base (396)..(396): a, c, t, g, unknown or other
  misc_feature (396)..(396): n is a, c, g, or t
  modified_base (448)..(448): a, c, t, g, unknown or other
  misc_feature (448)..(448): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccagggagagttcctaaagcctcctgatctatgctgcctccacgttacactcgaggggtcccatctcggttcacgcggcagtgaatcgtgggacagtagttcactctcactatcagcagccttgcagcctgaagntgttgactaactttattacttgtactaaaagttataaatactcgtacccctntaccgtcgttacggcgggtacggtaaccgaaggtcggagacgtacgaacgtactggtacgg

SEQ ID NO: 271242 - DNA, 646 bp, Homo sapiens
  misc_feature: GYAE6OF02HQK3G.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtcggctccatcaccagtgttatcactactggagctggactccgcagcaccgagggaacggcctggagtggattgggtacattctagttaccggtgggacgcctaccttctaaccaaccccgtcctacaatagtcgagtccaaccatcctacaatttagactacgtactaaacgacctagtttccttcctaggtaagttacgaacttcgtagtacgacttcggccggacgaccacgggtccttagttacgttactggtacggccggtacctaagttaaccgtacggtaattaacccggttaggttacccgggaccgtaatttaccgtacccgtaacccgtaattcccgaaaccggtagttttccggttaccttttttaggaaaccgtttacggttcccgggttaaggggggaaaccccccgg

SEQ ID NO: 271243 - DNA, 515 bp, Homo sapiens
  misc_feature: GYAE6OF02GDJ2Q.25.4.A04.1.454.CMB.1.raw
  modified_base (219)..(219): a, c, t, g, unknown or other
  misc_feature (219)..(219): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaattatttagcctggtatcaacagaaaccagggagagttacctaagctcctgatctatgctgcctccacgttacactcaggggtccatctcgttcagcggcagtgaatctgggacagagttcactctcactatcagcagccttgcagcctagaagatcgttagacctacgtttactttacgtacgttaacaaaagttaataatactacgtccccttactccgtacgtttcgggacggacggtaccgaagggtcggagaacgtacgaaacgtactggtacgg

SEQ ID NO: 271244 - DNA, 521 bp, Homo sapiens
  misc_feature: GYAE6OF02F8BDO.25.4.A04.1.454.CMB.1.raw
tcagactgtacagtcacgaccggtgctcgatttagagtagtgatcaggggggggagaggagccccagccgtgagattcccaggagtctccacttggtgatcagcactgaacacagaccaccaaccatggagtttgggcttaactgtctttttccttgttgctgttttaaaaggtgtccaatgtgaggtgcaactggtggagtctgggggagcttggtacagccaggccggtccctgacactctcctgcacagcttccggactcacctttggtgagcatgctatgacctgggtccgccaggctccgagggaagggtctggagtggcttgggttcattagaagcgaagcctagtggtgggcaacacaatacgccgcgtctgtaaaaggcagattcagcctctcaagagatgattaccaaaagcatcgccttatctgcacatgagcagcctgagaagcgaggactcgagccgtgtattacgtgttcttattactcgtgagtagtagttgtttattattactaac

SEQ ID NO: 271245 - DNA, 680 bp, Homo sapiens
  misc_feature: GYAE6OF02JU5J0.25.4.A04.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
tcagactgtacagtcacgaccggtgctcgatttagagtagtgatcaggggcagaagtctctctcagtcaggacacagcatggacatgagggtccctgctcagctcctgggactcctgctgctctgctcccagctaccagatgtgacgtccaggactgacccagtcctccatccctcctgtctgcaatctgttagganaccagtaatcagcattcattgccgggnagtcaggcattagctaagttnttagccttaggtatcgaacaggaaaccnggganacttcctaanctcctgaactctagtnctacgcctccacgttaccactccgaagggtcccagttccgttcggttacaggtccggctaggtaaccgtaagttccgtagggtaaccacgggttacttaccgtaccttaaccggtctaaacccttagtacccgttaaggtacccaaccgggtaccttcggtacccaacgggtacccttaggaaaccgtagtttcggttacgtaacccttaacgttttaaccgttactaacccgttaaagttaaaccgttaaattaaacgttaccctaccgttacccttccgtttaacgtaaccggtttttaccggacgggtaaccggtaaccgtaacgggtttacggacgttaaccgtaaccgtaaacggtacgttacgtaaccgg

SEQ ID NO: 271246 - DNA, 586 bp, Homo sapiens
  misc_feature: GYAE6OF02GBLW3.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggcgagtcagggcattagactaattatttagcctggtatcaacagaaaccgagggagacgttcctaagcctaccgtgtactctatcgctcgacctccacgttaccacgtacgacggggtacccatcgtacggttcacggtcgactagtgaactcgtaggacagtagttccactctcactatcacgcacgcctgacacgcctagaagtactgttagtacctaacttttagttaactacgtaaactaaaagttaacttaaacgtaccgttaccgcccttacttaccgttacgttttaccggggaccgggtaacgggtaaccggtaaagggtacggtaagtaaccgttaacgaaaccgttacgttggtaaccgg

SEQ ID NO: 271247 - DNA, 666 bp, Homo sapiens
  misc_feature: GYAE6OF02HGKMX.25.4.A04.1.454.CMB.1.raw
  modified_base (194)..(194): a, c, t, g, unknown or other
  misc_feature (194)..(194): n is a, c, g, or t
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
tcagactgtacagtcacgaccggtgctcgatttagagtagtgatcaggggcagaagtctctctcagtcaggacacagcatggacatgagggtccctgctcagctcctgggactcctgctgctctggctcccagactaccagatgtgacgtccagatgacccagtctccatccctcctgtctagcatctgtgganacagtaatcagacatcacttcggcgggcagttcagggctagttagacaattattagacctggtatacgaacagaaaccaggganagttacctaagcctctagactcgtancgtatcgcctaccacgttacaccttcgacgggtccctagttccgtacggttaccagggtccgagtacggtaggtaaacttccggagggtactagggtacgtttaccgtaaccgtcctactaaacctagttacgaacggtactaaccgtccgttaccgtacgaccgtccgtagtaacggtacttacggtaccggtaactaacccggtttattacccggtaagttaacctaaaaggttaaactaagtaaccttaccgtacccctacgtttaacccgtaccggtttaccggtaccgggtaacgggtacccgtaaacggtttcggaacggtacgtaacccgtaaaaggtaccgttaggtaaccggg

SEQ ID NO: 271248 - DNA, 538 bp, Homo sapiens
  misc_feature: GYAE6OF02HYJG2.25.4.A04.1.454.CMB.1.raw
  modified_base (398)..(398): a, c, t, g, unknown or other
  misc_feature (398)..(398): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccggcgagtcagggcattagcaattatttagcctggtatcaacagaaaccagggagagttcctaagctcctgatctatgctgcctccacgttacactcaggggtcccatctcggttcacgcgcagtgaatcgtgggacagagttcactctcactatcagcagcctgcagcctagaagattgttnacgtaactttattactagtaactaaaacgttataaacttactccgtaccccttcgtacctaacggttttccggacggggaacgggtaaccgtaagggtacggaacgtaacttaaccgaaaacgttaccgtaggttaccgg

SEQ ID NO: 271249 - DNA, 258 bp, Homo sapiens
  misc_feature: GYAE6OF02FLGDU.25.4.A04.1.454.CMB.1.raw
  modified_base (256)..(258): a, c, t, g, unknown or other
  misc_feature (256)..(258): n is a, c, g, or t
tcagactgtacagtcacgaccggtgctcgatttagagtagtgatcaggggtagtggttattattactactactattacatggacgtctggggcaaagggaccacggtcaccgtctcctcagcctccaccaagggcccatcggtcttccccctggcgccctgctccaggagcacctccgagatcacagcggccctgggctgcctggtcaaggactacttccactgtacagtctgagcgggctggcaaggcgcatagnnn

SEQ ID NO: 271250 - DNA, 629 bp, Homo sapiens
  misc_feature: GYAE6OF02I2ILQ.25.4.A04.1.454.CMB.1.raw
  modified_base (471)..(471): a, c, t, g, unknown or other
  misc_feature (471)..(471): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgtggagacagaatcagcatcacttgccgggcgagtcgagggcatagctaattattagctggtactacaacaagaaaccgtagggactagttacctaagcctactagactctatgctgtacctcctacgttacactcgaacgggtcctacttacgttcggttacacggtcgtacgtacggttagtaacgttcgttacgggaacgtacggtaacgtttccaaccgttcttacctaacttacgtaccgaacggtcctacgtccgttcgccgaacgtacctaggtaagnttacgtcgtacttaaccttatttaacctacgtaaataaaacgttattaaactcgttaccgtccccttacgttaccgtacgtttaccgggacggtaacgggaaccgtaagggtacggtaacgtaacgttaacggaaaccgttaaccggtgtaaccgggg

SEQ ID NO: 271251 - DNA, 544 bp, Homo sapiens
  misc_feature: GYAE6OF02H6IGD.25.4.A04.1.454.CMB.1.raw
  modified_base (354)..(354): a, c, t, g, unknown or other
  misc_feature (354)..(354): n is a, c, g, or t
  modified_base (421)..(421): a, c, t, g, unknown or other
  misc_feature (421)..(421): n is a, c, g, or t
  modified_base (519)..(519): a, c, t, g, unknown or other
  misc_feature (519)..(519): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatcctcctgtctgcatctgttggagacagaatcagcatcacttggccgggcgagtcgagggcattagactaatttatttagcctggtatcaacaagaaaccagggagacgttacctaagcctcctgatctatgctcgcctccacgttacactccgacggggtccatccgttcggttcagccggtnagtgtaagtcgtagggacagtacgtttcacttctctaactatcacgcagcctgcacgcctagaagtnttgtactactaactttattactagtaacgtaaagttataaactactccgtcccttctccgtacgttccgggacggaacgggtacgaagggtcggtaanacgtaacgaaacgtacgtagtacgg

SEQ ID NO: 271252 - DNA, 614 bp, Homo sapiens
  misc_feature: GYAE6OF02IHSTB.25.4.A04.1.454.CMB.1.raw
  modified_base (473)..(473): a, c, t, g, unknown or other
  misc_feature (473)..(473): n is a, c, g, or t
  modified_base (514)..(514): a, c, t, g, unknown or other
  misc_feature (514)..(514): n is a, c, g, or t
  modified_base (540)..(540): a, c, t, g, unknown or other
  misc_feature (540)..(540): n is a, c, g, or t
tcagactgtacagtcacgaccggtgctcgatttagagtagtgatcagggggcagaagtctctctcagtcaggacacagcatggacatggagggtccctggctcagctccgtgggactcctgctgctctggctccagattaccagctgtgactccagattcgaaccctagtctccatccctcccgtgtccttgcaacttcgtgttgggaacacataactcagcctatcctacttgggaaccggggctaagtccgaagggctaagtttacggactaagttttatttaacgccgtttagggtaattccaaataaacggtaaaacccaggggaagtaccgtttaacccggaaagtccttaccttaggactacctaagttgaccgttcgccttaaccaccggtttacacttcgacggggtcccagttcgtcggttcgaacgtgacctagtagaaccttgacggacatcgtacaccttntaccatctacggactcacgctcgcagttccagagattccgntactaagttattacgattagaaatanaactttacgggcaccctacttacggctttagggacgacggtacgagtacggtgaactacgaaacgtactagcgg

SEQ ID NO: 271253 - DNA, 624 bp, Homo sapiens
  misc_feature: GYAE6OF02GHIIA.25.4.A04.1.454.CMB.1.raw
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagtgttatcactactggagctggactcccgcagccacccgagggaacgggcctggagtggattgggtacattctagttaccggngggacncaccttctaaccaacccgtcctacaatacgtcgagtccaacctatcctctattacgactacgtactaacgtaacctagtttcctccctagtaaagttacgaacttcgtagtacgtaccttcggcccggacggaccgaccggtcccgttaggttaactttacgttggttacggccggtactacgttaaccgtaacgtaacttaacgtacggttcggaccgtaagttacgtacgaaccactaccgaacgtagttacggttactttttacggacttacgttccggtaggggtaacccgg

SEQ ID NO: 271254 - DNA, 538 bp, Homo sapiens
  misc_feature: GYAE6OF02FP5XY.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcagtcgagggcattagctaattatttagctggtatcaacagaaaccagggagagttcctaagctcctgatctatgctgcctcacgttacactcgacgggtcccatctcggttcagcgcagtgaatcgtagggacagtagtctactctactactactacacgcgacgtccgtgcgacgccgtagaagtagtgttacgtactaactttattacgtagttaacgtaaagttataaaaactcgtacctccctactccgtacgttacggtaccgggtacggtaccgtaaggtacggacgtacgtaacgaacgtacgtggtacgg

SEQ ID NO: 271255 - DNA, 564 bp, Homo sapiens
  misc_feature: GYAE6OF02GWXCI.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatccacttgccgggcgagtcgagggcattagcaattattagctggtatcaacagaaaccagggagtacgtccgtaagcctcctgatctatgctgccctctacttacactcgagggtcccatccgtcgtcaggcgcagtgaatcgtaggacagtacgtcacgttctacgtactactcgagccacgcctacgccacgtccctagaaggtattgttacgtacctaacgtttattaaccttagtaaaccttaaaatttgaaactacggtacgacccggttagtacggttacggttacccggtacccgaacgggttaccgaacggttacggacctaagtacccgaaacggtactagggtaccgg

SEQ ID NO: 271256 - DNA, 530 bp, Homo sapiens
  misc_feature: GYAE6OF02HY5EH.25.4.A04.1.454.CMB.1.raw
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (456)..(456): a, c, t, g, unknown or other
  misc_feature (456)..(456): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggcgagtcaggggcagttagcaatttattagcctggtatcaacagaaaccagggagagttcctaagctcctgatctatgctgcctccacgttacactcgacggggtccctatacgtcggttcaggcggcagtagaatcgtgggacagagttcaccttctacactatcagcagcctgcacgccctagaagtntgttnactaactttatactagtactaaagtataatactctccccttntaccgtacgtttccgggacggtaacgggtaccgaagggtacggaagtacgtaaccgaaacggtacgtggtacgg

SEQ ID NO: 271257 - DNA, 657 bp, Homo sapiens
  misc_feature: GYAE6OF02IP362.25.4.A04.1.454.CMB.1.raw
  modified_base (258)..(258): a, c, t, g, unknown or other
  misc_feature (258)..(258): n is a, c, g, or t
  modified_base (334)..(334): a, c, t, g, unknown or other
  misc_feature (334)..(334): n is a, c, g, or t
tcagactgtacagtcacgaccggtgctcgatttagagtagtgatcagggtctgtgaaggcttcaccagtcctggacctcctgtgcaagaacattaaacacctgtggttctccctcctgctggtggcagctcccagatgggtcctgtcccaggtgcagctgcaggagtcgggcccaggactggtgaagccttcacagaccctgtccctcacctgcactgtctctggtgctccatccaccagtggttatcactactgganctggactccgccagcaccgagggaacggccgtgggagtggtagttgggtacagttccgtaagttaccggtgggacncgtaccttccgtaccgaacccgtccctacgaacttacggtccgagtccaacctattcctactaattacgacctaccgtaactaacgtaacctacggtttccctacgtacgtaagttcgtaacttccgtaggtctaccgtcggaccggtaccggtacgaaccgggtccgttaggttacttcgttggtacggtacgtacctaacgttacgtaacgtaacttacggtacgcggtaacctagttacttaccgaacctaactaccggtaactaacgttcggttacttttacggaacttacggtccggttacggggaccgtaaacgggg

SEQ ID NO: 271258 - DNA, 631 bp, Homo sapiens
  misc_feature: GYAE6OF02JW9FU.25.4.A04.1.454.CMB.1.raw
  modified_base (196)..(196): a, c, t, g, unknown or other
  misc_feature (196)..(196): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtccagatgacccagtcctccatcctccctgtctgcatctgttgganacagaatcagcatcacttgccgggcagtcgagggcattagctaatttatttacgccttggtatacgaactaagaaaccgagggaagacgtttaccaagcctaccgtagaactcttaagtgacctcgaccctacctacgttaccacgtcgaaccgggttccacttcgtccggttcagcggctacggtagtactccggtagggacctaggtacttacacgttctacgtacttactcaggtccaggtaccttcgaccgtacggtcccagtaacgtcgttaggtacgtacctaaacgttttagtaaccgtagttaacctaaaagttactaaactttactccgtaccccttactaccgttaaccggtttccggacgggtaaacgttacccggaaggttcggtaacggaacgttaaccggaaacggttgtacgggttacgg

SEQ ID NO: 271259 - DNA, 611 bp, Homo sapiens
  misc_feature: GYAE6OF02H3H97.25.4.A04.1.454.CMB.1.raw
  modified_base (339)..(339): a, c, t, g, unknown or other
  misc_feature (339)..(339): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttggccgggcagtcgagggcattagcaattatttagcctggtatcaacagaaccaggagattccgtaagctctagatctatgctgcctcacgttacactctacggggtccatcgtcggttcagcgcagtnagtctagggacagagttccacttctacatactacgagacacggaccttgaccgtacgtccctaaggtaacgacgttacgtttacggacctttaaacttttacgtttaaccttaacggtttaactaaaaaacggtttaacttaaacgtttaaccttaccggtaccccctttcccgtttaccgttaacccggttttaccgggacgggtaaccgggaaccgtaaacgggtagggtaacgtaagttacccgaaaaggttaccgttaaggtaccggg

SEQ ID NO: 271260 - DNA, 598 bp, Homo sapiens
  misc_feature: GYAE6OF02IQGPW.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtcccctcacctgcactgtctctggtggctccatcaccagtgttatcactactggagctggatccgcagcacccgagggaacgggcctggagtggagttgggtacatctagttaccggtgggacgctaccgttctaccaacccgtccctcaatacgtcgagtcaacctatctacattaacgactacgtactaaacgaacctacgtttcctacccgtagtaacgttcgaaacgttctcgtcgtacttcgcccgcggaccgtacgggtccgttacgttaagttaccgtggtcgcgggactaacgttaccgtaacgtacttaacgtaggtcggaccgtatacgtcctaaccgatccgacgtactcgttcttttagattacgttccggtgggtaacccggg

SEQ ID NO: 271261 - DNA, 531 bp, Homo sapiens
  misc_feature: GYAE6OF02FVYGS.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtgttatcactactggagctggatccgccagcacccagggaaggcctggagtggattggggtacatctattaccgtgggagcaccttctacaacccgtcctacaatacgtcgagtcaccatctcattagacacgtctaagaacctagttcctcccttagaacgttgaaactctgtgacttgccgcgacaccggccgtgtattacgtgttgcggtcactacgtacgattactagtcggcgtatactcgaaccatccacgtattcgtacttttgattacttcgtggggtaacccg

SEQ ID NO: 271262 - DNA, 631 bp, Homo sapiens
  misc_feature: GYAE6OF02JK4ZB.25.4.A04.1.454.CMB.1.raw
  modified_base (257)..(257): a, c, t, g, unknown or other
  misc_feature (257)..(257): n is a, c, g, or t
  modified_base (312)..(312): a, c, t, g, unknown or other
  misc_feature (312)..(312): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtcgctccatcaccagtgttatcactactggancgtggactccgccagccacccgagggaacggcctgggagtggagttcgggtaacntcttacgttaccgggtgggactcctacctttcaacctaaccccgtcctactaaacgttgtaccgaagtcaacctagtcctacatttacgaactacgtaccgtaaacgacctacgttcctacccgttagtaacgtttacgaacttcgtacgtacacgttacggaccgcgtaaccgaccgggtccgttagttactttaccgtggtacgtcggacctaacttacgtaacgtaattacgtagtacggaccgtactacgtccgaactacgtacaacgtacgttcgttacgttttagacttacgttacggttaccgggtaaccgg

SEQ ID NO: 271263 - DNA, 534 bp, Homo sapiens
  misc_feature: GYAE6OF02FIBA7.25.4.A04.1.454.CMB.1.raw
  modified_base (463)..(463): a, c, t, g, unknown or other
  misc_feature (463)..(463): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtcctctggtggctccatccaccagtggttatcactactggagctggatcccgcagcacccaggggaacggcctggagtggattgggtacattctaattaccggtgggagccaccgttcacaacccgtcctacaatgtcgagtcacatctcattagaccacgtctaacgaccagttcctaccctgtaacgtcgaactctgtcgacttcgccgcggacacgggccgtagttacttacgtgtgccggnactacgtacgatacgtagcggccatactcaccactcacgatcgtcttttacgattactcggtgggaacccg

SEQ ID NO: 271264 - DNA, 776 bp, Homo sapiens
  misc_feature: GYAE6OF02FZA6U.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctcttgcctccagactaccagatgtgaccgtccagatcgacccagtcctccactccctcctgtctgctatcttggttggagacagaatcagctatctacgttcggccgggagacgtcgagggactagtacgactaatttacgtttacgtccgttaggtactacaaacgaacggaaaccgaaggggagtacgttaccgtaacgtcctccgtagtatctatcgtctccgtacccttaccgtaaccgttaccacgtaccggtaccggggtccctacgttccgttacggttcgacggccgacgtaaggtacgtaacgtcggtacgggtaacacggttaacgttccaccgttcctacctaacttacgtacgacgtccgaacggtccgtagaccgtaacggtacccgtaaggtaacgtacggtttcggttacggtaaacctttaacgttttaaccgttttaaacgttaacgttttaaaaacttaaaaggtttaccggtaaaccgtacgggttaacccgggttaccggttagggttaccggtttcccgggttaacccgggtaaccccggggtaaccggggtaaacccgggttaagggtaaccggtaaccgttaaaccggtaaacccgggtaaaaccgggttaccggttacggggttaaccgg

SEQ ID NO: 271265 - DNA, 577 bp, Homo sapiens
  misc_feature: GYAE6OF02IATYK.25.4.A04.1.454.CMB.1.raw
  modified_base (268)..(268): a, c, t, g, unknown or other
  misc_feature (268)..(268): n is a, c, g, or t
  modified_base (338)..(338): a, c, t, g, unknown or other
  misc_feature (338)..(338): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattattagcctggtatcaacaagaaacagganagttactaagctcctgactctatgctgcctccacgttacactcgacggggtccatcgtcgttcacgcggnacgtgaatcgtagggacagtacgttacacgttctacgactatcgagccacgcctgaccacgcctagaagtattgttacgtacctaacgtttacttaactaggttaaactaaaaaggttactaaaacgtttacctaccgtaccccttacgttaccgttaccgggtttaccggtacggggtaaccggtaaccggtaagggtacggaacgtaacgtaacgaaacggtacgtaggtaaccggg

SEQ ID NO: 271266 - DNA, 572 bp, Homo sapiens
  misc_feature: GYAE6OF02GMEKA.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcatagaccctgtccctcacctgcactgtctctggtgcctccatcaccagtgttatcactactggagctggactcccgccagccaccccgaggggaacgggcctgggagtggagttggggtacatctagttaccggtgggacgcaccttctaccaacccgtccctacaatacgtacgacgtcactactctacattacgaccacgtactaaacgaacctagtttacctccctagtaaagttcgtaaccttctagtcgacttcgccggcggaccgtaccgggcgttgtattaccgtgtcgcggctagtacctacgatacgtaggtcggcgtatacgtcaacctatacgaagtatcgttctttgattcgttcgtgggtaacccgg

SEQ ID NO: 271267 - DNA, 656 bp, Homo sapiens
  misc_feature: GYAE6OF02HNCTG.25.4.A04.1.454.CMB.1.raw
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (358)..(358): a, c, t, g, unknown or other
  misc_feature (358)..(358): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtgttancactactgganctggactccgcagccaacccgaggggaacggccgtggagtggagttgggtacattcgtagttaccggtgggacgcctaccttacaaccaaccccgtccctanaatacggtacgacgtcacctatcctataattacgaacctacgtactaaacgaaccctagtttccctaccctaggtaacgtttacgaaaccttctaggtacgaccgttcggcccggaccggtaccgaccgggtccgttagttaactttaccggtgtacggaccggtactaacgttaacgttaacggtaacttaaccgttacgggtcggaccgtaattacgtaccaaccgtacttaccgaacggttagttcggtttaccttttaaggaactttacggttccgggttacggggaacccggg

SEQ ID NO: 271268 - DNA, 590 bp, Homo sapiens
  misc_feature: GYAE6OF02INW67.25.4.A04.1.454.CMB.1.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (258)..(258): a, c, t, g, unknown or other
  misc_feature (258)..(258): n is a, c, g, or t
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctccagataccagatgtgacgtccagatgacccagtctccatcctccctgtctgcatctgttgganacagaatcagcatcattgccggngagtcaggcattagacaagtttattagcctggtactacaanagaaaaccagggagtagttccgtaagcttaccgtgatctagtcgcttcgcccttacctaacgttaccacgttccgaaacggggttccccaagttccgtttacgttcgaacggtcggactaggtagtactcgtagggaaccaagtacgtttacactactcaacttactcagacacgcctagcacgtcctaganattcggttnaacttacttaagtctacgaaataaaacgtataaatctccgtaccctcttacgtccgtttacgggccgggtaaaggaccggtaaagggtcgggtaagtaaccgtaacgtaaaaccggtacgtggtaaccggg

SEQ ID NO: 271269 - DNA, 733 bp, Homo sapiens
  misc_feature: GYAE6OF02IY3BO.25.4.A04.1.454.CMB.1.raw
  modified_base (196)..(196): a, c, t, g, unknown or other
  misc_feature (196)..(196): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctccagataccagatgtgacgtccagatcgacccagtctccatcctcctgtcctgactatctgttgganacagaatcagacatctacgttcggcgggcgtaggtccgagggtcctaagttaacggacttaaattttacgtttaacgcccgttaggttaactacgaaacgaacggaaaaccgaaggggtaacgtacgtttaccgtaaagtccttaccgtaggtacttacgttaagtcgtcgttaccgtccccgttaccgtaaaccggtttaaccaaccgttaccgggtaaaccgggggttcccctaacggtttccgttacccggttacgacggtacggtacgtaacgtacggtaaactccgggtagggtaacctaggtacgttaccgacttcctaaccgtactacgtctaacggcaacgtccgtcgaccacgtaccgtagtaaacgtcgttacgttacgtaccttaaactttacgtttaactacgttaaaactaaaagttaactaaacgttaccgtcctaccccgttactttacgtaacccgtttacgggacggttaacggaccgtaagggtacgaacgtaacacgtaaacgttacgtgtaaccggg

SEQ ID NO: 271270 - DNA, 767 bp, Homo sapiens
  misc_feature: GYAE6OF02JOGU0.25.4.A04.1.454.CMB.1.raw
  modified_base (312)..(312): a, c, t, g, unknown or other
  misc_feature (312)..(312): n is a, c, g, or t
tcagactgtacagtcacgaccggtgctcgatttagagtagtgatcaggggagctctgggagaggagccccagccgtgagattcccaggagtctccacttggtgatcagcactgaacacagaccacaaccatggagtttgggcttaactgtcttttccttgttgctgttttaaaggtgtccaatgtgaggtgcaacgtggtggagtcgtgggggagcgttggtacagccaggccggtcctgacactctcctgcacacgtccttccggactctaccgtttggtcgagcagtgactagtcggaccgtcgggtccnccgtacggcctaccggaaggggtaacgggtctaggggtacgtcgggtcgttcggggttactaagtttacgggaacggtccggtaaaggtcccgttaagggttcggggtacgggggtaacctaaacgaacgtaacggttaccgggcccggtacgttaccgtaaagggttaaaacgggcgtaacggtacttaccgacgtacccgttacgtaccgtaacggaagtaagtacggtaacttaaccgaaaaggtcctaacgtccggtaccttaactaccgtacgaccgtaactagtacggacgaccgtaacgtccgtaaggaacggaacggacggttaaaccggaccgtaaccgtaaccggtacccggttaaggttaaccgtttaaacgttcggttttaaccgtttaacgtttacccgttaccggttaaggtaacggttacgggtttaacggttttaacgg

SEQ ID NO: 271271 - DNA, 565 bp, Homo sapiens
  misc_feature: GYAE6OF02HP9T3.25.4.A04.1.454.CMB.1.raw
  modified_base (351)..(351): a, c, t, g, unknown or other
  misc_feature (351)..(351): n is a, c, g, or t
tcagactgtacagtcacgaccggtgctcgatttagagtagtgatcagggggcagaagtctctctcagtcaggacacagcatggacatgagggtccctgctcagcctcctgggactcctgctgctctggctcccagataccagatgtgacgtccagatgacccagtctccatcctccctgtctgcatctgttggagacagaatcagcatcacttgccgggcagtcagggcattagcaattattagcctggtatcaacagaaaccagggagagttacctaagctcctgatctatgctgtcctccacgttacactcgacggggtcccatcgtcgttcagcgacagtgaattcgngggaacagagttcactctcactatcagcacgcctgcacgcctgaacgtacgttggttcgaaccttaacgtttaacttaaccgttagttaacctaaaaaggttacttaaacgttactaccgtacccttacttaccgtaaccggtttccggacgggtaacgggtaaccgtaagggtacggtaacgtacgtaacccgaaacgtaccgtgttaacggg

SEQ ID NO: 271272 - DNA, 747 bp, Homo sapiens
  misc_feature: GYAE6OF02I2TTF.25.4.A04.1.454.CMB.1.raw
  modified_base (411)..(411): a, c, t, g, unknown or other
  misc_feature (411)..(411): n is a, c, g, or t
tcagactgtacagtcacgaccggtgctcgatttagagtagtgatcagggggagctctgggagaggagaccccagccgtgacgattcccaggagtctccacttggtgatcagcactgaacacagaccaccaaccatggagtttgggcttaactgtctttttccttgttgcttagtttttaaaaaggtgttccaatgtgtaggtgcaactgggtggagtcgtggggggaggcttggtacagccgaggccggtcctgacactctcctgcacagccttccggactccaccgtttggtcgacgcaatcgtacttagtcggacccttcggggtcccgccgagggccttaccggaaggggtaacgggtctagggagtcggtcgtttgggttcagttagaagcgaagtcctagtcgggngggacaacgactaagtacgccgtacgtacgtaaggtaaaacggctaagtattacgaacgtccctacgtacgaaagtacgtattacgtaacttaaccgaaaaaggtcctaaacgttccgtaccttaagttcctacgtaccgaactacgtacggaacgtaccgaacgttaccgtaacgggaaacgggtaaacggaccgggtaacgggtaccgttaaccgtaccgggttaccggttttaacgtttaaacgttttacccgttttaacgtttttaccgtttttaacgtttaccgtttaccggttaagggtaacggtttacgggttaacggtttttaacggg

SEQ ID NO: 271273 - DNA, 519 bp, Homo sapiens
  misc_feature: GYAE6OF02FGISN.25.4.A04.1.454.CMB.1.raw
  modified_base (218)..(218): a, c, t, g, unknown or other
  misc_feature (218)..(218): n is a, c, g, or t
  modified_base (313)..(313): a, c, t, g, unknown or other
  misc_feature (313)..(313): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
  modified_base (396)..(396): a, c, t, g, unknown or other
  misc_feature (396)..(396): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttgccgggnagtcagggcattagactaattatttacgcctggtatacaacagaaccgagggagattccgtaagctcctgattctatgctgccctacacgttacnctcgacgggtccatcgtcgttcngcgctagtgatcgngggactagagttcactctacatactcagcacgctgcacgctagaangttagttgactaactttattactagttaactaaagtacttaataccgtcgtcccctactcgttaacgttccggacggacggtaacgaggtcggaagtacgtacgaaacggtacgtaggtacgg

SEQ ID NO: 271274 - DNA, 596 bp, Homo sapiens
  misc_feature: GYAE6OF02ICZWQ.25.4.A04.1.454.CMB.1.raw
  modified_base (339)..(339): a, c, t, g, unknown or other
  misc_feature (339)..(339): n is a, c, g, or t
  modified_base (391)..(391): a, c, t, g, unknown or other
  misc_feature (391)..(391): n is a, c, g, or t
  modified_base (505)..(505): a, c, t, g, unknown or other
  misc_feature (505)..(505): n is a, c, g, or t
  modified_base (547)..(547): a, c, t, g, unknown or other
  misc_feature (547)..(547): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctcgtccctcacctgcactgtctctggtcggctcatcaccagtggttatcactactggagctggactccgccagccaacccgagggaacgggccgtgggaggtgggagttcgggtacagttcttagttaccggtgggacncctaccgttctaacctaaccccgtccctacaacgtacgtcgaactcaacctntacctactaacttacgactaacgttactaaacgaacctagtttccctaccgtagtaaagttcaaacttcgtagtcgtacgtcggccgacggaccacgggtcctagtacttacgngtcgcggtactattactacgtaatacgtaggtcgactatacnccacctatccgtacgtattcgtcgtttagacttaggtcgtacgggaacg

SEQ ID NO: 271275 - DNA, 541 bp, Homo sapiens
  misc_feature: GYAE6OF02HA803.25.4.A04.1.454.CMB.1.raw
  modified_base (219)..(219): a, c, t, g, unknown or other
  misc_feature (219)..(219): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcgagggcattagactaattatttagcctggtatcaacagaaaccgagggagagttaccaagctcctgatctatgctcgccctacctacgttacactcgacgggtccatcgtcgtcagcgcagtagagtcgtggacagtacgtctactactctactactcacgcacgccgtcgcacgctagaagtattggttacactaactttacttacttagtaactaaagttataacttactaccgtacccttacttccgtacgttcgggacgggtaacggaaccgtaagggtacggacgtactaacgaaacggtacgtaggtacgg

SEQ ID NO: 271276 - DNA, 649 bp, Homo sapiens
  misc_feature: GYAE6OF02JMZL0.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcgacctgcctactgtctcgtgggtcgacttccatccaccgtagttcggttatctactacgtggagtctggactccgccagccacccgaggacggcctgggagtggagttgggacagtctagttaccggtgggactaccgtaccttactaccgtaaaccccggttccctacgaaagttcggtcgaacgtccaccgtaactcctacaatttaacgacctacgttacctaaacgacccttaggtttaccctcccgtaaggtaacgtttcgaaccggtcttacggtgtacgtaccgtcgcccggtaccggaactaccgggtccgttagtactttacgtcggtcggccgtactagttacctacggtactacgtgtacggtacgtattacgtaccactacgttacaacggttctcgtttacgtttaggtaactaccgtcggtacgggg

SEQ ID NO: 271277 - DNA, 741 bp, Homo sapiens
  misc_feature: GYAE6OF02GL0RV.25.4.A04.1.454.CMB.1.raw
  modified_base (222)..(222): a, c, t, g, unknown or other
  misc_feature (222)..(222): n is a, c, g, or t
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctcccgtgtctagcatctgttgacgacagaatcagcatcacttggcccgggnagtcgaggcagtagctaattatttacgccttaggtactactaacaacgtaaaccgaagggtaagtaacgttaccgtaaacggtactaccgtagtatactaagtgtctcgtcctacctaacgttaaccacctaccgtaccggggtaccctaacgtccgttacggttaccgtaacggtccggacgtaccggtaggtaacgtacgttacgggacgtaaggtacggttactaccgtaccggttactaaccgttataccgtaacggccgtaacgtcccgttacgaccgtacgtacccgtacggtaaacgtagttacggttacgaaccgttaaacgtttacgtttaacgttacgttaaacgtaaaaacgttaacgttaaaaccttaacgttaaccccggttaccctaacccgtttaccgttaaacccggtttacccgggtacgggttaaacccgggtacggtaaaccgggttacgggtaaccgtaaccggttaaccgaaaccggttaccggtacggttaaccggg

SEQ ID NO: 271278 - DNA, 563 bp, Homo sapiens
  misc_feature: GYAE6OF02G9KA4.25.4.A04.1.454.CMB.1.raw
  modified_base (310)..(310): a, c, t, g, unknown or other
  misc_feature (310)..(310): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcacagtgttatcatactgagctggatccgcagcacccgaggaacggcctggagtggattgggacatctatacgtggngtcaccttcacaacccgtcctacaatgtcgagtcaccatctacgattagactacgtctaaagaacctagttctccctagaacgttgaactctagtcgacttcggaccgtcggacacgggcctagtacttacgtcgtagcgactagtaacctacgtaacttaacgtagttacggaccgtaacgtactaccaacccgattaccaacgtaacctgttaccttttaggaactttacgtaccgtagggggtaacccgg

SEQ ID NO: 271279 - DNA, 590 bp, Homo sapiens
  misc_feature: GYAE6OF02H7ES2.25.4.A04.1.454.CMB.1.raw
  modified_base (515)..(515): a, c, t, g, unknown or other
  misc_feature (515)..(515): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcgagggcattagctaatttattagcctaggtatcaacaagaaaccgagggagagttccgtaagcctctagacttctatcgctcgcctcctacgttaccacgtaccgacggggttccctacgtccgtcggttacgacggtcggacgtacggtacgtaagttcggtagggaacctaggtaacgttccacttcctactactaactccgagccagtccttcggacacggtctagaagtattaggttacgtactacttagttaactagttaacgtaaaatataaacttccgtaccncccttctacgtacgtttaccgggacggtaacgggacgtaaggtcggacgtagaaccgtaacgtacgtggtaccgg

SEQ ID NO: 271280 - DNA, 736 bp, Homo sapiens
  misc_feature: GYAE6OF02GDLNQ.25.4.A04.1.454.CMB.1.raw
tcagactgtacagtcacgaccggtgctcgatttagagtagtgatcagggggcagaagtctctctcagtcaggacacagcatggacatgagggtccctgactcagctcctgggactcctgctgctctggctcccagataccagatgtgacgtcagatgacccagtctccatcctcctgtctgcatcgtgtggagacagaactcagcatccacgttcggccgggcgacgtccgagggctacttagctaattagtttacgcctaggtactacaacaacgaaaccgagggacgacgttaccgtaacgtcctaccgtcgtactacgttacgtcgtaccgtcgtacccttaccgtaacgttacctaccgttaccggtaccgggggttacccctacgttaccgttaccgggttaccgaacggtaccggtacgtaaggttacgtaacgttcggtacgggaacgtaaggtacggtttaccaacgttaccgtacctaactacgtacgacgtacaacgtccgtacgaccgtacgtaccgtaagaagtacgttacggttacgtaacttaaaccgttttaactttaacgtaacgttaaaacgtaaaacgtttaaactaaacgttacctaccccgttacccttaccgttaccggttaaccgtttaccggggaaccgggttaaccggggtaaccgttaaaggggtacggtaacgtaaccgttaaccggtaaacggttacgttggtaccggg

SEQ ID NO: 271281 - DNA, 617 bp, Homo sapiens
  misc_feature: GYAE6OF02FVTV5.25.4.A04.1.454.CMB.1.raw
  modified_base (375)..(375): a, c, t, g, unknown or other
  misc_feature (375)..(375): n is a, c, g, or t
  modified_base (408)..(408): a, c, t, g, unknown or other
  misc_feature (408)..(408): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctggctgcttctgtgggagacagatcaccatcacttgccaggcgagtcaggacattagtcactgtagtaaattggtatcaacacgaaaccacggggtaacccctaactccagtactcgtacgatcgcctaccaagtttggacgtcgagggtcccatacgaagtcacgtggaagtgatcgtaggtacagtagttttagttntactatcagcgtacgctgacaaccgtgtaagtntttacgactaaacgtatttactttacgtacgttacctaacgtaattacgtacgtaacttccgttcctaccccgttactacctttacgttttcggacccgtaacggggtaccgtaagggtacggtaacgtaacgttaaccggtaaaacccggttacgtacgggttacggtaccggtaccggtaccgtaccgtacgtttcccgtttaccgg

SEQ ID NO: 271282 - DNA, 693 bp, Homo sapiens
  misc_feature: GYAE6OF02HXOKR.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagttggttatcactactggagctggactccgcagccaacccgagggaacgggcctgggaggtggagttgggtacattcgtagttaccggtgggactcctaccttctacctaaaccccgttcccctactaaactacggtaccgtaacgttaccaaccctagttaccttacctaagtttaacgaacctaaccggttacctaaaacggtaaaccctacggtttacccttacccgttaaggtaaacgtttacgaaaccttcgttacggttacgtaaccgttcggacccggtaccgggtaaccgtaccgggtccgtttaacgttacgtttaaccgtggtacggccgtactaacgttaaccttacgaacttaaccgtaggtacggacccgtattacgtacctacctattaccgacgtacgttcgttacttttgaacgttacgttccggtagggtaacccgg

SEQ ID NO: 271283 - DNA, 650 bp, Homo sapiens
  misc_feature: GYAE6OF02GNQBT.25.4.A04.1.454.CMB.1.raw
tcagactgtacagtcacgaccggtgctcgatttagagtagtgatcagggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtccctgacactctcctgcacagccttccggactcctacctttggtgagcatgctatcgaccgtcgggtcccgccgaggcctccgaggggaacgggtcgtgggagtgggtcgttgggttcagttagagcgaagtcctagtgggtgggacaacacaagtaccgccgtcgtacgtaggtaaaacgggcaagtacttacgacgtccctacgtacgaaaggagatacggtaacttaaccaaaacggtcctaacgttccgtaccttactcctacgacctaacgacgttggaacgaccgacgtcccgtaggacggaaacggcggtaacggacctacgacggtaccggttagttaccgtttaccgttcgttttactttacggtttaccttccggttaggtacggttaggttaggtttaacgg

SEQ ID NO: 271284 - DNA, 680 bp, Homo sapiens
  misc_feature: GYAE6OF02IA8J0.25.4.A04.1.454.CMB.1.raw
tcagactgtacagtcacgaccggtgctcgatttagagtagtgatcagggggcagaagtctctctcagtcaggacacagcatggacatgagggtcccctgctcagctccgtgggacctcctgctgctctggcctcccagataccagatgtgacgtccagatcgacccagtctccatccctcctgtctgctatcgtgttggagacagaatcagctatcctacgttcggccggggacgaggtccgaggggctaagtttacgactaatttagtttacgccgttaggtaactacaaacgaacggaaaaccgaggggagtacgtttacctaagccttcctgatactatgcctcgcctcctacgttacaccgtcggtacggggtcccattccgtcggttcacggcgacagtgtatcgtagggacaggtcgttaccaccttctacctaacttactcgaacgactacgccgttacgccgtaacgtaccgtacggtaaagcgtttacggttactaacccgtttaatttaccggtttaaactacggttaaactaaaacgtttaaactaaacgtttaccctaccgtaccccctttacgttaccggttaccggtttacccggggacgggtaaccgggtaaccgtaaggggtacggtaacgtacctaaaccgggaaacgttacgtggtacccgg

SEQ ID NO: 271285 - DNA, 605 bp, Homo sapiens
  misc_feature: GYAE6OF02JEJV4.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgacactgtctctggtcgctccatcaccagtgttatcactacgtggatctggactccgcacgcacccgagggaacggccgtggagtggagttcgggtacagtctaacgttaccggtgggacgtactacccgttctaaccgaacccgttccactaagtacgtcgtacgtcacctatctacacttacgactacgtactaacgaacctagtccttacccgtagtaacgttgaacttcgtagtacgacgttcgacccgacgaccgtacggtccgtagttacttacgtcgtcggaccgtactacgttaccgtacgacttaacgtacgtcgaccgtagtactcctaacctagtacgaccgtagttacgttcgttttagacgttacgtgtacgggtaacgg

SEQ ID NO: 271286 - DNA, 665 bp, Homo sapiens
  misc_feature: GYAE6OF02HTBCT.25.4.A04.1.454.CMB.1.raw
  modified_base (256)..(256): a, c, t, g, unknown or other
  misc_feature (256)..(256): n is a, c, g, or t
  modified_base (366)..(366): a, c, t, g, unknown or other
  misc_feature (366)..(366): n is a, c, g, or t
  modified_base (539)..(539): a, c, t, g, unknown or other
  misc_feature (539)..(539): n is a, c, g, or t
tcagactgtacagtcacgaccggtgctcgatttagagtagtgatcaggggagctctgggagaggagccccagccgtgagattcccaggagtctccacttggtgatcagcactgaacacagaccacaaccatggagtttggcttaactgtcttttcctgtgctagtttaaagtgtaccaatgtgaggtgacaacgtggtggagtcgtggggagcgttggtacagccgacggtccgtccctgacactctactgcacgngtctccggactcgtacgttggcgagctagtcgtactatcgaccgtggacccgcgaggtcctacggagggtaggtctggtagtgtcgttggtacagtagagcgaatctagngggtcggacaacgatacgtcgaccgttacgtagtaaggtaaaacggcgtacgtaacgttccgaacgtacccgtttacaaccggtaaaggagtaaaccgttcggaaacctttaaccgaaaaggttccgtacgtacggtacctatcgacgtacaaccggtgtacgaccggtaacncggtaaccgtgggaaaacgtccggacgtaaccggcctaacggaacggttccgttaacggttacttaacgttcgttttaacttacgttacctaccgggttaagtaccgtttaggttacggtttaacg

SEQ ID NO: 271287 - DNA, 663 bp, Homo sapiens
  misc_feature: GYAE6OF02IWUN0.25.4.A04.1.454.CMB.1.raw
  modified_base (513)..(513): a, c, t, g, unknown or other
  misc_feature (513)..(513): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacatccagatgacccagtctccatcctccctgtctgcatctgttggagacagaatcagcatcacttggccgggcagtcagggctaattagactaatttatttacgccttaggtactaccgaaacaacggaaaaccgaggggtaacgtaacggtttaccctaaacggtcctaccgttaggtaacttacttaagtcgtcctcggtaccccttaccgtaaccgtttaaccgtaccgtaccggtaccggggttacccctaagtttcccgttacgggtttcaacgggtccggtaacgtaaggttacgtaacgttcggacggggtaacctaggtacgtttaccgtactccgtacacgttactccgacggtacncgtccgtacgacctacgtaccgtagaacgtagttcgttacgtacttaacttacttaagtacgttaaactaaaagtactaagtacctcctaccttcctcgttacgtccggacggtacggtacgaggtcgaagacgtaacgtacgtagtcgg

SEQ ID NO: 271288 - DNA, 778 bp, Homo sapiens
  misc_feature: GYAE6OF02IWHKC.25.4.A04.1.454.CMB.1.raw
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagactcgacccagtcctccatccctcctgtctgcatcgtgttaggagacagtaaactcgagctaataccgaacgttcgggccggggacgtaggtaccgaaggggcctaagttagaacttaaatttacgtttaagccgttaggtaactacaaaacgtaaacggaaaaccgaagggtaagtaacgtttaccgtaaacgtccgttaccgtaggtaacttaccttaagttcgtacttaccgtccccgttaaccttaaccgttaactaaccttaccggggtaaccgggtcccctaagttccgttacggttacgaacggcggtactacgtagtaaacgtcggttacgggacgtaacgttagtacctaactacctacaacttacgtacaacggtccgtaacgtcccgttacgaccgtacgtaccgtaacggtaagtaacgttacgttaccgtaaacttaaacgtttaacgttaacgttaacgtaaaccgtaaaagttaaacgtaacgttaaccctaccgtaccccttaacgtaaccgtttaaccgggttaaccgggtacggggaaaccggttaaaccgggacgggttaacggaacgtaaccgtaaccggtaaaacgttacggtagggtaaccgg

SEQ ID NO: 271289 - DNA, 714 bp, Homo sapiens
  misc_feature: GYAE6OF02GW8HD.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcatacgaccctgtccctcacctgcactgtctcgtggtcgctccatcacctagttgttatcactacgtggagcgtggactcccgccagccaccggaggggacgggccgtgggagtgggtagttgggtactagttacttaacgttaccgggtgggacgtcctaccctttaccgtaacccgtaaccccgttccctaacgtaaacgttacggtcgtaacgtaccaacctactcctactaacttacgacctaacgtactaaacgtaacctacgtttccctacccgtagtaacgttacgtaacttcgttacggtcgtaccgttcggacccgtacggaaccgtaccgggtaccgtttagttaaccgttaccggttagggtcggtaccggtaccgtaacgttaacccgttaaacggtaactttaacgtacgggttacgggacccgtattaacgtacccaaccttacgtaaccgtaacggttattccggtttactttaggtacgttaccggttcgggacggggtaaacccgg

SEQ ID NO: 271290 - DNA, 587 bp, Homo sapiens
  misc_feature: GYAE6OF02HGAHE.25.4.A04.1.454.CMB.1.raw
  modified_base (221)..(221): a, c, t, g, unknown or other
  misc_feature (221)..(221): n is a, c, g, or t
  modified_base (409)..(409): a, c, t, g, unknown or other
  misc_feature (409)..(409): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggnagtcagggctattagactaattatttagccgttaggtatacaaacaagaaaaccgaggggagtacgttacctaagcctcctagatctatgctcgcctacctacgttacacgtcgacgggtcccagttcgtcggttcgacggcggactaggtgaacgtcgttggactagtacgtacactctctaactancagcacgctcgacacgcctaagaacgtagttgttacgaccttaactttacttaagtacgttaaactaaaagttacttaaactaccttaccgtacccttacttaccgttccggttacgggacgggtaaccggtaacggaaggtaggaacgtactaacggaaacggtacgttaggtacgg

SEQ ID NO: 271291 - DNA, 719 bp, Homo sapiens
  misc_feature: GYAE6OF02ISORY.25.4.A04.1.454.CMB.1.raw
  modified_base (488)..(488): a, c, t, g, unknown or other
  misc_feature (488)..(488): n is a, c, g, or t
  modified_base (533)..(533): a, c, t, g, unknown or other
  misc_feature (533)..(533): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacgttcggccgggcgagtcgaaggggcctaagttagctaatttaacgtttacgccgttaggttaataccaaaacgaacggaaaaccgaggggtaacgtaacggtttaccgtaaacgtccttaccgtaggtaacttcgtaatcgtaccgtcgtcccgtacctaaccgttaacaccgtaccggacggggttccccaagttccgttacggttacgacggcggactacggttagaacgttcggtacgggaacaggtacgtttccaaccttcgtaccacgttaacncgtaacgtccgaagcccgttcgacgaaccgttctaacgggtaaancgtttacgttacgaaccctttaaactttagttaccgtaagtttaaaccaaaaaggtttacttaacgtacccgtcgttacccccttacggttaccgttaaccgggtttcggaccgggggtaaaccggtaaccgggtaaggttaacgggaccttaaaggtaacctaaacgggttacttgggttaacgg

SEQ ID NO: 271292 - DNA, 521 bp, Homo sapiens
  misc_feature: GYAE6OF02G3WS4.25.4.A04.1.454.CMB.1.raw
  modified_base (499)..(499): a, c, t, g, unknown or other
  misc_feature (499)..(499): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtggttatcactactggagctggactccgccagcacccgaggggaacgggccgtggagtcggattggggtacagtctattaccggtgggacgcaccgttctacaaccccgtcctcaatcgtcgagtcaccatctcattacgactacgtactaacgaacctacgttctaccctagtaacgttgaactctcgtgactgccgcggacacggccgtgtattcgtgtgcgcatactacgatactgtgtcgatatcaccatcacgtntcgtctttgatatcgtggaccg

SEQ ID NO: 271293 - DNA, 623 bp, Homo sapiens
  misc_feature: GYAE6OF02IM7S5.25.4.A04.1.454.CMB.1.raw
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
tcagactgtacagtcacgaccggtgctcgatttagagtagtgatcagggtctgtgaaggcttcaccagtcctggacctcctgtgcaagaacatgaaacacctgtggttctcccctcctgctggtggcagctcccagatgggtcctgtcccaggtgcagctgcaggagtcgggcccaggactggtgaagccttcacagaccctgtcccctcacctgcactgtctctggtcggctccatcacagtgttatcactactggagctggactccgccagccaccgaggggaacgggcctgggaggtggtacgttgggtaacatctaagttaccggngggacnctaccttctaaccaaccccgtcctacaatacgtacgagtcactactctactaatacgacacgtactaacgaacctattctccctagtaacgttcgaactctagtcgtacgtgacccggacggaccgaccgggtccgtagtaacgttacgtcggtcgacggacctacgtaacgttaacgacttaacgtacggtcggtaccgtataacgtcctaacccgtaagtccctaacggtacgtttacgttacgtttttacggtaattacggttccggtacgggggtaaccccgg

SEQ ID NO: 271294 - DNA, 752 bp, Homo sapiens
  misc_feature: GYAE6OF02JPJBH.25.4.A04.1.454.CMB.1.raw
  modified_base (227)..(227): a, c, t, g, unknown or other
  misc_feature (227)..(227): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccagggcaggtgaagccttcggagaccctgtccctcacctgctctgtctctggtnacctccatcacctagtaatgctctattacgngggctggcctccgccncgccccgagggacggccgtggagtggagttgacgtattggtctttcgagttaggtgggtagttcgtaccttaaccgtaccgtaccgttaccccgttccctacgtaacggttacggtaccggtaacgttcccgaaccttagtttttaccgggttacgtaacccggtacccgtttacccgaaccggtccgtaaacgggcccttaagggttttccgtccgttcgtacggaacctacggttacgtacccggttcctcggttaccccggaacccggggtcccggaccccgtaacccggtacccggggtttccttaaccgttaacgtttaccgtcgggttcaccggtacgtacggtcgtaccgggaccggttaacccgtaacccccgtacgttaacccccgttacggtttacgaacccgtacgggttccgggaacccgtaaccggggtaccgtccgtaacccggtacccgtaccacccgtaccg

SEQ ID NO: 271295 - DNA, 860 bp, Homo sapiens
  misc_feature: GYAE6OF02HBWDS.25.4.A04.1.454.CMB.1.raw
  modified_base (310)..(310): a, c, t, g, unknown or other
  misc_feature (310)..(310): n is a, c, g, or t
tcagactgtacagtcacgaccggtgctcgatttagagtagtgatcaggggggggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctggggggagtcttggtacaggcccagggccggtcctgacacgtctcctgcacagccttccggactctaccgtttggtgagcgatgctagtcgtacccgtggggtcccnccgagggtcctaccggagggggaacgggttctgggtaggtggtcgttttggggtactagttaaggaaagtccggaaagtcccgttaaggtcgggggttcggggaaccaaaccgtacgaaacgttcccgggcccggtaccggttaccgtaaagggtaaaaaccggtcaaaggttacctttacgaccgttccccgttacgtaccgaaaggtaggtaagttaccggtaaacgtttaaacccgaaaaagggtcctaaaccgttacccggtaacctttacgttacccgttcggaaccctaacctacggttacgggaacggtacccgaacgggtacccgtaaacgggtaaacgggtaaacgggtaccggggtaaacggtaccccgttaaccggacgggtttacccggttacggttttaacgtttttacccgttttaacggtttttaaccgtttttaaccgttttaaccgtttccggttagggttaaaccggtttaaggggttttacggtttaacggggttttttaaactttttacgtttaaaccccgttttaaacc

SEQ ID NO: 271296 - DNA, 750 bp, Homo sapiens
  misc_feature: GYAE6OF02JH7D3.25.4.A04.1.454.CMB.1.raw
  modified_base (257)..(257): a, c, t, g, unknown or other
  misc_feature (257)..(257): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtcgctccatcacagtgttatcactacgtgganctggactccgaccagccacccgaggggacggtcctggacgtggtagttgggtacattacgtacgttaccggtagggacgtacctacccgttacgtaacccgtaaccccgttccctaacgtaaacgttagggtaccgtaacgtaccgtacctagtacccttactaacgtttaacgaaccgtaaccggttaaccgttaaaaccgaacccgttaccggtttacccttacccccgttaaggttaaaacggtttaccgtaaaccgtttccggtttacggtaccggtaaccgttccggcccgggttaacccggacccgtaccgggtcccgtttaaggttactttaaccggttaggtccggtaccgtacttaaccgttaccgttaacggtaacttacggttaacggtcggtaccgtaacgtacgtacccaacctacgtaccgtaagtacgtttcgttaccgtttttacgaacgtttacggttccggtacggggtaacccg

SEQ ID NO: 271297 - DNA, 660 bp, Homo sapiens
  misc_feature: GYAE6OF02HONWM.25.4.A04.1.454.CMB.1.raw
  modified_base (192)..(192): a, c, t, g, unknown or other
  misc_feature (192)..(192): n is a, c, g, or t
  modified_base (555)..(555): a, c, t, g, unknown or other
  misc_feature (555)..(555): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagactacagatgtgacgtccagatgacccagtctccatcctcctgtctgcatctgttganacagaactcagcactcacgtcggccgggcgagtcgagggcattagctaattatttagcgtggtatacaacgaagaaaccagggagtacgttacctaaggtcctacgtagactctattcgctcgccctaccgtacgtttaccacgttccggaccggggtaccctagttccgttacggttcacgggccggtacgtaggtacggtaaacgttcgggtacggggaactaaggttaccgtttacgtacccttcgtaaccctaacgttataccgtaagcccgtaacgtccgttacgaccgaacgtccgtaagtaaaggtcttaggttacgaacctttaatttaacgttatacgttaaactaaaaggttntaaactttccgtacgtaccccttactaccgttaaccggttccgggaccggtaacgggtaccgtagggacggtaacgtacgtaaccgtaacggtacgtacggtacg

SEQ ID NO: 271298 - DNA, 724 bp, Homo sapiens
  misc_feature: GYAE6OF02H3LDZ.25.4.A04.1.454.CMB.1.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccagggccggtccctgacactctcctgcacagcttccggactctaccgtttggtgacgcatgctagtgacccgttggggtccccgccgacggccgttaccggaaggggtaacggggtctggggaggttcggggtcgtttaggggttccaatttaagggaaacggtacggaaacggtcccgtttaaggtcggggggttacgggggaaccctaaaccgaaactaaaccgtaacccgggtccccggtaccgtttacccgttaagggtaaaaaaccgggctaaggtaactttaccgacggtccctactacgaaagagatagtaacttaaccgaaaagctactacgaccttatacgtagctaacagtacgagaccgacgtcctaggaaaggaacgaccgggaacggtactaccggacggtccgttaggttaacttttacctttcggtttaccttttaacgtttaccgttacgttagggtaaggttacggttaggttttaagg

SEQ ID NO: 271299 - DNA, 601 bp, Homo sapiens
  misc_feature: GYAE6OF02G1O0R.25.4.A04.1.454.CMB.1.raw
  modified_base (257)..(257): a, c, t, g, unknown or other
  misc_feature (257)..(257): n is a, c, g, or t
  modified_base (329)..(329): a, c, t, g, unknown or other
  misc_feature (329)..(329): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacacgaccctgtccctcacctgcactgtctctggtgctccatcaccagtgttatcactactgganctggactccgcagccaacccgagggaacgggcctggagtggagttcgggtacagtcgtagttacggtggacnctaccttactacctaacccgtcctactaagtacgtcgacgtaccaacactctacaagttacgactacgtactaacgaacctagttcctcctagtaacgttcgaactcgtagtcgactcgaccgccggactaccgggtaccttagtacttacgtggtcgcggtactacgtactaacgtacttaacgtaggtacggaccgtaattacgtaccgaacctactaccgaacgttacttcggttacttttagtacgttacgtccgggtacgggaaccg

SEQ ID NO: 271300 - DNA, 487 bp, Homo sapiens
  misc_feature: GYAE6OF02F8GL5.25.4.A04.1.454.CMB.1.raw
  modified_base (444)..(444): a, c, t, g, unknown or other
  misc_feature (444)..(444): n is a, c, g, or t
  modified_base (472)..(472): a, c, t, g, unknown or other
  misc_feature (472)..(472): n is a, c, g, or t
tcagactgtacagtcacgaccggtgctcgatttagagtagtgatcagggggcagaagtctctctcagtcaggacacagcatggacatgagggtccctgctcagctcctgggactcctgcttgctctggctcccagataccagatgtgacgtccagatgacccagtctccatccctccctgtctgcatctgttggagacagaatcagcatcacttgccgggcgagtcgagggcattagcaattatttagcctggtatcaacagaaccagggagagttcctaagctcctgatctatgctgcctccacgttacactcacggggtccatctcggttcagcggacagtgatcgtgggacagacgttcacctctcactatcagcacgctgcacgcctagaagtatgttgctaacttattactgtaactaaagtataactctacgtccctntctcgttcggcggaggacaaggtgaganacgaagacgtgtcgg

SEQ ID NO: 271301 - DNA, 717 bp, Homo sapiens
  misc_feature: GYAE6OF02JZZS1.25.4.A04.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgtganacagaactcagcatctacgttggccggnagtcgaggctaattacgactaagtttacgtttagccttaggtaactcaaaacgtaacgtaaaaccggaagggtagtaacgtttaccgtaacgtccttacccgttagtaaccttaccgttaacgtcggtaccgttccgtacccctacccgttaaaccgtttaaccgaccgttccggggtaacgggtcccctaacgttcggtttccggttacgacggcgggtactagggtacgtaacgttccgagggtacaacgggttacttacctacgttacctcgtaacttactaccgacgtaccctacgtccgtagacccgtagacccgttagacgtacgttgtacgaacctttaatttacgttaacgtacgttaaacttaaacgttacgtaacgtacggttaccgaccgttaggtaacggttccggaacccggttaccggaaccgggtaaccgtaagggttaccggtaacctaaccggtaacgtaaacggttacggtactaccggg

SEQ ID NO: 271302 - DNA, 914 bp, Homo sapiens
  misc_feature: GYAE6OF02HL1BN.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtgcagctcccagatgggtcctgtcccaggtgcagctgcaggagtccgggccaggactggtagaagtccttcacacgaccctgtccctcacctgcactgtcctcgtggtcggtcctaccactaccaccgtaggttacggttactaccgtaacttacgtgggacgtcgttcgggacctcccggaccacggtccaaacccgggaggggacgggtccgtagggtacggttaggtacgtttacgggtaactgttaccgttaacgtttaccggggtagggaccgttacccttaaccgtttacccgtaaacccgtaacccccggtttcccttaacgtaaaacggtttaccggttacccggtaaacgttacccgtaaacccgttaactttacccgtttaacgtaaacgttttaacccggaaacccgtttaacccggttaaacccgttaaaaaccggtaaccccttttaaccgggtttttacccccttaaccccggttaaacgggttaaaacggttttccgtaaaacccgtttcgggtaccgttaaccggaaccggttccgggaaccccgggttaccggaaaccggttcccgggttacccggtttagtttaaacccgtttacgggttcggtaccggtacccggtaactttaaacggttaacccggttaaacccgtagtttaaacccggaagggttccgggtaacctttaacggtaaccctaacccgaaccttaagtacccaacggtttcgttacgttttacgtttagacgtttaccggtacggggtcccggggtaaaccgg

SEQ ID NO: 271303 - DNA, 614 bp, Homo sapiens
  misc_feature: GYAE6OF02GOJHV.25.4.A04.1.454.CMB.1.raw
  modified_base (215)..(215): a, c, t, g, unknown or other
  misc_feature (215)..(215): n is a, c, g, or t
  modified_base (320)..(320): a, c, t, g, unknown or other
  misc_feature (320)..(320): n is a, c, g, or t
  modified_base (410)..(410): a, c, t, g, unknown or other
  misc_feature (410)..(410): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcnctgtctctggtgctccatcaccagtgtatcactactggagctggatcccgcagccacccgaggggaacggcctgggagtggtattgggtacatcgtattaccggngggacgctaccgttctaccaacccgtccctacaatgtcgagtccacatctactattacgaccacgtactaaacgtaaccctagtttcccncccttagaacgtttcgaacttcgttacgtgaccttcggcccgtacggaccgaccggtccgttagttaacttacgtgggtcgccggtataacgttaccgtaacgtattaaccgtacgggtacggcccgtaattaccgtccaaccctataccgaacgttgttacggtttacttttagaaccttagttccgggtaggggtaacccgg

SEQ ID NO: 271304 - DNA, 620 bp, Homo sapiens
  misc_feature: GYAE6OF02HCN3D.25.4.A04.1.454.CMB.1.raw
  modified_base (474)..(474): a, c, t, g, unknown or other
  misc_feature (474)..(474): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttcttgttgcttgttttaaaggtgtccaatgtgaggtgcaacgtggtggagtcgtggggggaggtcttgggtacagccaggcccggtccctgacactctcctgcacagcttccggactctaccgtttggtgagcatgctagtcgacgtcgggtcccgccgaggcctccgaggggagggtcgtgggagtggcgtttgggttctaagttaaggaagcggaaacgtccgtagtggggtcgggacaacgaacaacgtacgccgtcgtactaggaaaaggcagtactacacgcctactacgaagagtatagaacttaaccgaaancctaagtccgtacctactctacgactaacagtcgagacacgtctaggaagtacgacggacggacctacgacgggtccgttagttaacgttacgttgttttacctttaacgtttacgtcgttaggtaggttaggttaggtttaacgg

SEQ ID NO: 271305 - DNA, 621 bp, Homo sapiens
  misc_feature: GYAE6OF02HUHO3.25.4.A04.1.454.CMB.1.raw
  modified_base (208)..(208): a, c, t, g, unknown or other
  misc_feature (208)..(208): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctnacctgcactgtctctgtggctcatcaccagtgttatcactactggagctggatccgccagcacccgagggaggcctggagtggattgggtacatctagttaccggtgggagctaccttctacctaacccgtccctacaatacgtcgtaacgtcaacctatctcattagactacgtactaagacctagttcctacctaggtaagttgaaactcgttgtcgacgtagtccggacggacaccgggtccgttagtactttaccgtggttcgaccgggtactaacgttaccgtaaccggtaacttaacgttaggttacggacccggttaataaccgttccgaaacccctatacccgtaacggtacgtttcggttaccgtttttgaaaccgttacttaccgggtacggggtaacccggg

SEQ ID NO: 271306 - DNA, 645 bp, Homo sapiens
  misc_feature: GYAE6OF02I8KXR.25.4.A04.1.454.CMB.1.raw
  modified_base (155)..(155): a, c, t, g, unknown or other
  misc_feature (155)..(155): n is a, c, g, or t
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
  modified_base (484)..(484): a, c, t, g, unknown or other
  misc_feature (484)..(484): n is a, c, g, or t
  modified_base (504)..(504): a, c, t, g, unknown or other
  misc_feature (504)..(504): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagntgacccagtctccatccgtccctgtctgacatctgttggagacagaatcagctatctacttgccggnagtcagggtcattagctaagtttatttacgccttggtactacgaaacgaagaaaccngggaagacgtttacccaaagtcctacctagaacttccgtaagtccgtactccgtccctaccgtaacgtttaccgaccgttcggaacgggttcccaacttcggtttccggtacaacggcgtactagtagaacgttcggtcggaactaggtactttcaacgtcttacaactacgtcaacgnaccnctgacgagtccgtagaaacgtntggttactacgttaaccttnttacgtacgtaaattaaaagttactaaacgttccgtaccgtacccttacctaacggttcgtttaaccgggaccggttaacggtaaacccggtggtaacccggtaattaaccgtaccgaaaacggttacgtcggttaaccgg

SEQ ID NO: 271307 - DNA, 519 bp, Homo sapiens
  misc_feature: GYAE6OF02FQXF0.25.4.A04.1.454.CMB.1.raw
  modified_base (219)..(219): a, c, t, g, unknown or other
  misc_feature (219)..(219): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaattatttagcctggtatacaacaagaaaccagggagagttcctaagctcctgatctatgctgcctccacgttacactcgacgggtccatctcggttcagcgnagtgatcgnggacagtagttcactctacactatcagcacgtccttgaccagcctagagtattgttcgactaactttattacgtattaactaaattaagtaactactcgtacccctgtactacgttcgggacgggaaccggtacgtaagggtacgacggtactaacgaacgtacgtggtacgg

SEQ ID NO: 271308 - DNA, 565 bp, Homo sapiens
  misc_feature: GYAE6OF02FSP5H.25.4.A04.1.454.CMB.1.raw
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (413)..(413): a, c, t, g, unknown or other
  misc_feature (413)..(413): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcgagggcattagctaattatttagcctggtatcaacaagaaaccagggagacgttacctaacgctcctagactctatcgctcgcctccacgttacactcgacgggtccatcgtcggttcagcgacngtgatcgnggacagtacgtcactctactactactcacgcacgtcctacgcacgcctagaagtnttggttacacttaactttacttaacttcgttaactaaaagttacttaaataccttaccgtcccttacttacgtaaccgtttccgggaaccgggtaacgggtaaccgtaagggtacggtaacgtaacgtaaccgaacggtacgtggtaccggg

SEQ ID NO: 271309 - DNA, 669 bp, Homo sapiens
  misc_feature: GYAE6OF02JTVH5.25.4.A04.1.454.CMB.1.raw
  modified_base (148)..(148): a, c, t, g, unknown or other
  misc_feature (148)..(148): n is a, c, g, or t
  modified_base (522)..(522): a, c, t, g, unknown or other
  misc_feature (522)..(522): n is a, c, g, or t
  modified_base (582)..(582): a, c, t, g, unknown or other
  misc_feature (582)..(582): n is a, c, g, or t
tcagactgtacagtcacgaccggtgctcgatttagagtagtgatcaggggcgagaagtctctctcagtcaggacacagcatggacatgaggtccctgctcagctcctggactcctgctgctctggcctccagctatcagatggtgacntccagatcgacccagtcctccatccctcccgtgtctcgacattctggttagagaccagacgtcaccatccacgttggccggcagtccgagggcctaggttaggtaaattttacgttcgggtaccgttagggttacttaccgaggtaccaaaccggtaaaacccggaaggggttaaaaccgttacccttaaaccctaccgttactaaaccttcgtaacttacgtcgtacgtctaacgttccctaacgttttcaccgttaaggttttccgggggttaaccccttcgtccgtaacgtttccgaacgggttcggaccttagggttcgggtccttaggggactacggttaactcgtacgttcctacacgtactggaacnccacgtctcggcacgtccgagaagctgttacgactattacgtattccgaaattaacttcncggtaacgtcgtacgagttcgttaacgccggtaacgtaggaacccaaggttccgaacttactaaccgaataacggtcggtagtacgg

SEQ ID NO: 271310 - DNA, 605 bp, Homo sapiens
  misc_feature: GYAE6OF02IDK13.25.4.A04.1.454.CMB.1.raw
  modified_base (245)..(245): a, c, t, g, unknown or other
  misc_feature (245)..(245): n is a, c, g, or t
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
  modified_base (455)..(455): a, c, t, g, unknown or other
  misc_feature (455)..(455): n is a, c, g, or t
tcagactgtacagtcacgaccggtgctcgatttagagtagtgatcagggggagaggagccccagccgtgagattcccaggagtctccactggtgatcagcactgaacacagaccaccaaccatgagttggcttaactgtctttcctgtgctgtttaaagtgtcctaatgtgaggtgcaacgtggtggacgtcgtggggaggcgttggacagcccgaggcccgtcctgaccgactcctctgacacngccttcgactctaccttggtgagtccatgctatgacctggtccgcaggcctcgaggtaggtctaggngtgactgggtcagttagaacgtcgaagtcngtggaggctaaacgactaagaccgccgatacgtacgaaaaagcaacggtattaccgacgtaccctcgtaaccgaagtaaggtaactacggtaactaaacccgggttaaaaacnccgtaagtcccgtacctacgtaccacgtacaacacgtgaacgccacgttaccgagaagacgacgacgactacgacgtaccgtagttaattacgtctttactttaactacgttctaggagtacggttagttaggttactttagttacctag

SEQ ID NO: 271311 - DNA, 539 bp, Homo sapiens
  misc_feature: GYAE6OF02FTCCE.25.4.A04.1.454.CMB.1.raw
  modified_base (487)..(487): a, c, t, g, unknown or other
  misc_feature (487)..(487): n is a, c, g, or t
  modified_base (522)..(522): a, c, t, g, unknown or other
  misc_feature (522)..(522): n is a, c, g, or t
tcagactgtacagtcacgaccggtgctcgatttagagtagtgatcagggggagctctgggagaggagccccagccgtgagattccccaggagtctccacttggtgatcagcactgaacacagaccaccaaccatggagtttgggcttaactgtcttttccttgttgctgttttaaaaggtgtccaatgtgaggtgcaactggtggagtctggggggaggcttgggtacagccaggccggtccctgacactctcctgcacagccttccggactccacctttggtgagcatgctatgacctgggtccgccaggcctccgagggaagggtcgtgggagtgggcttgggttcagttagagcgaagcctagtgggtggggcaacacaagtaccgccgcgtcgtagtaaaacggcagattcgagtcctctacaagagatgacttaccaaagcactcgacctatctgcacatgagcagcctagagagcgagacncgacgtccgtgtacttactgtttacttacttactntggagtagtagttacgg

SEQ ID NO: 271312 - DNA, 604 bp, Homo sapiens
  misc_feature: GYAE6OF02JXE77.25.4.A04.1.454.CMB.1.raw
  modified_base (367)..(367): a, c, t, g, unknown or other
  misc_feature (367)..(367): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtccagatgacccagtctccactcctccctgtctgcatctgtggagacagatcagcatcacttcgggccgggcgagtcgagggactattacgactaatttattacgtccgtaggtactacaacgaacgaaacgagggagtacgtactacgtactcgtagtatctatcgctcgtcctacctacgttaccacgtccgacgggtcctacgtcgtcgtacgngcgactgtagagtcgtaggacgtagtactcctatccgtactactatacgacgtaccgacgtccgtacgaccgtaacgtaccgtaagttaagtacggtttggttaacgtaccctttaacttaaccttacgtacgtaacctaaattaaactaattaacttaactttacgtacctaaccgtttcgttaccggacgtaacgggtacgaaggtagacgtacgtaacaacggttacgtagtcg

SEQ ID NO: 271313 - DNA, 651 bp, Homo sapiens
  misc_feature: GYAE6OF02FPR2T.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctcgtggtgctccatcaccagtgttatcactactggagctggactccgccagccaacccgagggaacggcctggacgtggattcgggaactagtacttacgttaccggtgggacgtacctacccgtttacaaccgtaaccccggttccctacgaaattacggtacgaactccaacctattcctacatttaacgacctacgtactaacgaaccgtacgttcctacccgtagtaagttacgtaaccttcgtagtacgtacgttcgacccggtacgaaccgtacgggtccgttaggttactttacgtacggttcggacgggtacctaacgttaacctaacggtaacttacgtaacggtcggacctagtacgtaccaccgtactacgtacgtagttacgttacgttttagacgtttacgtcggtacgggtaaccgg

SEQ ID NO: 271314 - DNA, 718 bp, Homo sapiens
  misc_feature: GYAE6OF02GPNXC.25.4.A04.1.454.CMB.1.raw
  modified_base (255)..(255): a, c, t, g, unknown or other
  misc_feature (255)..(255): n is a, c, g, or t
  modified_base (318)..(318): a, c, t, g, unknown or other
  misc_feature (318)..(318): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtgtatcactactgganctggactcccgccagccacccgaggggaaggcctggagtggagttgggacatctagttaccgngggacgctaccttctaccgtaacccgtcctacaatacgtacgacgttaccacctactccgtacaacgtttaacgaacctaacgttaactaaacggtaaacccctaggtttacccttccccgttaaggtaaacgtttaccggaaaccttccgttaggttacggaaccgttcggaccccgggtaccggtaaccgtaccgggtcccggtttaggttaaccttttaaccggtacggttcggaccgggaccttaagtttaaacccgttaaaccgtaacgtttaaaccgttacgggttaccgggtaccccgttaattaaccgtcccaaaccgtacttacccgtaacggtaactttcgggtttaccttttaggaactttacggttaccggttacgggggaaacccgg

SEQ ID NO: 271315 - DNA, 850 bp, Homo sapiens
  misc_feature: GYAE6OF02JWHMW.25.4.A04.1.454.CMB.1.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (613)..(613): a, c, t, g, unknown or other
  misc_feature (613)..(613): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgtcttagttttaaaggtgtccaatgtgaggtgcaactggtgagtcgtggggagtcttggtacagccgaggccgtcccngacactctcctgcacngtccgttccgactctaccgtttggtgagctatcgcttaagtggacccgttcggggtccccgcgtaggcccgttaccggaagggggtaacgggttcgtaggggtacggtttcggggtcgttttacgggggttacctaaaggtttaacgggaaacggtacggaaaccgttcccgttaagggttcggggtacggggtaaccaaaactaaacgtaaacgttccccgggaccgtccggttaacgtaaacgggtaaaaacggccgtaaagggtaaccttcgaaccgtcccgtacgtaaccgaaagtaacgaagtacggtaactaacccgaaaagtccgtaactaccgtaccaagtttaccncggtaacctaaccgttagacgggaccgttacgtaacccgggttccgaaagggaaacccggtaaagggaccccggtaaacggggtacccttaacgggttaaccccgggtaaccgggttttaacccggtttaaacgttttaaccggttacccgtttttaaaaccgttttagttttaaccccgggttcggtttaaacggttaaccggggtttaagttttaaaccggggttttttaaccgg

SEQ ID NO: 271316 - DNA, 753 bp, Homo sapiens
  misc_feature: GYAE6OF02J2GQ1.25.4.A04.1.454.CMB.1.raw
  modified_base (257)..(257): a, c, t, g, unknown or other
  misc_feature (257)..(257): n is a, c, g, or t
  modified_base (283)..(283): a, c, t, g, unknown or other
  misc_feature (283)..(283): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgtgctgtttaaaggtgtccaatgtgaggtgcaactggtggagtcgtggggggaggcttgggtacagccagggccggtccctgacactctcctgcacncgtcttccggactctaccgtttgggngagccatcgctatggaccctggggtcccgccgacggcctccggaaggggaacgggttcgtggggaagttgggtccgtttggggttaccaagtttacggaaggtcgaaacggccgttaaggtggggttacggggaaccaaacgtaaccgaacttaccgggcccgtcggttaactaacggggtaaaaacgggctaaaggtacgttaccgaacggttccccttacgaaccgtaaagaacggtacgttacggtaaccttaacccgaaaaggttcccgaacgttacccggtaccttacggttcctacggtaccctaacgtacgttacgggtacgtaccgaacccggttcgtaacgggaaacggtaacggtaccgggacgggtaccctacgtaacgggtcccggttagttacgttaaccgtttctttaccgtttactttaaccgtgtttacggaggttaacggttaggtttaacgg

SEQ ID NO: 271317 - DNA, 687 bp, Homo sapiens
  misc_feature: GYAE6OF02G1PHV.25.4.A04.1.454.CMB.1.raw
  modified_base (199)..(199): a, c, t, g, unknown or other
  misc_feature (199)..(199): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtccagatcgacccagtcctccactccctccctgtctgctatctgtgganacagaatcagcatcacgttcggccgggtacgagtcggagggtactagttacgtactaaagtttacgttacgaccgttaggttaactaccgaaaccgaaaggaaacccggagggtaacgtacgtttaccgtaaagtcccttaccgtagtaatctagtcgtactccgtaccctaccgtacttaccgacgtcggtaccgggtaccctagttccgttcggtacgcggacgtagtacggtagtaacgtcggaggtaacgagtacgttactaccgtactaccgtattacgtacgacgtccgacgtccgtacgacgtacgtacgtaggaagttcgttagtactaacctttaagtttactagttaacgtaaacgttaaagttaaactaccgtcgtaccctaccttaccgtaccgtttccgggtaccgggacggggtaacggtaccgggtaaggtaggttacctaaacgtaacccgtaaacggtcggttagtaccgg

SEQ ID NO: 271318 - DNA, 719 bp, Homo sapiens
  misc_feature: GYAE6OF02H5YT3.25.4.A04.1.454.CMB.1.raw
  modified_base (226)..(226): a, c, t, g, unknown or other
  misc_feature (226)..(226): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgctatctgttggagacagaatcagcatcacttgccgggcagtcgngggcattagacaattatttagccttggtatacaacaagaaaccagggaagtagttacctaagacttcctgactctatgctgcctcacgttacactcgtacggggtccagtcgtcggttacagccggatagtacgaactcggtagggactaggtacgttacgtactacctacacgttaactcgaacgtcgtaacgcccgttacgaccgtaacggtacccgtaagggtaaacgtaacgtttacggttaccggtaaacccgttttaaactttaaaccgtttttaacgttaaacggtttaaaaccgttaaaaaaacggtttaaacttaaaaccgtttaaccgttacccgtaccccccgtttaccgtttacccggtaaccggtttttacccggggacggggttaaaccggggtaaaacccgggtaacggggttacggggaaacggttaacccgttaaaccggtaaaaccgggttaacccggtttagggtaacccgggg

SEQ ID NO: 271319 - DNA, 679 bp, Homo sapiens
  misc_feature: GYAE6OF02GYMJF.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtgttatcactactggagctggactccgcagcaccgagggacgggcctggagtggagttgggtacatctagttaccggtgggacgctaccttcaacctaacccgtccctacaaatacgtcgacgtcaaccatctacattagacctacgtactaaagaaccctagtttccctacccgtaggtaacgtttacgtaaaccttcgttcggtcgtaccgttcggacccggtaccgggtaacctaccggggtccccgttaggttaactttaccgttgggttcggtaccgggtacctaacgttaaccgttaaccgaacgtttaacccgttacgggttacgggtaccccgtaaatttaccggttaacccaaacccctaattacccgaaccggttatttcggtttactttttaggactttaacggttcccgggttaggggtaaacccggg

SEQ ID NO: 271320 - DNA, 799 bp, Homo sapiens
  misc_feature: GYAE6OF02I7KRG.25.4.A04.1.454.CMB.1.raw
  modified_base (214)..(214): a, c, t, g, unknown or other
  misc_feature (214)..(214): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctccagactaccagatgtgacgtcagatcgacccagtctccatcccttccctgttctgctattcgtggttgaacgacagtactcganacatctacgttcggccgggcgtagtcgaggactagttagactaatttagttacgtccgtaggtactaaccgaacgaacgaaaccggtaggggtaacgttaccgtttaccggaagtacccgttccgtagtacttacgtactcgtcccttccgacccttaccgttaaccgttaccgaccgttaccgggtaccgggttacccttacgtttccggtttccggtacgtaccggtacggtacgtacggttaacgtacggttccgggtaaggtacgtacgttaacgttaccttactacgtaacctaacgttacgtacgacgtacctaccggttaccgagtacctacggtaaccgtaaggtacgtacgtttcgggtaacttaacccggtttaactttaaccgttacgttaaacgttaaacggttaaaattaaccggtttaaactacccgtcccgtttacccctttacggtttaaccggttaccggggtttaaccggggaaccggtaaacccggggtaacgggtttaacgggaaccggtttacggttaaaaccccgttaacggtaaaaccgggtttgtaacccgggttaaccgg

SEQ ID NO: 271321 - DNA, 684 bp, Homo sapiens
  misc_feature: GYAE6OF02H0O84.25.4.A04.1.454.CMB.1.raw
  modified_base (284)..(284): a, c, t, g, unknown or other
  misc_feature (284)..(284): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtctttttccttgttgctgttttaaaaggtgtccaatgtgaggtgcaactggtggagtcgtgggggaggcttggtacagccaggcccggtccctgacactctcctgcacagccttccggacctctaccgtttggngagcatgctatcgaccgttggggtcccgccgagggccttaccggagggggaacgggttccgtgggaggtgggtcgtttgggggtttcaagttaggaagtcgaacgtccttagtggggtggggaccaaacgacaaagtccggccgcgtacgtaggtaaaaggcaagtattcgacgtcctcacgaagaagatagtacttaaccaaaagctaacgtccgaccttaacgtctacggacacgtaagttcgaacgccaagtcccgtaggaaacgaaacggcggaacgggtacctaccggtacggtaacccggtttcgttaaacgttttaacccggtttagttttaaccgtttttaacgtttacctttaaccggtaggtaacgggttaggtttacggtttttaaggg

SEQ ID NO: 271322 - DNA, 993 bp, Homo sapiens
  misc_feature: GYAE6OF02GAZSD.25.4.A04.1.454.CMB.1.raw
tcagactgtacagtcacgaccggtgctcgatttagagtagtgatcaggggcagaagtacgtctctcagtccaggacacagcataggaacatgaaggtccctgcgttcacgcctccgtgggacgttccgtgactcgcctcgtggccgttcccaggtacctaaccgagactaggtcgtacgtccaggaagtcggacccctaggtcctccgagtacctccttgtacagcctatcctagttacgagacagtaactcctagcgtagtacctaccgttaggaccccggggactaacggttacggttaacggggtacctaacgtttaacggtaccggttaaaagttttacgttttaacggccggtttaacgggttacctaaaccggaaccgtaaaaccgggaaaaccgggtaaacggggtaacggtaaccggttttaaccgtaaacggtccgttaaccgttagggtaaccttaacgttacgttaacggttacccggttacggtaccccgttacccgttaaaccgttttaacccgtaaacccggttaaccccgggtaaccccggggttaaccccttaaaggtttacccggtttacccgggttaacgacccgggtaaccgggtaacgttaccggttaacgtaaacggttaccggttaaccggggtaaacctaacgggttaaaccgtttaaccctaaccgttacccctttaaaccgtaacgttaacgttaccgaaccggtacgttaacggtccccgttagtacccgaacgggtacccgtaggtaaccggtacgttaacgtacgtaaccgttaaacgtttccgttaaacgtttacgtaaaccgtaaacctttaaaggtttaaaccggttaccttaccccggtttacttaccggtttaaccggttaccgggaccggtaaaccgggttaaaccggttaaggtaaaccggtacgtttaaaccgttaaccggtaaaccggttacggtttaccgggacgggttaaccgg

SEQ ID NO: 271323 - DNA, 582 bp, Homo sapiens
  misc_feature: GYAE6OF02G4NID.25.4.A04.1.454.CMB.1.raw
  modified_base (319)..(319): a, c, t, g, unknown or other
  misc_feature (319)..(319): n is a, c, g, or t
tcagactgtacagtcacgaccggtgctcgatttagagtagtgatcagggtttgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtgttatcactactggagctggatccgccagccacccgagggaacggcctggagtggagttgggtacagtctagttaccgnggagcacgttctacacccgtcctacaatcgtacagtcacatctctattacgactacggtactaaacgaacctacgttcctaccctagtaacgttacgtaacttcgtcgtacgacttcggccggacggaaccgtaccgggtccgttgttaacttacgtggtacgcggactacgtactacgatacgtagtcgcgtagtactacgacctatacgtaacgtagtcgttacttttaggaattcgtaccggtgggtaaccgtaaacggg

SEQ ID NO: 271324 - DNA, 570 bp, Homo sapiens
  misc_feature: GYAE6OF02G62L8.25.4.A04.1.454.CMB.1.raw
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagtggttatcactactggagctggatccgccagcacccagggaagggcctggagtggagttgggtacatctaagttaccggtgggacgcaccttctaccaacccgtccctactaatagtcgacgtcaaccatcctcaattacgactaccgttactaacgaaccctaacgtttcctacccttagtaacgttagtaaacttcttggtacgactcggcccggaccggacgtaccggtccgtagttacttaccgtgtcgcgcattactacgtatactagtcggacgtatactcacctatacactaggggtnttctttnatacgtcgtgggtaccgg

SEQ ID NO: 271325 - DNA, 594 bp, Homo sapiens
  misc_feature: GYAE6OF02JAHN1.25.4.A04.1.454.CMB.1.raw
  modified_base (402)..(402): a, c, t, g, unknown or other
  misc_feature (402)..(402): n is a, c, g, or t
  modified_base (485)..(485): a, c, t, g, unknown or other
  misc_feature (485)..(485): n is a, c, g, or t
tcagactgtacagtcacgaccggtgctcgatttagagtagtgatcagggggggagaggagccccagccgtgagattcccaggagtctccacttggtgatcagcactgaacacagaccaccaaccatggagtttgggcttaactgtcttttccttgttgctgtttaaaaggtgtccaatgtgaggtgcaactggtggagtcgtgggggagcttggtacagccagggccggtccctgacactctcctgcacagcttccggactcaccttggtgagcatgctatcgacctgggtccgccaggcctccgaaggggaggtcgtggagtgggtcgttgggttcagttaggaagcgaagccttagtgggtgggacaacgaacaactaccgccgcgtctaggtaaaaggnaggacttcgacgcctactacgaagacggtatagtacttaccgaaaagactacgtccgtaccttatccgtagccactatggacncgaaccgtcgtacgagaacgcgaacggactccgagtccgtagttacgttacgtcgtttatttaattccttacgtagtagtaggtagttggttaactttattacgttaac

SEQ ID NO: 271326 - DNA, 635 bp, Homo sapiens
  misc_feature: GYAE6OF02G3MLE.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtcagatgacccagtctccatcctccctgtctgcatcgtgttggagacagaatcagcatctacgttggccgggcgagtcgagggcatagactaattattagctggtatacaagaacgaaacgagggagtagttaccgtaagctcgtagtactactaatcgctcgcctacctacgttaccacgtcgacgggtcctagtcgtcgttcacgcgcgtagtagactcgtagggactaggtacgttacacctctactagtactacgacgacacgtctcgacgtaacgccgtagtaacgtagttacgttacgtaaccgttaaatttaacttaaccgttaagtaaaacgtttaaaaagtaaacttaaacttacccgttaccgtacccccttacgttaccggtttaacccggttaccgggtaacgggtaaccgggtaaccggtaacgggtacggtaaacgtacgttaaaccgaaacggtaacggttggtaacccgg

SEQ ID NO: 271327 - DNA, 579 bp, Homo sapiens
  misc_feature: GYAE6OF02H34UR.25.4.A04.1.454.CMB.1.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (378)..(378): a, c, t, g, unknown or other
  misc_feature (378)..(378): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
  modified_base (551)..(551): a, c, t, g, unknown or other
  misc_feature (551)..(551): n is a, c, g, or t
tcagactgtacagtcacgaccggtgctcgatttagagtagtgatcgagggggcagaagtctctctcagtcaggacacagcatggacatgagggtccctgctcagctcctgggctcctgcttctctggacctcccagataccagatgtgacgtccagatcgacccagtcctaccatccctcctgtctgcatctgtaggacncagatcagtcatcattggccgggnagtcgaggctattacgactaattactttacgcctaggttaacacgaacgtaacgaaaccgtggaacgtacgttaccgtaacggtactcccgttagtaactcgttagtcgctcgcccgtactacggttacacgtcgaccggtctatcgtggtacngcgcagtcaacgtgacggtactagtagtcacttactacaacttctacgacgtccaggtactcggactacgcgtanaagtntacggttactagtaacttcgtactaggtaactaaagtactaagcctccgtaccttcttaccgtacggtcggtaccgggatacggtaacggtancgtaactacggaacgtagtgtacgtacg

SEQ ID NO: 271328 - DNA, 601 bp, Homo sapiens
  misc_feature: GYAE6OF02IFESX.25.4.A04.1.454.CMB.1.raw
  modified_base (262)..(262): a, c, t, g, unknown or other
  misc_feature (262)..(262): n is a, c, g, or t
  modified_base (464)..(464): a, c, t, g, unknown or other
  misc_feature (464)..(464): n is a, c, g, or t
  modified_base (516)..(516): a, c, t, g, unknown or other
  misc_feature (516)..(516): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagtacagaatcagcagtcacgttggccgggcagtcgaggtcattagctaattattagcctggtatacaanaacgaaaaccgaggggaacgtagtttccaacgtccttccgtagtaactctaatcgctacgtcctaccctaacgttacctacgtaccgacggggttacccacgtccgtacggttaccgacggtcggtacgtaaggtagtaacggtcgtacgggtaacaggtacgtctaacctcgtacctactagtcgtacgcacgtccgtcgnaccgctagaagtctagttcaccttaatttacgtacttagtaaataaaacgtntaaactactacctccctcttacgtaccgtttacggacggtaacggaccgtaaggcgtacggaactaacgaacgttagtgtaccgg

SEQ ID NO: 271329 - DNA, 729 bp, Homo sapiens
  misc_feature: GYAE6OF02IUVYT.25.4.A04.1.454.CMB.1.raw
  modified_base (145)..(145): a, c, t, g, unknown or other
  misc_feature (145)..(145): n is a, c, g, or t
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
tcagactgtacagtcacgaccggtgctcgatttagagtagtgatcagggggcagaagtctctctcagtcaggacacagcatggacatgagggtccctgctcagctcctgggactcctgctgctcgtggcctcccagactaccagntgtgaccgtccagatgaccctagtcctccactccctcctgtctgactntctgttgganacagaactcgatcacgtcacgttcggccggggngtaacgtgacggactagttacgacttaaatttaacgtttcgccgtaggtaactaccaaacgacgaaaaacccgtggggaacgtacggttttaccaaacgccgttacccgtttagaactttccttaacgtgtcccgttacgtcccgtacccttaccgttaacccgaccgttaccggtaaccgggttcccctaagtttcccggttccggttacgaaccggtcccggggtataaccggttaggtaaaccggttcgtaacggggtacctaaacggttcgttaccaaccggtttacctaaccgttactaaccgttacgacgtacggtaacccgtccggttacaccgtacgtaccgtagtaaccgtagttcgttactaacgttacttacgttacgtacgaaattaaacgtataactcgtccctactcgtaccgttcggtacgggtagtaaccgggtaacgtaggacgtacgtaacgaccgtaaggtaccggtgtcccgg

SEQ ID NO: 271330 - DNA, 926 bp, Homo sapiens
  misc_feature: GYAE6OF02GMWP3.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtcctgcatctgttggagacagaatcagcatcacttggccgggcgagtcgagggcattagctaattattacgccttaggtactccaaactaacggaaaaccgagggggtaacgtacggtttacccgtaaagtcccgttaccgtaggtaactttccgttaacgtcggtaccttcggacccccttacccgtaaacggttttaacccaaccggtttacgggaaccgggggtttaccccctaacgtttcccgggtttacccgggtttaccgaacgggtccgggaccgtaaggttacggggtaaactttccgggtaacgggggtaaaccgtaacgggttaacggtttaccctaacccggtttcctttaacccgttaaccgttaactaccggtaaccgtaccgtaaccggcccggttaaccggacccgtaaccggtaccccggttaaaggtaaaccggtttaacgggttacccgggttttaacgggtaaccctttaaaccggtttttttaaaccgtttaaacccggtttaacgggtttaaaaacgttaaaaaccggtttaaaccgttttaaaaccgtttaaccccgttacccgtttaccccccctttaacggtttaccccggtttaacccggggttttaccgggggtaacccggggttaaacccgggggttaaaccggtaaccggggggtacggggtaaccggtttaaaccgtaaacccgggttaaaccggttaacggttaacggttacccgggg

SEQ ID NO: 271331 - DNA, 643 bp, Homo sapiens
  misc_feature: GYAE6OF02H0CSQ.25.4.A04.1.454.CMB.1.raw
  modified_base (155)..(155): a, c, t, g, unknown or other
  misc_feature (155)..(155): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagntgacccagtctccatccctcctgtctgcatcgtgttggagacagaactcagcatctacgttcgggccgggcgagtcgagggtctagttagactaatttattagccgttaggtactacaacgaacgaaaccgagggagtacgttaccgtaagtctcctagattactagtcgactcgccctacctaacgttacacgtcgtacgggtcctagtccgttcggttacgacggcgacgtagtagtacgtcgtagggactaggtacttcgaccttacacgtaacttgacacgtaccgtacggtaccctggacctaggttacccgtaagtaacgtgttaggtacctaacgtttaacttttacgttaacgtacgttaaacgtaaaagtacttaacttaccgtaccgtcccctttagacccgtttacggttacccggggaacgggtaacggtaaccgagggtacggtacgtaacaaccgtaaaggtcgtaggtaccgg

SEQ ID NO: 271332 - DNA, 696 bp, Homo sapiens
  misc_feature: GYAE6OF02GTXWS.25.4.A04.1.454.CMB.1.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttctttttccttgttgcttagttttaaaaggtgtccaatgtgaggtgcaacgtggtggagtcgtgggggaggtcttggtacagccgacgggcccggtccctgacctacctcctcctgcacagtccttccggactccgtaccgtttggtcagcatgctatcgaccggtcgggtcccgccgacggcctaccgggaggggagggtcgtgggaggtgggtcgtttgggttctaagttaaggaacggacggaagtccgttaggtcggggtacggggacaaaccgaacgtaaacgtaccggacccgtcgttacgtaacggtaaaaggacgagtactaccgacgtacccgttacaccgaaggtagtagttacgtaacctaaacgaaagtccacgttaccgacctagttaccgtcgacacgtactacggcgacgtacgtccgtaaggacgtaaggcgtacggtaccgtacgaacgggtcgttacgttaacgtttacgttacgtttaccgtttaatttcccgttagtacggttaacggttaggttaggtttaacg

SEQ ID NO: 271333 - DNA, 768 bp, Homo sapiens
  misc_feature: GYAE6OF02HANG6.25.4.A04.1.454.CMB.1.raw
  modified_base (215)..(215): a, c, t, g, unknown or other
  misc_feature (215)..(215): n is a, c, g, or t
  modified_base (290)..(290): a, c, t, g, unknown or other
  misc_feature (290)..(290): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttctttttccttgttagcttagttttaaaaggtgtaccaatgtgaggtgcaactggtggagtcgngggggaggcttggtacagccaggcccggtcctgacactctcctgcacagtccttccggacttccaccgttttggngagcagtcgacttagtcggtaacccgtcggggtcccgaccgaggggcccttaccggagggggtaacgggttcgtagggtacggttggtccgttttaggggttacctaaagtttaagaaacggccggtaaagtcccgttaagtggggtacggggaaccaaacgtaacgaacttaccgggacccgtcggtttactaagggtaaaaacggccgtaaggtaactttccgaaacgtcccccttacgtacgaaaacggtagtaagtacgttaaacgttaaacccgaaaaaggtcctaacgttacccgtaacttacgtttccgacgtaaccaataacgtgaacgtccaaccggtaccgtagggtaaacgaacgggacggtaaacgggtacctaccggaacggttccggttaagtttaaccgtttaccgtttgttttaaccctttagttacctcggttagtaaggttacggttaagtttttaacgg

SEQ ID NO: 271334 - DNA, 699 bp, Homo sapiens
  misc_feature: GYAE6OF02JYH9G.25.4.A04.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (226)..(226): a, c, t, g, unknown or other
  misc_feature (226)..(226): n is a, c, g, or t
tcagactgtacagtcacgaccggtgctcgatttagagtagtgatcagggggcagaagtctctctcagtcaggacacagcatggacatgagggtccctgctcagctcctgggactcctgctgctcgtggcctcccagataccagatgtgacgtccagatcgacccagtctcatccctcctgtctgctatctgtgganactagatcanctatcacgttcggccgggtnacgtcgagggctagttagactaatttagttacgccgttaggtactacaaacgtaacgaaaccggtagggacgtaacggtttaccctaaaggtccttaccgtaggtacttaccttaacgtcggtaccgttcgtccccctaacgtaccgtttaaccgaccttaccggggtaccggggtaccctacttaccggttcggttacggacgtcggactagtacgacgtcgggtacgacgagtacgtccacttcgactacttacgagtacgacctacggtctacggtcaacgtccgtagtaagactttcggaactaccctttaaaggtttaactttaaccggtatttaaaacgaaaatttaccggtaaacttaccgttcccttacccgtacctttacggtaaccggttaccgggtacggggaacgtaacgggtacggtaggtaccgaaaccgttaacgtaacgggtccgttaaggttcccg

SEQ ID NO: 271335 - DNA, 595 bp, Homo sapiens
  misc_feature: GYAE6OF02GBV4Z.25.4.A04.1.454.CMB.1.raw
tcagactgtacagtcacgaccggtgctcgatttagagtagtgatcagggggggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtctgggggagcttggtacagccaggccggtccctgacactctcctgcacagcttccggactcaccttttggtgagcatgctatcgaccgttggggtcccgccaggcctccgaggggtaacgggtctgggagtggcgtttgggttcagttagaagcgaagcctagtgggtgggacaacgacaataccgaccgcgtctagtaaaaggcagattcagtcctactacaagagatagaacttacgaaaagcaatcgaccttagtctagccaacatgacgtcgacgccgtagaacgtaagccggaagactacgagtcccggttattaacgtttaccgttgtttacctttaattaccttacgtagtaggtagttaggttaggtttatttacttactttaacc

SEQ ID NO: 271336 - DNA, 701 bp, Homo sapiens
  misc_feature: GYAE6OF02HLT1Z.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtccagatcgacccagtcctccatccctccctgtctgcatcgtgtaggagacagaatccagctactccaccgttcggcccgggcgagtcgagggcagttacgactaaatttagttacgcttaggtataccaaacgaacgaaaccgagggagtacgtttacctaacgtccttcgtagacttctatcgctcgccctacctacgttaccacgtcgacgggtccctacgtccgtcggtcgacgtcgcgtaggtacgtacgtcggtacggacgtacgtacgttaccacgtctacctactatacgacgcaccgccttcgactacgtaccgtagtaacgtgttacgtacgtaacccttaagtttactttaacgtaacgttaaacgtaaaacgttaacttaaaccgttccgttaccccgttacccctttaccggttacccggtttaaccggtttaccccggggaaccggggttaaaccggggtaacccggttaaggggtttaaccgggaaataacccgggttaacccgttaaaacgggttacccggttagggtacccggg

SEQ ID NO: 271337 - DNA, 561 bp, Homo sapiens
  misc_feature: GYAE6OF02HV5ZD.25.4.A04.1.454.CMB.1.raw
tcagactgtacagtcacgaccggtgctcgatttagagtagtgatcagggggcagaagtctctctcagtcaggacacagcatggacatgagggtccctgctcagcctcctgggactcctgctgctctggctcccagataccagatgtgacgtccagatgacccagtctccatcctcctgtctgcatctgttggagacagaatcagcatcacttggccgggcgagtcagggcattagcaattattagcctggtatcaacagaaaccagggagagttaccaagactcctgatctatgctgcctccacgttacactcgacggggtacccatctacggttcacggcggacagtagaatcgtagggacagagtttcaacgtctacactatacagcagcctgcagacctgaagtacttgttacgactaaacttattacgtgttaaactaaaagtaaataactactacgtaccccttctaccgttacgtttaccgggaccgggtaacgggtaaccgtaaagggtacggaacggtaacgttaacgtaaaaccggtacgttaggtaacggg

SEQ ID NO: 271338 - DNA, 755 bp, Homo sapiens
  misc_feature: GYAE6OF02JJ4R5.25.4.A04.1.454.CMB.1.raw
  modified_base (271)..(271): a, c, t, g, unknown or other
  misc_feature (271)..(271): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcaccgtgccactggttcctcgtgggtcggcctccatccacgtagtgttactcactacgtggacnccgtggactcccgcagccacccgaggggaacggccgtggaggtcggtgttacgggtaccagtttacgttacgttacccggtggggacgtacctacccgtttaccgtaaacccgtaacccccggttccctaacgtaaacgttacggttaccggtaacgttacccaaccgtaacttcccttaacgtaacgtttaacggaaacccttacggttaccgtaaaaccgaaccctttacggtttaaccccttccccgtttaaaggtaacggtttacgtaaaccgttccgttacggttaccgaaccgttcgggtaccccggaccgggtaacccgacccggggttccggttaacgtttaacttacggtcggttacggtaccgggtactaacgttaccgttaaacggtacttaacgtagggtccggtacacgttacaaccgtaccatccgacgtagtttcgttacgtttgacttcgttaccggagggtaaccgg

SEQ ID NO: 271339 - DNA, 804 bp, Homo sapiens
  misc_feature: GYAE6OF02JPVZQ.25.4.A04.1.454.CMB.1.raw
  modified_base (199)..(199): a, c, t, g, unknown or other
  misc_feature (199)..(199): n is a, c, g, or t
  modified_base (218)..(218): a, c, t, g, unknown or other
  misc_feature (218)..(218): n is a, c, g, or t
tcagactgtacagtcacgaccggtgctcgatttagagtagtgatcagggggcagaagtctctctcagtcaggacacagcatggacatgagggtccctgctcagctccgtgggactcctgctgctcgtggctcccagactaccagatgtgacgtccagatcgacccagtcctccatccctcctgtctgctatctgtgganacagtaactcagcactacncgttcggccgggtacagtccgacgggtctaacgttagacttaagtttacgttaacgtcttaggttactacctaaacgaacggaaaccggaggggtatacgtttaacccaagtccgtaccgtaggtaacttccttaaggtcctacgttccgtaccccgttaaccgtaccggtttaaaccgccgttaccgggtaaccggggttcccctaacggtttcccgtacgggtttacccggacgggtacccggtcgtaaacgggtttacggtaacgttacccggtagggggtaaccctaagggttaccgtttacccgtaacttcccgtttaaaccgacctttaacggcctaagacccttaccggcccgttacggtccaaaccgttccgttaaaggtaacgttcggttaacggttccgtaaacctttaaaccgttaggtttaacccgtaagtttaaaccgaaaaacgttttaacttaacccgttaccgttacccgttacccttaacgttccggttaaacccggttacgggacgggtaaaccggtaacgtagggtaaccgaggtaacctaaacggacccggttaggtcggtaaccg

SEQ ID NO: 271340 - DNA, 747 bp, Homo sapiens
  misc_feature: GYAE6OF02H29TI.25.4.A04.1.454.CMB.1.raw
  modified_base (247)..(247): a, c, t, g, unknown or other
  misc_feature (247)..(247): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggccaggactggtgaacgccttcacagaccctgtccctcacctgcactgtctcgtggtcgctcatcacctagtgttanctactactggagtctggactccgccagccaaccgagggaacggtcctagggagtggtacgttgggtaacacgttacgttaacgttaccggtagggactcccgtacccgtttaccgtaacccgtaaacccccgttccctaacgtaaacgttaccggtacggtaacgttacccaaacctaactttcctaaccgttaacgtttaaacggacccttaaacggtttaaccgttaaaacggtaaaccccttacgttttacccttacccccggttaagtaacggtttacgtaaccttcgttacggttacgacgttccggtacccgacgggaccgtacgggtaccgttacgttaacgttacggttacggttacggccggttaacctaacgttaacctaacggtaacttaacgtacgggttcggtaccgtaacttacgtacctacctacgtaaccgtacgtagttacgttacgttttacgagtttacgttacggtaccgggtaaaccgg

SEQ ID NO: 271341 - DNA, 760 bp, Homo sapiens
  misc_feature: GYAE6OF02JUNUE.25.4.A04.1.454.CMB.1.raw
  modified_base (642)..(642): a, c, t, g, unknown or other
  misc_feature (642)..(642): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtgcagctccagatggtcctgtccaggtgcagctgcaggacgtcgggccaggactggtgaagccttcacacgaccctcgtccctcacctcgccactcgtctcgtcggtcggcctccactccaccgtaggttggttatccgtactacgtggacgtctcgggtactcccggaccgcgacccgaaccccggaacggggggtaaacggggtccccgtacggggtaacggtcgggtaaggttttcgggggtaaccacggttaccgtttaaacggttaacccgggtggggtaccgtcccgttaaaccctttccgtaaacccgtaaccccggttccctaaccgtaacggttacggttaccgaaccgttacccaaaccgttactccgttaacctaacgtttacgaaccgtaaccgttaccaaaacggtacccttacggttacccttacccgtaagtaacgttacgtaccgttaccgtgtacgacgtcggacccggacgtccgcggtacgttcgtaactgttacgccggngtactaactaccgtagtaccgtactacggcggtacctacgtacgtcccaaacgttccgtacgaccggtattacggttccggttttacgaacgtttacgttaccggtcgggtaaaccgg

SEQ ID NO: 271342 - DNA, 626 bp, Homo sapiens
  misc_feature: GYAE6OF02GZEAE.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttggccgggcgagtcgagggcagttagactaatttattagccttaggtatacaacaagaaaccgagggagacgttcctaagctccgtgatctatcgctcgtccctacctacgttaccacgtacggtacgggtccctagttccgtcggttcgaggcggtagtaggtacgaacgtcggagggacgtagtacttcacttctactactacacgacgacctacgccgttacgacgtacgtaccgtagacggtattcggttaacgtaccttaaactttaacgttacttaacgttaaactaaaagttacttaaacttaccgtaccgtaccccttacgttaccggtaacggtttaccgggaacgggtaacgggtaaccgttaagggtacggtacgtaaccgtaacgtaacggtacgtggtaccgg

SEQ ID NO: 271343 - DNA, 641 bp, Homo sapiens
  misc_feature: GYAE6OF02IBL6N.25.4.A04.1.454.CMB.1.raw
  modified_base (165)..(165): a, c, t, g, unknown or other
  misc_feature (165)..(165): n is a, c, g, or t
  modified_base (320)..(320): a, c, t, g, unknown or other
  misc_feature (320)..(320): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggngtcgggcccaggactggtgaagccttcacagaccctgtccctcacctgcactgtctctggtgctcatcacagtgttatcactactggagctggactccgcacgcaacccgagggacgggcctggacgtggagttcggtacagtctagttaccggngggacgcctaccttcctaccaacccgtcctacaagttacgcgacgtacacctatctacattacgactaccgtactaaacgacctagtttcctccgtagtaaacgttcgaacttcgttcggtagtaccttacggcccgacggtaccgaccgggtccgtttagtacgtttaccgtcgggttacggccggtactaacgttaaccgtacgtaactaaccgttaggtaccggtaccgtaacttacgtaccctaacctacgtaccgtaacgtgttacgttaccgttttagtaacgttacggttaccgggttacgggggtaaacccgg

SEQ ID NO: 271344 - DNA, 636 bp, Homo sapiens
  misc_feature: GYAE6OF02I0L05.25.4.A04.1.454.CMB.1.raw
  modified_base (270)..(270): a, c, t, g, unknown or other
  misc_feature (270)..(270): n is a, c, g, or t
  modified_base (594)..(594): a, c, t, g, unknown or other
  misc_feature (594)..(594): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagcctccagatgggtcctgtcccaggtgcagctgcgaggagtcgggccaggactggtgaacgtccttcacacgaccctcgtccctcacctgcacttcgtctcgtggtcgcctccatccaccgtgttgttatccaactcgtggancgtaggactcccgcagccaacccgagggacggcctggagtggagttcggtacagttacgttagttaccggtgggactccgtaccctttacaacctaacccccgttccctaactaacgttacggtccgtacgtccaacctacttctaactattaacggactacggttactaaacgaacctacgttcctacccgtagtaacgttacgtaacttcgtgtacgtaccgtacggccgtaccggactaccggtccgtttatacgtttcgtgtcgcgtactaagtacctagactacgtggtaccgacgtactcgacaccatccgtaacgtntttccgttgtttacgactttacggtacggtacgggtaaccgg

SEQ ID NO: 271345 - DNA, 739 bp, Homo sapiens
  misc_feature: GYAE6OF02FV47A.25.4.A04.1.454.CMB.1.raw
  modified_base (347)..(347): a, c, t, g, unknown or other
  misc_feature (347)..(347): n is a, c, g, or t
  modified_base (680)..(680): a, c, t, g, unknown or other
  misc_feature (680)..(680): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggccaggactggtgaagccttcacagaccctgtccctcacctgctactgtctcgtggtcggcttaccatccaaccaggttgttaactcaactacgtggagctaggactcccgaccagccgaccgagggaacggccgtagggaggtggtagttgggtacatcgttacgtacgtgggacncgtaccttcaccgtaacccgtcctacaagttacgtacgtacgtacaacctagttacctacgtaacgttacgtaacccgtaacgttaacctaaacggtaacccgtaccgttttaccttaccccggtaagtttaacgggttacctaacgttaccgtttagtaccggttaccgtccgggcccggtaacgggtacccgtacccggggttacgtttaacgtttaacgttccgttaacgggtcgggtacccgttaactaaacggtttaaccgtaaagtaacgttaacccggtaggtttccgggaccttaattacccgtactaacccttaaggtaacccncgttaagtttcctttacggttttaacgcgtaaacggtttcccggtacggggtaaccggg

SEQ ID NO: 271346 - DNA, 716 bp, Homo sapiens
  misc_feature: GYAE6OF02HSXGQ.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcactctgttgagacagaatcgagcatcacttcgacgggcagtcagggctaacgttagactaattttaacgttagccgttaggtaataccgaaacaacggaaacccgtaggggactaacgttacctaagccttcctagtattcttaacgtcgtccttcgcccttacccgtaaacgttaccaacccgttaccgggaacgggtttccccaggttaccgtttaccggttaccgaacggtcggtacgtaacggttaggaacgttacggtcggggtaacaagggttaccgtttacctaaccgtcctaccgtaactacgtacgaacgtcgaacgtcctcggacctacggaccctagggaaccgtaggtttcggttaaacctacttaaacccgttttaattaccggttaactaaacgttaaaacgtaaattaacgttaacccgcgttaccccttcgttacccgttaacggttccggggaacggtaaccgggaacgtaagggtacgtaacggtacctaacggtaaaccgaggttccggtaacg

SEQ ID NO: 271347 - DNA, 719 bp, Homo sapiens
  misc_feature: GYAE6OF02FRM8X.25.4.A04.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtagacgtccagactgacccagtctccatcctcctgtctgcatcttgtaggaanacagaatcagcatcattcggaccggtnagtcgaggacaagttagactaattagtttacgccgttaggtactacaacgtaacgaaaccgtaaggggagtaacgttaccttaaaacggccttaccgtacgtattaccgtaagtcgtccgtacgtacccttaaccctaacggtttaaacctacggtacgaacgggggttccccaacgtttccggtacggtacgtacggcggacgtacggtacgtaaacgtcgttaacgggaacgtaaggttaccttacgtaactacctactaacgtttaacgacgtacgacacgtccgtacgcgttacgtaccgtaagtaactaggttaggttaactaacttaaacctttaagttacctaacggttaaaccgtaaaagtaaacttaacgtaaccctaccgttaccccttattaaccggttaaccgttagggtaaccgggtaacggtaacggtaacggtacggtaaaccgtaactaacccggtaaaacgttaacgttccggtaagg

SEQ ID NO: 271348 - DNA, 709 bp, Homo sapiens
  misc_feature: GYAE6OF02H7KWT.25.4.A04.1.454.CMB.1.raw
  modified_base (169)..(169): a, c, t, g, unknown or other
  misc_feature (169)..(169): n is a, c, g, or t
  modified_base (230)..(230): a, c, t, g, unknown or other
  misc_feature (230)..(230): n is a, c, g, or t
  modified_base (399)..(399): a, c, t, g, unknown or other
  misc_feature (399)..(399): n is a, c, g, or t
tcagactgtacagtcacgaccggtgctcgatttagagtagtgatcagggggggagaggagccccagccgtgagattcccaggagtctccacttggtgatcgagcactgaacacagaccacaaccatggagtttggacttaactgtcttttcctgtgctagttttaaagngtccaatgtgaggtgcaactggtgagtctgggggagctttgggacagcaggccgtcccganactctctagcacacgcttccggactctacctttggtgagcaatgctatgacctggtccgcagctcagggaggtcgtggagtggcgtttggtacagttacgaagcgtaagccgtagtgggtagggctaacgacgaacgtacgccgtgtacgtaagtaaaacggcaaagtnttacgacggtacccttgtacgaaaggtacgtaagtggtaacctttaccgaaaagtccaaagtttccgaccgtttaaagtccgttacgaaccgtaaccgtaagtcggaaacggtccgtaaacggtaacccgttacggtaaaaccggacgaccgggtaaaccggtaacgttacccggaaaccgggttccgtttaacggttactttacggttaacggttttctttaaacgtttccgttacgtacgtaacgggttaacgtttaaccggtttaggtttaaaccgtttaaacgttttaccgtaacttttaaaccgg

SEQ ID NO: 271349 - DNA, 771 bp, Homo sapiens
  misc_feature: GYAE6OF02IDIBC.25.4.A04.1.454.CMB.1.raw
  modified_base (223)..(223): a, c, t, g, unknown or other
  misc_feature (223)..(223): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatccctcctgtctgcatctgttggagacagaactcagcatcacttcggccgggngagtcgagggcatttagctaatttacttagccgttaggtactacaacgaacgaaacgagggtatacggtttacctaagccttccgtagaacttcttatcgtctacgcccttaccgtaacgttaccaacgtcggaacggtccctagttcgtcggttacacggcgactagtcgtaagtcgtacgggaacaggtacttaccgacttctacgtaacttactaccagtaccgtacgtacccgtacggtacccgaaggtaccccttaagggaaacgtttacggttaggtttaccggttaaaccttaaacccggtttttaagtttaaaccccggtttagttaaaaaccgttaaaaaacggtttaaccttaaacgtttaaccgtacccggttttacccccttacgtttaaccccggtttaacccgggttttaaccggggggaacccgggtaaaccccgggggttaaacccggaaaaggggggttttccgggaaaaacgttaacccgggtttaaacccggaaaaaccggggtttacccggttagggttaacccgggg

SEQ ID NO: 271350 - DNA, 699 bp, Homo sapiens
  misc_feature: GYAE6OF02G268K.25.4.A04.1.454.CMB.1.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (440)..(440): a, c, t, g, unknown or other
  misc_feature (440)..(440): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagactaccagatgtgacgtccagatcgacccagtcctccatccctccctgtctgctatctgttaggacacagaactnacgcatctacgttcggaccgggngacgtcgagggctagttagactaatttacttacgccttaggtatacaaacgaacgtaaaaccgaggggtacgtacgtttaccaagtccgtcctacgtacttctagtacgccgtacgtccccgtaacccttacggttacccacggttaccgggaccggggtttaccccagttcccggtttacggttcgacgggtccgacgtacggtaanacgttcgagggtaactacggtacgttacctacgttcctactactagacgaacgtccacgtcctagaccgtaccgagtaacggtacgtagttacgtacgtaccttaactttacgttaacgtacttaaacgttaaagttaacgttaaacctaccgttccctacccttactaccggttaacgggttaccggaggggtaaccggtaacggtaagttacgggtaacgtaacggtaaccggtaaacggtccgttaggtaacccgg

SEQ ID NO: 271351 - DNA, 545 bp, Homo sapiens
  misc_feature: GYAE6OF02F4Y87.25.4.A04.1.454.CMB.1.raw
  modified_base (274)..(274): a, c, t, g, unknown or other
  misc_feature (274)..(274): n is a, c, g, or t
  modified_base (439)..(439): a, c, t, g, unknown or other
  misc_feature (439)..(439): n is a, c, g, or t
tcagactgtacagtcacgaccggtgctcgatttagagtagtgatcaggggggggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccgtccctgacactctcctgcacagccttccggactcaccttttggngagcatgctatgaccctgggtccgccagctccgagggaggtctggagtggcttgggtcattagagcgaagcctagtggtgggacaacacaatacggccgcgtctaaggtaaaacggcaagtattcagtcctctacaagagatgattacaaagcactcgcctatcngcacatgagcacgcctgagacgcggaagcgtacgacgtccgtgtacttacgttcgttacttacttactcgtagtagtacgttagttaggtttattacttacttaac

SEQ ID NO: 271352 - DNA, 721 bp, Homo sapiens
  misc_feature: GYAE6OF02F8M6Y.25.4.A04.1.454.CMB.1.raw
  modified_base (180)..(180): a, c, t, g, unknown or other
  misc_feature (180)..(180): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttagttttaaaaggntaccaatgtgaggtgacaactggtggacgtcgtggggggagtcgttaggtacagccaggcccgtccctgacactctcctgcacgagccttccggactcctaccgtttggtgagcatcgactatcgacccgtgggtcccgccgaggcctaccggaaggggtaacggttcgtagggaggttcggtcggtttcgggttacaagttaaggaacgacggtaaacgtccgtaaggtcggggtacgggaacaaacccgaactaaacgtaccgccgtaccgttacgtaaggtaaaaaccgggcaagtacttaccgacgtaccttacgtaacgaacgtagtaacgttacggtaacttaaacccgaaaacgtcctaacgttacccgtaaccttaactcctacggacaaccgtaagacgtaacgcaacgtccgtaaggtaacgaacgggtacgacggtaccgttacggacgttcccgttaaggtttaacttaaccgtttacgtttactttaacgttacttccgtaaggttacggtaaggtttagtttaacgg

SEQ ID NO: 271353 - DNA, 841 bp, Homo sapiens
  misc_feature: GYAE6OF02GD5IS.25.4.A04.1.454.CMB.1.raw
  modified_base (502)..(502): a, c, t, g, unknown or other
  misc_feature (502)..(502): n is a, c, g, or t
  modified_base (538)..(538): a, c, t, g, unknown or other
  misc_feature (538)..(538): n is a, c, g, or t
tcagactgtacagtcacgaccggtgctcgatttagagtagtgatcagggggagctctgggagaggagccccagccgtgagattcccaggagtctccacttggtgatcagcactgaacacagaccaccaaccatggagttgggcttaactgttcttttcttgttgcttagttttaaaggtgtaccaatgtgagtgactagtggtggagtcgtggggggagtcgttgggtacacggaccgacgggtcccggttccctggacctaccttcctcccgtgacccacgacgtccgttacccggacttaccgttaccgttttgggagaacggtcaacgttgtcttaacgtacggtacccggttccggggtccccggaccggtacgggtccttaccggggaagggggtaagggtcggttaggggtacggttgggttcggttttagggttacttaagttaacggacggtaacggacgtccgtaggtcggggtacggggaacaaaccgtaanaaccgtaccggaccgtcgtacggtaaagtaaacggntaggtacttaccgacgtcctactacgaaagtacgtagttacgaaccgttaaacgaaacggtcctaccgttaccctaccgttactcccgtaacgtacctaaacggtcgttaacggacccgaaccgtaccccggttagaaacccggtaaaggggaacccgggaacggtaaacccggtcgtaccgaaccgggttccgttttaaacgtttacccgtttaacggtttttacgttttaaccttttaacggtttaacccgtttgggttaaccggtaaggggtttaacggtttaggttttttaaacccggg

SEQ ID NO: 271354 - DNA, 675 bp, Homo sapiens
  misc_feature: GYAE6OF02GRY3E.25.4.A04.1.454.CMB.1.raw
  modified_base (256)..(256): a, c, t, g, unknown or other
  misc_feature (256)..(256): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctcgtggtgctccatcaccagtgttatcactatgganctggatcccgccagccacccgagggacggccgtggagtggagttgggtacatctagtacggtagggacgctaccttctaacccgaaccccggttccctacgtaacgtacgtacgacgtacctaacctagtccgtactaacttacgacctaacgtactaaacgtaccctacgtttccctacccgtagtaacgttcgaaacgttcgttacgtacgtaccgtcgacccggcggtaaccgtaccgggtccgttagttacgttaccgttggtacggtaccggtactaacgttaaccgtaaccgtaccttaaacgttaggtttaccggcccgtaagtttaccgaacccgtaacctacgtcccgtaaacggtcgtttacggttcgtttttaagacctttaacggttccgggtacggggtaacccgg

SEQ ID NO: 271355 - DNA, 631 bp, Homo sapiens
  misc_feature: GYAE6OF02JHHH7.25.4.A04.1.454.CMB.1.raw
  modified_base (257)..(257): a, c, t, g, unknown or other
  misc_feature (257)..(257): n is a, c, g, or t
tcagactgtacagtcacgaccggtgctcgatttagagtagtgatcagggggagctctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtcgtggggggagcttggtacagccagggccggtcctgacactctcctgcacngccttccggactctaccgtttggtgagcatgctatgaccgtgggtcccgccacggctccggaaggggaacgggtcgtgggagtgggtcgtttgggttcagttagaagcgaacgccgtagtgggtggggacaaacgacgaataccggccgtcgtaccgtaggtaaaacggcgaagtacttacgacgtccctacgtacaaagacgtatagtaacttaccgaaaagcctaagtccgtaccttatcctacgaccaactagtcgaacgcgaaccgccgtaaggaagaacggcgaacggtctacgacggtccgttagttaacgtttacgttcgttttacttacgtttactacgttaggtaagtacggttaggtttaacgg

SEQ ID NO: 271356 - DNA, 876 bp, Homo sapiens
  misc_feature: GYAE6OF02FZW09.25.4.A04.1.454.CMB.1.raw
  modified_base (226)..(226): a, c, t, g, unknown or other
  misc_feature (226)..(226): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccatccctcctgtctgcatctgttggagacagaatcagctatctacgttggccggganacgtcgagggcaagttagacctaagtttactttacgccttagggtaacttacaaacgaacggtaaaacccgagggggtaacgtaacgtttacccgtaaaggccttacccgtaggtaacttcgttaagtcggtaccttacgtcccttaccgtaaccgttaccaccgtacgggtaaccggggttacccctacgttccgtacgggtttaccgacggtacccgggtacgtaacggttacggtaacgttaccggtacggggaactaaccggttacgttacccgtaccttaccgttaactaaccgttaaccgttaccgaacggtacccgtaacccggtccgttacgggaacccgtaccgtaacccggttaggtaaacggtaacggttttaacgtaccggttaaaccgttaaacgttttttaccgtttaaaccgttaacgtttaaaccgtaaaaaacgttttaacgttaaaaccggttacccgttacccggttaccccctttaccggttttaacccggttaaaccccgggttttaccggggaaccccggggggtttaaacccggggtaaaccgggttaacgggggttaccgggtaaacggttaaacccgtaaaccgggttaaaacccgggttacgttaaccgggtttaaccccgggg

SEQ ID NO: 271357 - DNA, 713 bp, Homo sapiens
  misc_feature: GYAE6OF02ILP4S.25.4.A04.1.454.CMB.1.raw
  modified_base (670)..(670): a, c, t, g, unknown or other
  misc_feature (670)..(670): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgacgaggagtcgggcccaggactggtgaagccttcacagaccctgtccctcacctgccacttgtcctctgggtcgctccatcaccgagttggttatcactacgtggacgtcgtaggactcccgccagccgaaccccggaaggggaacgggcccgttgggaggttacgggtagttcggggtaactacgttaccgttaagttacccgggtggggacgtacctaacccgtttcgtaacccaaaccccggttccctaacgtaaacgttacggtaccgtaacgtccaacctacttccgtactaaacgtacgtaaccaacgttactaaacgtaaccctaagtttccctacccgtaggtaacgttgaaccttcgtagtagaccttcgggacccgaccggaaccgtaccgggtacgttagttacgtttacgtggtcgtacggacttaacgtaccgttacgaattaaccggtaagtaccgggacctaagttacgtccgaacctacgttaccgtaacggtnttacggttacttttagaacttgtttaccgggagggaaacccgg

SEQ ID NO: 271358 - DNA, 748 bp, Homo sapiens
  misc_feature: GYAE6OF02FUU55.25.4.A04.1.454.CMB.1.raw
tcagactgtacagtcacgaccggtgctcgatttagagtagtgatcagggggcagaagtctctctcagtcagacacagcatggacatgagggtccctgctcagctcctgggactcctgctgctctggctcccagataccagtatgtgacgtccagatgacccagtctcctactcctccctgtctgctatctgttggacgaacagaatcagctatctacgttcggaccgggacaaggtcgaggctaattagactaattacgttacgccgtagtactaacaacgaacgaaaccggaggacgtacgttactacgtctacgtgtactcgttagtctctcgccccttacaccgttaacgacgttaccggacgggtaccctacgtccgttaccggttacgacggtaccgacgtaacggttacgtaacgttccgggtaaggtaaccgtaacggttaaccggtacttaacccttaccgtaacccgtaaacttaaccgttaacggtacgacccgtacgtaacccgttcgaccgttaaccgaccgttaacggtaacggtaaccgttaggttaaccttacgtttaaacctttaagttaacgttaaacgttaaaccgtaaaaaagtttacctaaaacgttaacccgttcccttaccccgttataccccggtttacggttaacccgggaacgggttaaccggtaaacggtaacgggtaacgtaccggtaaaccgtaacccgaaacggtaccttacgggtacg

SEQ ID NO: 271359 - DNA, 580 bp, Homo sapiens
  misc_feature: GYAE6OF02GLM18.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagttggttatcactactggagctggactcccgcacgccaccgagggacggcctgggagtggagttcgggtaacacttcgtaagttaccgggtgggacgtctaccttctaaccaccccgtctacaatacgtcgacgtcacgactctacattacgacctacgtactaacgaacctacgttactccccgttagtagttacgtaactctagtcacgtcgccgcggacgacggtccgttgttaacgttctaggtcgcggactatacctacgacttacgtaggtcgaccgtattacgtccacctactaccgagttctgttctttgacttcgttcggcggggtaaccgg

SEQ ID NO: 271360 - DNA, 694 bp, Homo sapiens
  misc_feature: GYAE6OF02FQ3HT.25.4.A04.1.454.CMB.1.raw
tcagactgtacagtcacgaccggtgctcgatttagagtagtgatcaggggggggagaggagccccagccgtgagattcccaggagtctccacttggtgatcagcactgaacacagaccaccaaccatggagtttgggcttaactgtctttttccttgttgcttgttttaaaaggtgtccaatgtgaggtgcaactggtggagtcgtgggggagcttggtacagccaggccggtccccgacactctcctgcacagcttccggactcacctttggtgagcatcgctatcgaccgtgggtcccgccgaggtcctaccgagggggtaacgggtcgtagggaggttggccgtttgggggttcctaagttaacgaaacggacgaacgtcccttaaggtggggtaggggacctaaacgaacgtaaacgtaccgccgtcgttacgtaaggtaaaaacgggtcaagtacttccgaagcccttcgtacaaaggagtacgtagtaacttaccgaaaagtcaactcgtacccttattctacgctaacgagtcgagcacgacctaggaacgaaggtccgtaaagggtaccacggtacgtaccggttagttactttacgttagttttaaccttaatttacgttcgtaggtaacgttaggtttaaggtttacggtttaaattttaaccgtttaaccttaactttaaacg

SEQ ID NO: 271361 - DNA, 707 bp, Homo sapiens
  misc_feature: GYAE6OF02GM86M.25.4.A04.1.454.CMB.1.raw
  modified_base (180)..(180): a, c, t, g, unknown or other
  misc_feature (180)..(180): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctccagatgggtcctgtccaggtgcagctgcaggagtcgggccaggactggngagccttcacacgaccctcgtccctcacctgcactgtctcgtggtcgactcatccacgagttgttatcactgtggagtcgtggactccgcacgccgaaccggtaggggaacggtccgtggacggtggtacgttggaactgttactacggtaccgggtggactcttacccttactaacctaacccgttccaataaacgtcggtacgacgtccaacgtattcctacgtaacttacggaacctacgttaacgtaaacgtaaccgtacttacgtacccgttaaggtacgttacgtaaccttcgtacgtacgtaccgttacggcccggtacggtaccgtaccgggtccgtttagttacgttacggtcggtacgtcggtaactaacgttaacgtacgttacgttaacgtacggtccggtactaccggtttaacaccgtaaccgttaacgtaccgtaaaccggttacgtttaccgtttttacgtttttaacggaccggttttaccggggtacccgggtaacggtaaaaccgggg

SEQ ID NO: 271362 - DNA, 672 bp, Homo sapiens
  misc_feature: GYAE6OF02FZOKJ.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccatccctccctgtctgcatctgttggagacagagtcaccatccacgttggccgggcgagtcgagggctagttaggaaatttgttcggccttggtactcgagcaacggaaaccgacgggtaaactttcccgtaaacctcctactatctatcgctgctacgtccttactttgacttaaggtttccgggtccctctacgtacttcgaggtccggcgtagggttcggggtcgtcgggaataacgttaacttcctaccttactacaacccgatacgtacgctacgcccttacgacctacggtaccgtaacgaagttacgttacgggttactaaccttaaacgttttaacttaccgttaagttaaaccgttaaaatttcgaacgttacggtccggtaaccggttgtacgttccgggtaccggtacccggtaacgggacccgtaaggggttacgaaccgtaacttaacccggaaacggttaccgtagggtccggtacgttacccggaacc

SEQ ID NO: 271363 - DNA, 648 bp, Homo sapiens
  misc_feature: GYAE6OF02JZX2S.25.4.A04.1.454.CMB.1.raw
  modified_base (197)..(197): a, c, t, g, unknown or other
  misc_feature (197)..(197): n is a, c, g, or t
  modified_base (570)..(570): a, c, t, g, unknown or other
  misc_feature (570)..(570): n is a, c, g, or t
tcagactgtacagtcacgaccggtgctcgatttagagtagtgatcaggggcgagaagtcgtctctcagtcaggacacagcatggacatgagggtccctgctcagctcctgggactcctgctgctctggctcctagataccagtatggtgacgtcccagacgtcgacccgagtcctccacttccctcctgtctgactntctgttggagacacgaatcacgcatacacgttcgacggggtcagtccgagggtcagttagacagttattacgcctaggtatcaacagaaaccgaggagtactacgtaagcttccgagtacgtacgtatcgtctcgacctccgacgtttacacttacggaaccgggtccctcggttacctttcggtacgcgtcgtacgacgtacgtaacgtcggtggtaacccgtaggtacgtactaccgttactacccgttaatacgttaccgacggaccttaacggaccgttcgttaccgacggttcccgtaagtacgtaccgttaggtcgttaacctacgtttaactacggttacttaaccgaaattaacgttacttaacncgtccctagtccttaaccggttgacgttaacgggtaccaaggttgacggtaaccctagaaccgttccggtagtaccgg

SEQ ID NO: 271364 - DNA, 701 bp, Homo sapiens
  misc_feature: GYAE6OF02JJJPW.25.4.A04.1.454.CMB.1.raw
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (377)..(377): a, c, t, g, unknown or other
  misc_feature (377)..(377): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctccagatgggtcctgtcccaggtgcagctgcaggagtccgggcccaggactggtagaacgtccttcaacgacgaccctgtcccctacacctgccactgtctcgtggtcgcctccatcaccagttgttacncaactcgtggancgtggactccgacagccaacccggagggacggcctggagtgagttggaactatcgttaagtaccgggtggactcctaaccttccgtaaccgaaccccgttcctaanaacgttcgacgacgtccacctatctacaattacggaacctacgttacaaacgtaaccctaggttcctacccgtagtaaacgtttacgtaaccttcgtacggttacgaacgttcggacccggtaccggtaaccggaccgggttacccgttagtttaaccgtttacggtaggttaccgggtaccgttaactaacgtttaaccgtaacgttaaacgttaccgtaacgggttacggacccttaagtaacccgtcctaaaccgtcttaaccgacgtaagtttccgttacttttacggacgtttaaccgttcgggtaacgggtaacccgg

SEQ ID NO: 271365 - DNA, 745 bp, Homo sapiens
  misc_feature: GYAE6OF02I20V1.25.4.A04.1.454.CMB.1.raw
  modified_base (146)..(146): a, c, t, g, unknown or other
  misc_feature (146)..(146): n is a, c, g, or t
  modified_base (183)..(183): a, c, t, g, unknown or other
  misc_feature (183)..(183): n is a, c, g, or t
  modified_base (207)..(207): a, c, t, g, unknown or other
  misc_feature (207)..(207): n is a, c, g, or t
tcagactgtacagtcacgaccggtgctcgatttagagtagtgatcagggggcagaagtctctctcagtcaggacacagcatggacatgagggtccctgctcagctccgtgggactcctgctcgctcgtggcctcccagataccagntgtcgacgtcagatcgaccagtctctactccttcccngtctgctatcgttgttggacgtanagtaactcagaccatccgtacttcgggcccggtgacgtcgaggcctagttacgctaattttacgttagccgttaggtaactaccaacgaacgtaaccgagggtacgtacgtacgtagccttcgtactactctagtcggtctaccgccgttaaccctacgttaccgaccggttccgaacggggttacccttaacgttcccggtttaccgggttacaacgggaccggtacgtaacgtacgtaccggttacgggttccggtaaacgttacggttcccgttactacccgttcctaaaccgtaccttaacgggtccacccggtacccgtacggtccgttcggaaaccgtccggtacgttaaactacgggtacttacgttaccgtaccttaaacctttttagttaaaccggttaggttaaaaccttaaagttccctaaacgttaccctcccgtttactacccggtaacgttccggtacccgggtaagggtacggtaccgtaaggttcccgaagtaacccgttaacggacgttacgtacccggtg

SEQ ID NO: 271366 - DNA, 674 bp, Homo sapiens
  misc_feature: GYAE6OF02H1QBY.25.4.A04.1.454.CMB.1.raw
  modified_base (195)..(195): a, c, t, g, unknown or other
  misc_feature (195)..(195): n is a, c, g, or t
tcagactgtacagtcacgaccggtgctcgatttagagtagtgatcagggggcagaagtctctctcagtcaggacacagcatggacatggagggtcccctgctcagctccgtgggactcctgctgctcgtggcctcccagactaccagatgtcgacgtccagatcgacccagtcctccactccctcctgtctgacntcgtgttggagacagtaatcagacatcctacgttcggccgggtacgaggtacacggggtactattacggtacttaaaagttttcgtttaacgccgttaggttaactaccgaaaacgaacggaaaaccggtaggggtacgttaaccggtttacctaaacggtcccttaccgtaggtaactttccgtttaagcgttccgtaccgtccccgttaacccgtagttacccacgccggtaccggttccagttccgtacggtacgacggcgtactaaggtaccgacgttcgggtacgggtacaacggtcgtacctactacgtacacgttacacgtacgcacgtccgtacgcgagtccgtagacgtagtgtactacttacgttatacgtagtaaactaagtaataacgtctcccgacttaccgttaccgtaccggtacggtacggtacgtaacgtggtaaccgtgtacaacgtaacgtgtcgtacgg

SEQ ID NO: 271367 - DNA, 719 bp, Homo sapiens
  misc_feature: GYAE6OF02JZZ0W.25.4.A04.1.454.CMB.1.raw
  modified_base (540)..(540): a, c, t, g, unknown or other
  misc_feature (540)..(540): n is a, c, g, or t
tcagactgtacagtcacgaccggtgctcgatttagagtagtgatcaggggcagaagtctctctcagtcaggacacagcatggacatgagggtccctgctcagctcctgggactcctgctgctctggcctcccagataccagactgtgacgtccagatcgaccagtctccatccctcctgtctgccagttcgtgtgagacagactcagcatctacgttcggaccgggcgtagtacgacgggtactagttacgaactagtttattaacgccttaggtactacgaacgtaacgaaaccgtagggtacgtacgttaccgtaacggtccttaccgtagacgttacttaacggtccgacgttaccggtaccccttaccgtaaccggtttaaccaccggttaacccgacccggggttacttaaccgtttccggtttaccggtacgtaaccgggtaccgtagttacggtaacgtaacgtcgggtaacggtacgtaacggttacttaccgtaccttcctacgtaactacgtaccgaacggtctacccgngttaccgactacggctaggtacgtagttcgtactacgttaacttagttaacgtacgttaaactaagttaaccgtacttacccgtacgtacccgttcgtttaaccggtcggttaccggtaacgggtacgtaaccggttaaggtacggtaacctaaccgagtaaaccgtcgtaggtaccgg

SEQ ID NO: 271368 - DNA, 782 bp, Homo sapiens
  misc_feature: GYAE6OF02HJC69.25.4.A04.1.454.CMB.1.raw
tcagactgtacagtcacgaccggtgctcgatttagagtagtgatcaggggagctctgggagaggagccccagccgtgagattccccaggagtctccacttggtgatcagcactgaacacagaccaccaaccatggagtttgggcttaactgtcttttccttgttgcttagttttaaaggtgtccaatgtgaggtgcaacgtggtggagtcgtgggggaggcgttgggtacagccgacgggtccccgggtcccctggacctacctccgtcctgccaccacgtccgttcccggacctccgtaacccttttgggtgaggcatgtcctatcgaccgtgggtccccgccgacggcctaccggaggggaacgggtcgtgggtaggtcgggtcgtttgggttactaagttaaggaacggaccgtaacgtcccgtaggttacggggttagggggacctaaaccgaacctaaagttaccggacccgggaccggttacgtaacggtaaaaacgggacgaacggtaacttcgaacgtacccctcgtaaccgaacggtaagaacgtaacgttaacgttaaacccgaaaaaggttaccaacgttcccgtacccggttaactccggtagaaccctaccgaagttacggaacgtccgaacggtacccggtacgggaacgtaaaggcccgggtaacggccggtaacgtaccggtcccggttaaggttactttaaccgttacggttttacttaaccgtttacgttcgtaacggtaacggttacggtttaggtttaacgg

SEQ ID NO: 271369 - DNA, 539 bp, Homo sapiens
  misc_feature: GYAE6OF02F3CU6.25.4.A04.1.454.CMB.1.raw
  modified_base (398)..(398): a, c, t, g, unknown or other
  misc_feature (398)..(398): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcgagggcattagcaattatttagcctggtatcaacagaaaccagggagtagttcctaagctcctgatctatgctcgcctccacgttacactcgacgggtccatctcggttcagcgacagtgatcgtaggacagtagttcactctacactatcagcacgctgcacgcctagaatnttgttacgacttaactttattactagtaaacaaaagttattaaactaccgttcctacccttacgtaccgttaccggttacgggaccggtaacggtaccgtaagggtacggacgtaacgtaaccgaacgtacgtagtaccgg

SEQ ID NO: 271370 - DNA, 664 bp, Homo sapiens
  misc_feature: GYAE6OF02FG7RC.25.4.A04.1.454.CMB.1.raw
  modified_base (192)..(192): a, c, t, g, unknown or other
  misc_feature (192)..(192): n is a, c, g, or t
  modified_base (244)..(244): a, c, t, g, unknown or other
  misc_feature (244)..(244): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttnacagaccctgtccctcacctgcactgtctctggtgctcatccacagtgttancactactggagctggactcccgcagccacccgaggggaacggccgtggagtggagttcgggtaacagttcgtagttaccggtaggggactacctaccgttacgtacctaaccccgtcctacaacgttacgtccggaagtccaacctatccgtactaagtacgacctacgttactaaacgtaacctacgtttacctacccgtagtaacgttgtaaccttcgtcgtacgaccgtacggccgtaccgggtacctaccgggtcgttaggtttaacttaccggttggcgtaccggtactaacgttaccgtaacgtaacgttacgttacggtccggtaccagttaccgtaaccaaccgtaacgttccgaacggttattcggtcccgtttttaagaccggtttacttccgggttacggggaaacccg

SEQ ID NO: 271371 - DNA, 846 bp, Homo sapiens
  misc_feature: GYAE6OF02F58A4.25.4.A04.1.454.CMB.1.raw
tcagactgtacagtcacgaccggtgctcgatttagagtagtgatcagggggcagaagtctctctcagtcaggacacagcatggacatgagggtccctgctcagctctggactcctgctgctctggctccagataccagatgtgaccgtccagatcgacccagtcctccactccctccctgtctgctatctggttggagaacagaactcagcactccgtacgttcgggcccggggacgtacggtacggacgggtactaagttaacgtacttaaattttacgtttacgtccgttaggttaactacaaacgaaacggaaaccggaagggacgttacgttaccgtaacgtcctacgtagtactcttacgtcgtccctcgtaccccttacgtaaccgttaacctccgttaccggtaccggggttaccctacggttcccggtttaccggttacggaccgggtacggtacggtaacggttacggtaaccggttcgggtaacgggtaactaacggtttaaccgttaccctaccttaccgttaactaaccgttacgtaccgaccgtaccgtacccgtaccggttaccgtaccggtacggttacccgtaaaggtaaccgtttagttacggttaccgttaaaccgtttaacgttttaaaccgtttaaccgtaacggtttaaaaacttaaaactttaacctttaaccgttacccggtttccccttaaccccttcggtttaaacccgggttacccgggttaaccgggggaaacccggggttaacccggtaaacgggttaacggtacgggtaaacccgttacggtaaaacccggtaacggttcgggttacggtaacccgg

SEQ ID NO: 271372 - DNA, 749 bp, Homo sapiens
  misc_feature: GYAE6OF02JDP6G.25.4.A04.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaactnagcatcacttggaccgggcgagtcgagggcagttagactaactttatttacgcctaggtacttaccgaaacaaggaaaccgtaggggtaagtacgtttacctaaggtaccttccgtagaactttaccgttaagtcgttccgtcgacccctttacccgtaacgtttaaccgaccgtttcggaaccgggggtttccctaacgttccggtttacgggtttacccgaaagggtccgggtaaccgtaaggttacgaaaccgttcggttaacgggggaacctaacgggtacttttacgaacctacccgttactacttaacgtccgaagttccgtaacgccttaggcctaaacggtccttaaacggaaggttcttagttaccggtaaccttaacgttttaacttacgttaacgttaaaccgtaaaaagttactttaaacgttaccgttccccgtaccttaacgggttacttaacccgtttaccgggggacgtaaccggggaaccgtaagggtacgaacgttaactaccggtaaaacgttacggtcggtaacgg

SEQ ID NO: 271373 - DNA, 804 bp, Homo sapiens
  misc_feature: GYAE6OF02IIO77.25.4.A04.1.454.CMB.1.raw
  modified_base (76)..(76): a, c, t, g, unknown or other
  misc_feature (76)..(76): n is a, c, g, or t
  modified_base (164)..(164): a, c, t, g, unknown or other
  misc_feature (164)..(164): n is a, c, g, or t
tcagactgtacagtcacgaccggtgctcgatttagagtagtgatcgagggggcagaagtctctctcagtcaggacncagcatggacatggagggtccctgctcagctcctgggactcctgctgctctggctcccagataccagatgtgacgtccagatgacccngtctccatcctcctgtctgcactcgtgttggagacagaatcacgactatcgtacgttcggcgggcgacggtacgagggactaaggttacgacttaactttattacgccttaggtactacgaaaccaaggaaaacccgaggggtaacgtaacgtttaccgtaaagtccgtaccgttaagacttacctacgtagtaccgttcgtaccccttactaaccggttaacctaccgttaccggtacccggggttaccctaggttacccggtttacgggtttaccgaagggtcccggtaaccggttaagggttaccggtaaaccgttacgggtaccgggtaaacgttaaccgggtttaggtttaccctaaccgggtttaccctaacccggttaaacttaccgtaacgtaaccggtccgtaaccgtccgttaccggtaccgtacggacccgttaagggaacgtacgtttacggtaaccgttaaccgttaaaccgtttacggtttaacttacggttaaaccgttaaaacgtaacggtttaaacctacccgttaccttacccccgtatttacccggtcggttttacccgggacggtaacgggtaaccgtagggtacgtaacgaaccggtaacgaaacgtcggtagtaccgg

SEQ ID NO: 271374 - DNA, 574 bp, Homo sapiens
  misc_feature: GYAE6OF02H2YBT.25.4.A04.1.454.CMB.1.raw
  modified_base (262)..(262): a, c, t, g, unknown or other
  misc_feature (262)..(262): n is a, c, g, or t
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagacccctgtcccctcacctgcactgtctctggtcggctccatcgaccagtggtatcactacgtggancgtggactccgccagccaccgagggaagggcctggagtggattgggtacntcgtacgttacgngggacnctaccttcacgacccgtcctanaatgtcgagtcactntctcattagacctacgtcaaagtacctacttcctaccctagtaagttcaactctgtacgaccgtggaccgacggaccacgggtcctagttaattcgtgtcgacggtcacgttacttaacgatacgttaggcgtcgacttagtccaaccgtactcgtaacgtaagttcgttaacgttttgaagttacgtacggtacgggtaacccgg

SEQ ID NO: 271375 - DNA, 822 bp, Homo sapiens
  misc_feature: GYAE6OF02JIG2K.25.4.A04.1.454.CMB.1.raw
  modified_base (209)..(209): a, c, t, g, unknown or other
  misc_feature (209)..(209): n is a, c, g, or t
tcagactgtacagtcacgaccggtgctcgatttagagtagtgatcagggggcagaagtctctctcagtcaggacacagcatggacatgagggtccctgctcagctcctgggactcctgctgctcgtggcctcccagataccagatgtagacgtccagatcgacccagtctaccactccctccctgtcctcgacatcgttggttacgganacgaagtaactcagctactacctacgttcggcccggggacggtaagttcgacgggtactaagttaacgacttaagttttaacgttacgtccgttaggtaactaacgaaacgaacgtaaaaccggagggtaacgtacgttacccgtaaagtccgttacctagtacttacgtatcggtcctccgtacctacccgtacttaaccgtacgtacggtaccggggttacctagttccgttacggttaccgacggtcggtaccgtaggtacgtaaacgtttcgggacgggtaacgtaacggttacgttaccgtaaccttctacgttacctacgtaccgacgtacccgacggttcccgttacgaacccgttacggtacccgtaaggtaacgtagttacgggttactaaccgttaaaccgttttaacgtttaacggttaacgttaaaacgttaaaagtttaacgttaaacccgttaaccgtttcccgttacccccgtttacgggtaccccttaacggggttttacccggaaccgggggttaacccggttaaacgggtaacgggttaaccggttaaccggaaccgttaaccggtaaacccgttacgggttacccggtaacggg

SEQ ID NO: 271376 - DNA, 680 bp, Homo sapiens
  misc_feature: GYAE6OF02HPC2E.25.4.A04.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
  modified_base (262)..(262): a, c, t, g, unknown or other
  misc_feature (262)..(262): n is a, c, g, or t
  modified_base (462)..(462): a, c, t, g, unknown or other
  misc_feature (462)..(462): n is a, c, g, or t
tcagactgtacagtcacgaccggtgctcgatttagagtagtgatcagggggcagaagtctctctcagtcaggacacagcatggacatgagggtccctgctcagctcctgggactctgctgctctggctcccagctatcagatgtggcatccagatcgacccagtctccatccctcctgtctgcatctgttganacagngtacaccatcacttggccggngagtcgagggctaagttaggtaaagtttattcggcgttggtancgtagaccaaggaaaccgaaggggtaaactttaccctaaccgtcctactactactatcgcttgactacctcttactttgacgttaacggtttcgggccgttctacgattccgacggtccgacgtagggttcgggttacgtagggaactaacgtaacgttcctaacttcgtaccacccgtataccgacgtaccgcgtaccncggtaacgtaccgtccgtaagaacgttcgttacggttaccgaactttaaaccgtttatttaaccgttaaaggtttaaacttaaacgttttcggtaaaccttaacgggtacgtaccccggttagggttacggtttacccggtacccggtacccgggtaaagggtaacccggtaaggttacggactaaaccggtaccaaacggtacgtttggacgtaccg

SEQ ID NO: 271377 - DNA, 703 bp, Homo sapiens
  misc_feature: GYAE6OF02I8AA5.25.4.A04.1.454.CMB.1.raw
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
tcagactgtacagtcacgaccggtgctcgatttagagtagtgatcagggggcagaagtctctctcagtcaggacacagcatggacatgagggtccctgctcagcctcctgggactcctgctgctctggcctcccagataccagatgtgaccgtccagatcgaccctattcctccattccctccctgtcctgcattcgtgtggagacagatcagcactcgtacgttcgggacccggggtcagtccggagggcctaagttagaccttaagtttactttacggccgttacggtaactacgaaaaccgaacggaaaaccgagggggtaacgttaccgtttaccgtaacggtccttaccgtagtactcgtatcggtctcgacccctcgtaactacctcgtacggccggttacccngttaccggttcgtacncggtcgacgtagtacgtagtcgggtagacgtacgtacgttaccctacgtcctacaaccttatcacgacgaccgtccgtacgaccgtacgtccgtaagaaccgttcgttagttaaccgtactttaaccgttatttaaccgtaacgttaaacttaaaacgttacttaaaccgtcttacccgtacccttcgttaccgtccgggttaccgggaacgggtaaccgggtaacggtaacgggtacgtaacgtaacggtaccgtaaacgtcggtacggtaaccgg

SEQ ID NO: 271378 - DNA, 845 bp, Homo sapiens
  misc_feature: GYAE6OF02GTB7U.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtccagatcgacccagtcctccactccctccctgtctgctattctggttggagtacagtaactcgaagctactcctacgttcgggacccggggtacgtacggtacggaggggtacctaagttaacggacttaaaattttacgtttaacggtcctttaagggttaaacctaacgaaaacccggtaaacggaaaacccgggtaagggggtaacgtaacggtttaacccgtaacggtccttaccgtagtaacttcgttacgttcgtaccttaccggaccccttaacccgtaaccgttaacccgtaccggtaccggtaacccggggttacccctacgttccggtttaacggttcgacggtacggtccgtaaggtacgtaacgtccgggtaacggacgttaaggtacgttccgtaccgttactaccgtacttaacacgtaccgacgtaccgtccgttaacgaccgtacgtacgtaacgggtaactacggttacgttaactaaccgttaacgttttaaacgttaacgttaaacgttaaacgtttaaaacgttacgttaaacggtaaccggttaccgtaccggggttaacgtttaccgggttaacccggttacccgggtaacccgggttaaacggggtaaccgttaaggggtaccgtaacgtaaacccgggttaactaaaccggttaccggtaggtacccggg

SEQ ID NO: 271379 - DNA, 778 bp, Homo sapiens
  misc_feature: GYAE6OF02FXES4.25.4.A04.1.454.CMB.1.raw
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
  modified_base (429)..(429): a, c, t, g, unknown or other
  misc_feature (429)..(429): n is a, c, g, or t
tcagactgtacagtcacgaccggtgctcgatttagagtagtgatcagggggggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtctgggggaggcttggtacagccacggcccggtccccgacactctcctgcacagcttccggactcaccgtttggngagcatgctaagttcgaccgtgggtccnccaggcctaccgaagggggagggtctgggagttggcgtttgggttacagttaggaagcggaaatccgtagtgggtacggggcaaacactaagtaccggccgtacggttactaagtaaaaacggggnaacggtattaccgacgtccctacgtacgaaacgtagtagttacgtaacttaaccccgaaaaagtcctaacgttacccggacccttaaacttccgtacaaccaccgtaacgttacgggaacgtaccgtaacggtacccgtttaagggaaacggtaaacgggttacggaaacgggttacccttaacccgggtaaacgggttacccggtttaaggtttacccgttttaaacccgtttggtttttaaacccttttaacgtttaccgttacccgttagggtaaacggttagggttttacggtttaaggttttaaacttttaaaccggtttaaacccgtttaaccgttttaaacc

SEQ ID NO: 271380 - DNA, 705 bp, Homo sapiens
  misc_feature: GYAE6OF02FPE36.25.4.A04.1.454.CMB.1.raw
  modified_base (253)..(253): a, c, t, g, unknown or other
  misc_feature (253)..(253): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggccaggactggtgaagccttcacagaccctgtcctcacctgcactgtctctggtggctcatccacagtgtatcactactgganctggactccgcagccaccgagggaacgggcctgggagtggagttgggacatcgtaacttaccggtgggacgtcctaacctttcaaccgaacccgttcctacaatacggtccgaacttccgaacctattcctactaagttaaccgaacctacggttacctaaacgtaaaccctacgtttacccgtccccgttaaggtaacggttacgtaaacctcgttacggtacgtaccgttacggaccccggtacgggtaccgaaccgggttacccgtttacggtttaacttccggtcggttacggacccgggtattaaccggttaaccgttaaccgtaacgttaaccgttacgggtacggtcccgtaaacttcggtaaccaacccgttattaacccggtaacttacggttacgtttaccgttttggtaacttacggtttacccgggacgggtaaaccggg

SEQ ID NO: 271381 - DNA, 693 bp, Homo sapiens
  misc_feature: GYAE6OF02HJ8Z5.25.4.A04.1.454.CMB.1.raw
  modified_base (668)..(668): a, c, t, g, unknown or other
  misc_feature (668)..(668): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcgaggaggtccgggcccagggactgggtgaagtccttcacacgaccctgtccctcacctgcactcgtctcgtggtcgcctccatccaccgtagtgttatcactacgtggagtcgtggactccgccacgcgacccgaggggacggccgtaggaggtggtagttcgggtactacgttcttaagttaccgggtgggtaactacccgtaacccgtttaccgtaaccccgaacccccgttccctaacgtaaacgttacggtaccggacgttacccgaacctaacgttcctaacgtaacttaacgacctaaccgttactaaaccgtaaccctacgtttacccttacccgtaggtaaacgtttacgaaaccttcgtacggtacgaccgttcggacccggacgggtaaccgtacgggtccgtagtttaacgtacgtcgcgtcggactaagtaccgtagtacgtaacgtagtcgtacatacctccaacctataccacggttatccgtttacgtttanacttacggtacggtcgggtaacccg

SEQ ID NO: 271382 - DNA, 678 bp, Homo sapiens
  misc_feature: GYAE6OF02JFGNA.25.4.A04.1.454.CMB.1.raw
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
tcagactgtacagtcacgaccggtgctcgatttagagtagtgatcagggtctgtgaaggcttcaccagtcctggacctcctgtgcaagaaacatgaaacacctgtggttctccctcctgctggtggcagctccagatgggtcctgtcccaggtgcagctgcaggagtcgggcccaggctggtgagccttcacagaccctcgtccctcacctgcacgtcgtctcgtggtcggctccatcactagttgtatcgactacgtggancgtggactccgccagaccacccggaggggaacggtccgnggtacgtgggtagttcgggactacgttactagttaccggtgggacgtcctaccttcgtaacctacccgttccctacgtaacgtcgtccgaagtacccaacctagtcctaccgtaattaacgacccgtaacgttaactaaaccgtaaaccgtaccggttttacctaccccgtaggttaaacgttacgtaacttcgttacggtcgaaccgttcggcccgtacggaccgacggttccggttagttacttacgtggtccgacgtactaacgttacgtaccgtaattaccgtagtcggacctaagtacctaccgtaacctaattccgaaagttcgttacgttaccttttagacgtttaacggttccggtacgggtaacccgg

SEQ ID NO: 271383 - DNA, 718 bp, Homo sapiens
  misc_feature: GYAE6OF02FROG4.25.4.A04.1.454.CMB.1.raw
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcacagtgttancactactgganctggatccgccagccacccgaggggaacgggccgtggaggtgggagttcggggtaactagttacttagttacccggtaggggacgacctaccttactaaccgaaccccgttaccctactaaacgttacggtaccgacgttaccaccgtacttcctactaacgtttacgaccgtacgttaccgtaaacgtaaaccctacggtttacccttaccccgttaggttaaacgtttacgaaaccgtttaccgttacggttacggtacgttacggcccggtaccgggaaccgtaaccgggttcccgttaggttaactttaccggtacggttcgggtcgggtacctaacgttaaccgttaacgtaacgttaaccgttagggtcggtaccgtaagtacgtacctaaccgtaactaccgtaacgtagttacgttcgtttttacgacgtttacgttcggtacggggtaacccgg

SEQ ID NO: 271384 - DNA, 709 bp, Homo sapiens
  misc_feature: GYAE6OF02GOAOU.25.4.A04.1.454.CMB.1.raw
  modified_base (187)..(187): a, c, t, g, unknown or other
  misc_feature (187)..(187): n is a, c, g, or t
  modified_base (324)..(324): a, c, t, g, unknown or other
  misc_feature (324)..(324): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtcgacgtccagtatcgacccagtcctcctactcctccctgtcngcattctggtaggagacagaactcgacgctactctaacgttcgggcccgggagacggttacgagggtctatacgactaattattacgcctaggtatacaacgaagaaaccgagggtaatacgttactacgtcctcgngtactactatcgcgtcgcctacctacgtacctacgcggtaccggtcctacttccgtcggtacacggccggtacgtagttacggacgttacggtaccggggtagtacgtaaccgttaccgtaccgtacctaccgtaacgttactaccgtacgacccgaccgttacccgttacacctacggaccttaaagggtacgttattcggttaaccaacctttaacgtttaacgtttaaccggtaagttaaacgtttaaaaagtaactttaaaccgtcccgtacccggttaccccctacgtttaccggttaacccggttccggggaaccgggtacgggtaacggtagggtacggtaacggtaaactaaccggtaaacttacggtcggtaccgg

SEQ ID NO: 271385 - DNA, 654 bp, Homo sapiens
  misc_feature: GYAE6OF02HEL3M.25.4.A04.1.454.CMB.1.raw
  modified_base (229)..(229): a, c, t, g, unknown or other
  misc_feature (229)..(229): n is a, c, g, or t
  modified_base (472)..(472): a, c, t, g, unknown or other
  misc_feature (472)..(472): n is a, c, g, or t
  modified_base (490)..(490): a, c, t, g, unknown or other
  misc_feature (490)..(490): n is a, c, g, or t
  modified_base (507)..(507): a, c, t, g, unknown or other
  misc_feature (507)..(507): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctccagataccagatgtgaccgtccagatcgacccagtcctaccatccctccctgtcctgcctatcgtgtggagacagaatcagcatctacgttggccgggnacgtcgagggcctaagttacggactaagtttatttaggccgttggtaactacaaacgtaaggaaaacccgaagggtaagaacgtttaccgtaaagccgttccctagtactacgtactcggtcctcgtacccttaccgtaccgtttaccaccgtcggtaaccggggtcctacgttccgttccggtcgaggcgtacgtagtagtacgttccgtaacggacgtagtacggttcacgtcactactanacgtagccacgcctacgnaccgtacctagaacgtnttcggtacttaacgtaactttagtaaccgttacaaacttaaaagtacttaaacgtacctccgtacccttcgtaccgttacgtaccgggtacggtaaacggtaccgaagggtacggaacaacggtaacctaaacgggtactcggtacg

SEQ ID NO: 271386 - DNA, 787 bp, Homo sapiens
  misc_feature: GYAE6OF02ILNQO.25.4.A04.1.454.CMB.1.raw
tcagactgtacagtcacgaccggtgctcgatttagagtagtgatcaggggggggagaggagccccagccgtgagattcccaggagtctccacttggtgatcagcactgaacacagaccaccaaccatggagtttggcttaactgtcttttccttgttgcttgtttaaaggtgtccaatgtgaggtgcaacgtggtgagtcgtgggggagtcgttggtacagccgagggcccgtcctgacactcctcctcgcacgacgtccgttccggaccttccgtaccgttttcggtagagtctatggtaccttatcggtaccgtcggggtacccgccgaggtcccgtaccggtaggggaagggttccgtagggacggttgggtcgtttggggttaccgtaagttaaggaaacggacggtaacggtaccgttaggttaggggttacggggaccaaaaaccgaacgtaaacggtaaccccggtacccggtacggttaaccggtaacggttaaaaacgggacctaacggttacttaccggacgtccccttaaccgttacgaaaagggtaagtaacgttacggtaaactttaaacccgaaaaacggacctaaacggtttccccgaaccttacgtaccttaccggtaccaacgtaagtacggaacggtacctaccggccgtaagggaacggtaacggcggtaaagaccgtacgtacggccggtttataacgtttcgtacgtttactttcttaagtaccgttagaggtacgtagtttagtttacgtttactaccgtttaac

SEQ ID NO: 271387 - DNA, 702 bp, Homo sapiens
  misc_feature: GYAE6OF02HO8YY.25.4.A04.1.454.CMB.1.raw
  modified_base (345)..(345): a, c, t, g, unknown or other
  misc_feature (345)..(345): n is a, c, g, or t
  modified_base (603)..(603): a, c, t, g, unknown or other
  misc_feature (603)..(603): n is a, c, g, or t
  modified_base (625)..(625): a, c, t, g, unknown or other
  misc_feature (625)..(625): n is a, c, g, or t
  modified_base (666)..(666): a, c, t, g, unknown or other
  misc_feature (666)..(666): n is a, c, g, or t
  modified_base (675)..(675): a, c, t, g, unknown or other
  misc_feature (675)..(675): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagcctcccgagagttcgggtccctcgtcccgaggtcgcagctgcgtagggacggtccgggacccgtagggtactgggtacgaacgtcccttaccaccgtaccgtacccttccgtaccccctacctaccgtcgacctacgttcgttccgttcggtgggtccgtacctacctactaccaccgttaggttcgtactacctacgtacgtggactcgtcgtccnccgcacgaccggaccggagggtacgcggtaggtacggtaggtacggttacggtactacgttacgttacgtaccgggtagtaccgtaccctaccgttacccgtaaccccgtacccgtcctaagtacgtacgtaccgtcgacctactactctaactacgtactaaccgtacgtaaccaccgtaccgttcgtcctaacgtagtagtctactgtaccgagtccgaccgtaccggcgtaacgtcgtacgttactacgttcggntacgacgtactacgttaaccgngtaactggttaccacgttacactacgctaactgtcgttacngttacgttntaccgtaggtcggacgtacggtaacgg

SEQ ID NO: 271388 - DNA, 596 bp, Homo sapiens
  misc_feature: GYAE6OF02FRK1Z.25.4.A04.1.454.CMB.1.raw
  modified_base (195)..(195): a, c, t, g, unknown or other
  misc_feature (195)..(195): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccactccctccctgtctgcatctgtgganacagaatcagcatcacgtggccgggagacgtcgagggcattaggactaattacgtttacgtccgttggtactactaacgaacggaaaccgaagggagtacgttaccgaagtcctaccgtgtattactgtgctcgcctaccacgttacacctcgtacggggtcccacgttccgttccgtcgacgcggtacgacgtacgtagtcgtacgggacgacgtagttacactcctacgactaagtcctagtccacgccttcgacgcgtccgtagactagttcgttactacgtaacttaacttactataaacgtaaattaataactacgtccgtccctacgtccttacggttacggacgggtacggtaacgagggtacgtaaggtactaccgtaacgtagttcgtacgg

SEQ ID NO: 271389 - DNA, 778 bp, Homo sapiens
  misc_feature: GYAE6OF02FJ8PO.25.4.A04.1.454.CMB.1.raw
  modified_base (162)..(162): a, c, t, g, unknown or other
  misc_feature (162)..(162): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
tcagactgtacagtcacgaccggtgctcgatttagagtagtgatcagggtctgtgaaggcttcaccagtcctggacctcctgtgcaagaacatgaaacacctgtggttctcctctgctggtgcagctcccagatgggtcctgtcccaggtgcagctgcaggngtcgggccaggactggtagaagtccttcacacgaccctgtaccctcacctcgctaaccttgttcctacgtcggtacgtccttaccaacttccgaaccgtaggttacggtttaactccgtaaccgttacgtggtaacggtcttaagggacccttcccggacctacggaccccgtaacccgaagggggtaaaccggtcccgttaggaacggttcggtagtttacgggaactcttacgtacgttaccgggtgggaactccctaccttcgtaaccgaccccttcgaactaagtcgtacgtacgtacaaccagttcctanacgttanaccgtacgtactaacgtaaccttcggttcctaaccgtagtacgttaaccggacttcggtacgtcgtaacgttcacccgggtcgaaccgtccggtccgttaggtaccttaacgggtcggtaccgtacgggtaacttaacggttaaccctaacgggttaaacttaccgggttaccggtccggttaaccgtaacttaccggttaacccacggtaacccttaaccggtacgacgtttaaccggtttcccggttttaaagacgtttaacccgggttcggttaaccgggtaaacccgggg

SEQ ID NO: 271390 - DNA, 853 bp, Homo sapiens
  misc_feature: GYAE6OF02HY32S.25.4.A04.1.454.CMB.1.raw
  modified_base (228)..(228): a, c, t, g, unknown or other
  misc_feature (228)..(228): n is a, c, g, or t
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
tcagactgtacagtcacgaccggtgctcgatttagagtagtgatcaggggggagaggagccccagccgtgagattcccaggagtctccacttggtgatcagcactgaacacagaccaccaaccatggagtttggcttaactgtcttttccttgttgtcttagttttaaaaggtcgtaccaattgtgaggtcgcaacgtgggtggagtcgtgggggagtcttggtaacngaccgagggccccggttccctgacctacctcctctagccacngtccttccggacctctaccgtttggtacgngtcatggtactagtcgaccgttgggtcccgcacggctacccggagggtaaggtcgtcggagtcggtcgtttacggtttcagtttagaacgcgtaacgtccgtaagtgggtcgggaactaacgaaccaagtaccgaccggtccgtaacgttaacggttaaaacgacgtaacgggtacttaccggtacgtacccgtttacgaaccgtaaacggtaaggttaaccgtaggtttaaaccgtttaacccgaaaaacggtccgtaaccgttacccgttaacccgttaaccgtttacgaccggtaacttaccgaacgtaacgggtacgtaaccggtacccggttaaccgtaagggaaaccgggttaaaggacccgggttaaacggaacccgttaaccgtaaccggtttaccggttcggttttaaacccgttttacggttttaccggttttaaccttttaacggttttaacccgtttaccgtaaggtttaaccggtttaagggttaacgtttttttaaccggggttttaacttttttaaacggttaacccgttttaaaccg

SEQ ID NO: 271391 - DNA, 609 bp, Homo sapiens
  misc_feature: GYAE6OF02IT7Y8.25.4.A04.1.454.CMB.1.raw
  modified_base (326)..(326): a, c, t, g, unknown or other
  misc_feature (326)..(326): n is a, c, g, or t
  modified_base (351)..(351): a, c, t, g, unknown or other
  misc_feature (351)..(351): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatccaccagtggttatcactactggagctggactccgccagccaccgagggacggccgtggagtggagttgggacatctaagtaccggtgggacnctaccttactaccaacccgtcctanaatacgtcgatcacctatctacattacgactacgtactaacgaacctacgttcctacctagtaagttacgaacttctgtacgtacgtcgaccggcggaacgtaccggtccgttagtacgtttacgtggtacgccgtactacgttaccgtaacggtacttaacgtacggtcggtacgtaactacgtacctaaccgtacgttacgaacgttacgttacgttacgttttagaactttacgtaccgggtacgggtaacccgg

SEQ ID NO: 271392 - DNA, 692 bp, Homo sapiens
  misc_feature: GYAE6OF02G00EJ.25.4.A04.1.454.CMB.1.raw
  modified_base (196)..(196): a, c, t, g, unknown or other
  misc_feature (196)..(196): n is a, c, g, or t
  modified_base (494)..(494): a, c, t, g, unknown or other
  misc_feature (494)..(494): n is a, c, g, or t
  modified_base (536)..(536): a, c, t, g, unknown or other
  misc_feature (536)..(536): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccactccctcctgtctgcatcgtgtganacagaatcagcatctacgttcgggccggagacggtcgacgggtataagttagactaaatttactttacgtccgttaggtatacaacgaaacggaaaccgaaggggacgtacgttaccgttaacgccgttaccgtagacttacgttagtaccgtcgtccgttcccctaccgttaccgttaccgtaccgtccggtaccggggtaccctacgtttaccgttcggtttaccgacggtccgtacgtagtaacgtacgttcgggaaccggtagtaccgtactttccacgttcctactactaacncgaacgacctcgtcgtcgaccgtaaccgcgttacgaacgttntggttactaccgtttaacttacgtttaaccgttaagtaaacttaaacggttaacttaaactcccttaccgtacccttccgtacgttaccgggttaccgacgggtaaccggaaggtcggaagtaacgtaccgtaaccggtaaacgttggccgtacgg

SEQ ID NO: 271393 - DNA, 672 bp, Homo sapiens
  misc_feature: GYAE6OF02FK0M3.25.4.A04.1.454.CMB.1.raw
  modified_base (234)..(234): a, c, t, g, unknown or other
  misc_feature (234)..(234): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgctacttcgtgttggacacagaactcaagcatcacgttggccgggcgagtcgngggcctattagactaattatttacgccttggtactacaacgaacgaaaccgaaggggacgtacgttccgtaaacgtccttacctgtacttcgtaactcgtccttcgccctaccctaaccgtttaccacgttcgtacggggtacccctacgttccgttacggtttccggacggccggtactacgggtagtaaacgttcgtcgggacgtagttaccgtacctactcgtacctacttaacgtcgaacgtaccacgtccttacgaccgacgttaccagtaaacgttgttcgtacgtacgtaacgtttactttaacgtacgtaaacttaaaacgtattaaacgtaccgttacgtcccctactttaccggtaaccgtttaccgggaacgggtaaccggacggttaaggcggtaacgtccgtaacgaaacggtacgtaggtacgg

SEQ ID NO: 271394 - DNA, 719 bp, Homo sapiens
  misc_feature: GYAE6OF02F4857.25.4.A04.1.454.CMB.1.raw
  modified_base (167)..(167): a, c, t, g, unknown or other
  misc_feature (167)..(167): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (354)..(354): a, c, t, g, unknown or other
  misc_feature (354)..(354): n is a, c, g, or t
tcagactgtacagtcacgaccggtgctcgatttagagtagtgatcagggtctgtgaaggcttcaccagtcctggacctcctgtgcaagaacatgaaacgacctgtggttctccctcctgctggtggcagctcccagatgggtcctgtccctaggtgcagctgcaggngtcgggcccaggactggtgaagtccttcaacacggaccctcggccctcacctgccactgtctctggtcgctaccntcaccagtgtacncactntggngctggactccgcagccaacccggagggacggtccgtaggtacggttggtaacgttacgggacctaacgttacgtaccggtttaaccgggngggtacacccgttacccggtttactaaacccgtaccccgtactacgtaaagttaccgtacgtaacgtcccgaaactacgttccgtacctaagttaccggtaacctaaccggttactaaaccggtaaacccgttcggtttacccctccggttaacggtaaaggtttaccggttaaaccgttctttcggtaacggtaacgttccggtaccggacggtaaccctacgttccggttacgttaacgttccctggtaccggtaccgacgtacttaacgttaacgtagttaacccgtagtaccgtacgtacgtacttcaacctagttacacgtacttggttcttaccggtatacgttcggtaggtaaccggg

SEQ ID NO: 271395 - DNA, 719 bp, Homo sapiens
  misc_feature: GYAE6OF02IQ4A3.25.4.A04.1.454.CMB.1.raw
  modified_base (180)..(180): a, c, t, g, unknown or other
  misc_feature (180)..(180): n is a, c, g, or t
  modified_base (194)..(194): a, c, t, g, unknown or other
  misc_feature (194)..(194): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttggacttaactgttcttttcttgttgtcttagttttaaaagngtcaatgtgaggtncaagtggtggagtcgtgggggaggtcgttggtacagccgagggtcccggtccctgacaccgttcctacctgacacgacgtccgttacccggactctaccgtttggacgagcgaatgactagtcgaccgttcgggcccgcgacggccgtacggaggggtaacggtcgtgggtacgtggtcgtttagggttctaagttaaggaagacgaacgtccgtaaggtcggggtacggggacctaaacgaacgaaacgtaccggaccgtcgttaacgtaaggtaaaaggccgtaagtacgttcgaaccgtccgttacgtaacgaagtagaacgtacgtaactaaacgaaacgacgtacgtaccgtaccttactcgtacgaactacgtaagtaccgaagtaccgtaacgtacgaacggtaaaggaaccggtacggaacggtaccgtaccggtacggtaaccgttacgttaactttacgtttacgtttactttaacgttacgtagttaacggtaggttacggttagttttaacgg

SEQ ID NO: 271396 - DNA, 687 bp, Homo sapiens
  misc_feature: GYAE6OF02FYAXC.25.4.A04.1.454.CMB.1.raw
  modified_base (182)..(182): a, c, t, g, unknown or other
  misc_feature (182)..(182): n is a, c, g, or t
  modified_base (506)..(506): a, c, t, g, unknown or other
  misc_feature (506)..(506): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgaccgtccagatgacccagtcctccatcctcctgtcngcatcgtgtggagacagatcagcatctacgttcggccggggagtacgtcgagggtactattagataatttagtttacgccttaggtactaacaacgaacgaaaccgaggggacgtaacgttcctaacgccttaccgtagtattctacgtgtcctcgtaccctaccgtaaccgttaaccaccgttaccgggaaccggggttaccccacgttccggttcggttaccggacggacgggtcctaagggttacgtacgttcggtacgggaacgtacgttacgttacgtaccttacgtacgtacctagacacgctaaccggcctacgacncgttaccgaagactagtcgttacgaacttaactttagtttacgtaagttaaactaaaattacttaaacgtcccgttacctaccccgttcgttaccggttccggttacggggaacccggtaacgggtaacgtacgggtacgtaaccgtaaaggtaacccgtaaacggttggtaccggtacgg

SEQ ID NO: 271397 - DNA, 687 bp, Homo sapiens
  misc_feature: GYAE6OF02JSTBH.25.4.A04.1.454.CMB.1.raw
  modified_base (155)..(155): a, c, t, g, unknown or other
  misc_feature (155)..(155): n is a, c, g, or t
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (525)..(525): a, c, t, g, unknown or other
  misc_feature (525)..(525): n is a, c, g, or t
  modified_base (546)..(546): a, c, t, g, unknown or other
  misc_feature (546)..(546): n is a, c, g, or t
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtcgacgtcacgntgacccagtcctccatccctcctgtctgacatcngttgancgtanactcagcaagtcacgttcgccggggacctagtcgaggtaccgtaacgttaacggtactaaacgtttacgtttaacggtacccgttagggttaacgttaccaaaccgaaacggaaaacccggtaaaggggtacgaaccggtttaaccgtaaaacggtccgttaccgtaaccgtagtaccttaagttcgtaaccgtctccccgtacctaaccggtttacacccgttacggaccggggttacccaacgttcgttccggtacgtaggccgacgttagtacggtatcgggtacgacgtacggtacgttccgaacgttcctcttaaacgtnttaccgacgtcaccgtccgtnaaccgtcgccgaagtaagtctaggtctactaactttagtactacgtaagttaaataccgtaaatccgacttcccgtagttcccgtaaggttcgaaccggtacgaaggtacgtacgtacgagaacgtaccgattagtaccgg

SEQ ID NO: 271398 - DNA, 932 bp, Homo sapiens
  misc_feature: GYAE6OF02HX3BW.25.4.A04.1.454.CMB.1.raw
tcagactgtacagtcacgaccggtgctcgatttagagtagtgatcaggggagctctgggagaggagccccagccgtgagattccccaggagtcctccacgttggtgatcagcactgaacacagagactcagcagtggtagtttggctgcgtcgtttgggtttttcctcgttgtcgtttacgtttttaaggaggtcgttccagttgtcagatcgacaacgtgggacgggtagggtcggggggtagcggtcgggtaccgacgggccggggaacttccccgtggaccgtaccgttcctccgtaggtcgacctacggttcggtacccgtccgttcccccttaaccccgttttccggtttccggtttttcggccttacgtttaccgtaccggttaccgggggttccccgaccgtaaccgggtacccttacccgggaacgggtaccgggtaaacggggtacccgttagggggaccgggtttcgggggtacgggtccgggttacgttaacggttagggttacgggggtaggggtaacgttaggggtaaaacggttagttaggttaaccgtttaagtttttacggacgtaccgtaaacgtacccgttaccgggttaacgggggaaaccgggtcccctaacgtacccgaaccttaccgtaccgtaccggtagaaccgggtactaccggtaaccctaacccgaaacgttaaccccttttaacgttttaaccgtcgtaaccgtaccttaaacggttaacggtaaaaccggttcgtaaccggtaactaaccggaaccgaccgtcggtaccgttagtaccgttaagtttcccggacggtaccgggtacggttacggaacgggtaacccggttaacgggtaccggggttaaccccgggtcgtttaacccggtacgggtaaccgtacgggtcccgggtaacccgggg

SEQ ID NO: 271399 - DNA, 687 bp, Homo sapiens
  misc_feature: GYAE6OF02FSKFX.25.4.A04.1.454.CMB.1.raw
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (336)..(336): a, c, t, g, unknown or other
  misc_feature (336)..(336): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtgcagctcccagatgggtcctgtcccaggtgcagctgcaggacgtcgggcccaggactggtagaagtccttcacagtaccctgtccctacaccgtgcactgtctcgtggtggcctccatccacctagttgttacncactacgtggancgtggactccgcagccaccgagggacggccgtggacgtggattgggaactagtctaacgttaccggnggacgtcctaaccttcctaacccgtaccccgttcctaacgtaacttacggtaccgtaacgtacctaacctacttcctacttaaacgttacgtaacctaacgttaaccgtaaacgtaaccctacgtttcccgtaacccgtaagttaacggttaccgaaccttcgtacgtacgtacgtccggacccgtacgggtaccaccggggttcttaaggtacttacggtggtccggtacgtcgtaacgttaccgtacgtaattacggtacgtacggtccgtaatccgttaaccgacctatccgtaagtactttcgtttaccttttaacgacgttccggtaccggggacgtaaaccgggg

SEQ ID NO: 271400 - DNA, 744 bp, Homo sapiens
  misc_feature: GYAE6OF02JY0SN.25.4.A04.1.454.CMB.1.raw
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (361)..(361): a, c, t, g, unknown or other
  misc_feature (361)..(361): n is a, c, g, or t
  modified_base (491)..(491): a, c, t, g, unknown or other
  misc_feature (491)..(491): n is a, c, g, or t
  modified_base (595)..(595): a, c, t, g, unknown or other
  misc_feature (595)..(595): n is a, c, g, or t
  modified_base (720)..(720): a, c, t, g, unknown or other
  misc_feature (720)..(720): n is a, c, g, or t
tcagactgtacagtcacgaccggtgctcgatttagagtagtgatcagggggcagaagtctctctcagtcaggacacagcatggacatgagggtccctgctcagctcctgggacctcctgctgctctggcctcccagactaccagtatggtacgaccgtccgacgatcgaccctagtctccactcctccctgtaactgacagtctggtggagtaccanaactcganctactctacgttcgggcgggactagtcgagggtactaatacggtactaatttacgtttagaccggttgtaatccgaaactagtaaacccgaaggggtcgtaccttaccgaagtccgtacctagtacgtctaacgtnacgtcccgtacccgttacccaaacgttacccgtaaccgttcgggtaaacccggggttccctacgtagggtttaccccccgttggaccggtaacgggtcctaaggtagttaaacccgtgggtaacccgggnggtaaacgtcgttacccgtactccgttactaacccggttaacgaccgcgtaaacctccgtaacggttcccgagtactaccgttaggaaatttccgggtacgttnaaacccttagtttacgtacctttaaggtaaaaccctaagtatttaaccccaacgttcctaccgttcctaggtcccgtacggttacgggaacccggtgtaaacgggtacgtaactaaccgggttanaacccggttaccgtggtccccggg

SEQ ID NO: 271401 - DNA, 798 bp, Homo sapiens
  misc_feature: GYAE6OF02F45UC.25.4.A04.1.454.CMB.1.raw
  modified_base (158)..(158): a, c, t, g, unknown or other
  misc_feature (158)..(158): n is a, c, g, or t
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
  modified_base (678)..(678): a, c, t, g, unknown or other
  misc_feature (678)..(678): n is a, c, g, or t
  modified_base (701)..(701): a, c, t, g, unknown or other
  misc_feature (701)..(701): n is a, c, g, or t
tcagactgtacagtcacgaccggtgctcgatttagagtagtgatcagggggggaggaggagccccagccgtgagagttcccaggagtctccacttggtgatcagcactgaacacagaccaccaacatggagtttgggcttaatgtcttttccttgttnctgttttaaaaggtntcctaatgtgtaggtcgnaacgtggtagaggtcgtagggggngtcttaggtacgaggtccagggcccggtcccccganacttcgttcccgnggacccaagtgtcccttaccgggactcctaccgtttcggttcgacggtacctagtacggtacctattacggtaccccgtaggggttacccccgcgttaacggacccggttcccggaacgggggtaaacgggggttcctagggtaaccgggttgggtcccggtttaggggttacgtacggtttaacgaacggtaccggtaaacgggtccgtaagtttcgggagggggacccgttaaacgaacgtaaactccggtaccggtacgttaccggtaaggtaaaaacgggtcaaaggtaacttaccgagtcccgtacgtaacttaagaagtacgtaagtacgttacgtaaaacgcgtaactacccgacgttacgttactaggacttacaacgtgactacgccggaactacggagaccganaccgggtatacgtagaccggttntaagtttacgtaccgttttaactacctttaccggttacttaaggttacgttaacggtaagtttcgggtttaattaaccttttacttacgtttaaccg

SEQ ID NO: 271402 - DNA, 973 bp, Homo sapiens
  misc_feature: GYAE6OF02IK5SO.25.4.A04.1.454.CMB.1.raw
tcagactgtacagtcacgaccggtgctcgatttagagtagtgatcagggggcagaagtctctctcagtcaggacacagcatggacatgagggtccctgctcagctccgtgggacctccttgctgctcgtggcctcccagataccagatggtgacgtaccgagatcgacccagtcctccacttccctccgtcgttctcgcgtacttcgttggttagggaagactaagtaaatcgagactactacctacggttccgggtaccggggaccggtaacggttacggaacggggtaccgttaaagtttaacggtaacctttaaagtttttaacggttaaccgtacccggtttaggtaacttaaacccgaaaacggaaaaccggtaaaccgggaaggggtaacgtaacggttttacccgtaaacgtcccttaccgttagtacgttaacgtttaacgtcggttcccgttaccggtacccctaccgttaaaccccgttaaggtccccgttacggggtaacccggttaccctacgtttcccgggttttacggaccgtaaccggtacggaaccgttaacggtttaacggaacggtttaccgggaagggttaacgttaacggtaccgttccgtaaccttaccgtaaccttaaccgttcgtaaccgaacgttaccgtacggtacccgacggttaccgaaaccggttacgtaacgggtaaaggttacggtttaacgtttaaaccgttaaaccgttttaaacgttttaacgtttaaacggttaaacgtttaaaaacccgttaaagtttaaacccgtttaaaccttaaccccgtttacccgttacccccgtttaccggttaacccgggttttaacccgggtaacccgggtttaaccgggggaaaccgggttaaacccggtaaggggtaacggtaaaccggttaaaccggtaaaccggttaaaaccgttcgggttaaccggggttccccg

SEQ ID NO: 271403 - DNA, 765 bp, Homo sapiens
  misc_feature: GYAE6OF02GSNWE.25.4.A04.1.454.CMB.1.raw
  modified_base (172)..(172): a, c, t, g, unknown or other
  misc_feature (172)..(172): n is a, c, g, or t
tcagactgtacagtcacgaccggtgctcgatttagagtagtgatcagggggcagaagtctctctcagtcgaggacacagcatggacatggacgggtccctgctcagcctccgtagggacctcctgctgtctctggcctccgagactaccagatgtcgacgtcagatcgaccngtcctccactccctcctgtctgctactcgttggtggacacagtatcagctaactctacggtcgggccgggagtacgtcggagggtactagttacgtactaagtttacgttacgccgtaggtaactacaaacgtaaacggaaacggtaaggggtagttaaccggttaccgtaaacgtccgttaccgtagtaccttactacgttcgccgttacgtccctaaccgttacgtaccgttaccgtacgggtacccgggttacctacggtttcccggttacggtacgacggtacggtagtacgtagtaaccggtcggtaacgggactagttacgttaccgtaactccttaaccgtacttaacgtccgacgcgaccgtcgtacgacgacgtaccgtaagacgtagttacgtaaccgtaacttaacttttacgtaacgttaaacgttaaacgttaaaagttacttaaaccgtacccgttacccttacccttacggttacccgttacgggttaacgggtaccggggtaacgggtaaaccggttacgggaacggttaaccgggtaaccgttaaaccggtaacggttaccggttagggtaaccgg

SEQ ID NO: 271404 - DNA, 729 bp, Homo sapiens
  misc_feature: GYAE6OF02FPDRV.25.4.A04.1.454.CMB.1.raw
  modified_base (198)..(198): a, c, t, g, unknown or other
  misc_feature (198)..(198): n is a, c, g, or t
  modified_base (271)..(271): a, c, t, g, unknown or other
  misc_feature (271)..(271): n is a, c, g, or t
  modified_base (327)..(327): a, c, t, g, unknown or other
  misc_feature (327)..(327): n is a, c, g, or t
  modified_base (491)..(491): a, c, t, g, unknown or other
  misc_feature (491)..(491): n is a, c, g, or t
  modified_base (607)..(607): a, c, t, g, unknown or other
  misc_feature (607)..(607): n is a, c, g, or t
  modified_base (615)..(615): a, c, t, g, unknown or other
  misc_feature (615)..(615): n is a, c, g, or t
tcagactgtacagtcacgaccggtgctcgatttagagtagtgatcagggggagctctgggagaggagccccagccgtgagattcccaggagtctccacttggtgatcagcactagacacagacccaccaaccatggagttggcttaactgttcctttcttgttgtctagttttaaagtcgtacctaagtgtgtaggtncgaacgtggtggagtcggtgggggacgtcttaggtacacgccgacggcccgggtccctaggaccacttctccnacctactacgtccttcccgactacctccgtttaggtgacgtacgctaggtacctancggttaccggtcgggtcccgccgacggtaccgaccgggtacgggtacgggtaccgtgggtacgtacggggttcgtttacggggtactagtttaggaacggtcggaacgtcgttaggtggggtacgggtacaaacggtactaacggaccgtaccggccggtttanaaccggtaaaacgtgtaaacgtctaaccgcgtaacttcgtaaccgaagttacggtacgtacgtaaacttacccggaaataccgaaccgtttccgtaaaccgttactccggtaaacnccgttaanacggttagaccgtacgtaccgacgttaacgaagacgtacggagtaccgtaccgtcgtacggttaacgtactttcggttactttcgttactacgtcgtagtacgtagttgtaacg

SEQ ID NO: 271405 - DNA, 888 bp, Homo sapiens
  misc_feature: GYAE6OF02HITEX.25.4.A04.1.454.CMB.1.raw
  modified_base (182)..(182): a, c, t, g, unknown or other
  misc_feature (182)..(182): n is a, c, g, or t
tcagactgtacagtcacgaccggtgctcgatttagagtagtgatcaggggagctctgggagaggagccccagccgtgagattcccaggagtctccacttggtgatcagcactgaacacagacccaccaaccatggtagtttggcttaactgttcttttccttgttgtcttagtttaaaggtntaccaatgtggagtgacaacgtggtaggtagtcggtggggacgtcgttaggtacacgccgacggtcccggtccctcgaacctacctccttccgtcgaccacgtacggtcccgttacccgggtaccttaccggttacccgttttgggtacgagtacctagttagtaccttaagttccggcccggttccggggtaccccgccggtaaccgggtccggtaccggggaagggggttaaccggggtcgtacgggggtagggtttcgggttaccgggttttacgggttaactaacggtttaagggaaccggtaccggaaaaccggttcccgggttagggttacgggggtacggggtaaacctaaaccgtaaaaccgtaacggtaccccgggtacccggttccggttaacgtaaacggggttaaaacggtcgtaaacgtttaccgtaacccgttaccgtaccccgttaaccgtaaacgaacggtaagggttaactacggttaaaaccgtaaccggtaaaactcgtacgtcccgtaacttaacggttacctacgccgtaaagttccggacgtaacccgaggttacccgaacgttaacggaacggtaaacggccgaaccggtacgtaccgtaccgggtttactttacggtaccttttaacggttacgtttactttacggtctacgggttactaaggtttacgttacggttttaag

SEQ ID NO: 271406 - DNA, 962 bp, Homo sapiens
  misc_feature: GYAE6OF02HU919.25.4.A04.1.454.CMB.1.raw
  modified_base (317)..(317): a, c, t, g, unknown or other
  misc_feature (317)..(317): n is a, c, g, or t
tcagactgtacagtcacgaccggtgctcgatttagagtagtgatcaggggagctctgggagaggagcccagccgtgagattcccaggagtctccacttggtgatcagcactgaacacagaccacaaaccatggagtttgggctttaactgttctttttccttgttgtcttaggtttttaaaaaggtgtacctaagttgtggtaaggtgactaacgtgggtggagtcgtggggggaggtcgttggtacacggccacgggtcccggtcctacgacacctctcctcgacacagtccgttccggactcctaccgttttggngtacgcagtcgcttaagtcgtaccggttcgggtcccgtaccgacgggtccgtaccggaaggggggtaacgggttcgtaggggtacggttagggtcggttttggggtttacctaaggtttaacggaacggtaccggtaaacggtaccgttaggttcggggggtacgggggtacaaaaccggtaacgtaaacggtacccgggacccgggttaccgttaaccggttaaaacggggtaaaaaacggggtccctaaaggttactttacccggaacggtttcccccgttaacgtaaccggaaaacggtaagtaaacgttaacggttaaaccgttttaaaacccaaaaaacgggtacccgtaaacgtttaccccgtaaccgtttaaaccgggttcttacccggaaacccgtaacttaacgggtacgaccggttaacccgaaccgggttacccgtaaacggggaaacggaaaccgggttacgggaaaccggggttaccctaccgggttaaccggggaacccgtttttaaccggttaaaccggtttttaacctttttaaccgggtttttaaacccttttaaccggttttaaaccccgtttttgggtaaacgggtttaaaacgggtttaacgggttttaaccgggttttttaagg

SEQ ID NO: 271407 - DNA, 799 bp, Homo sapiens
  misc_feature: GYAE6OF02FZRIV.25.4.A04.1.454.CMB.1.raw
  modified_base (211)..(211): a, c, t, g, unknown or other
  misc_feature (211)..(211): n is a, c, g, or t
tcagactgtacagtcacgaccggtgctcgatttagagtagtgatcagggggcagaagtctctctcagtcaggacacagcatggacatgagggtccctgctcagctccgtgggactcctgctgctctggcctcccagactaccgagtatggtcgacgtccagatcgacccagtcctccactccctcccttgtctgctatcctggttggaganaacgaatcacgcatcctacgttcgggaccggggcgtagtacgagggtcctaagttacgacttaatttacgttacgccgttagtataccaacgtaaggaaaccggaggggtaacgtacgtttaaccgacgtcccgttacgtcgtacttcgtacttcggccttccgtccccttaaccgtacgttaccaccgttaccgggtaccgggtacccctacgttcggttacggttccgaggtcccggtaggtagttacgaacgttccggggacggacgtacgtaccgttacctacgttaccctacgtaccttactaccgacgaccgaaccgtcgtacggaccgtaccgttaccggtaacgtaacgttacggttcgtttaaccggtaaccttaacgtttttaacgtttaacgttaaccgttaaaacgtaaaacgttaaactttaaccggtttaacccttacccgttaccccgtttccgttacccggttaaccgggttaccggggtaacccggggtaaccggggttaacgggttaaacgggttacggtaacggttaaccggtaacggaaaacccggttccgggttaagggttaccggg

SEQ ID NO: 271408 - DNA, 659 bp, Homo sapiens
  misc_feature: GYAE6OF02GC88U.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttgccggcgagtcgagggcattagactaattatttagccttggtatacgaactagaaaccgaagggagtacgtacctaaagtcctcgtacgatctagtcgcttcgcctccgacgttaccaccgtcgacggggtacccagttcgtcggttacaggaccggacagttagaaacgttcgtaagggactacggtaacgttccgtacctacgtctaacgttacacgtaagccgtaacgcccgttggaccgtacgtccgtaagtaacgtacgttgttaacggtaacctaaaccgttttaattaacccgtagttaaactaaaaacggttacttaaacgttaaccttacccgttaccccttacgtaccgttaaccgggtttccggaacgggtaaccgggtaacgtaagggtacggtaacgtaacggttaaccggtaaacggtacgttggtaaccgg

SEQ ID NO: 271409 - DNA, 706 bp, Homo sapiens
  misc_feature: GYAE6OF02IWKEL.25.4.A04.1.454.CMB.1.raw
  modified_base (199)..(199): a, c, t, g, unknown or other
  misc_feature (199)..(199): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtccagatcgacccagtcctaccatccctccctgtctgcatctgttgganacagatcagcatcacttcgggccgggtcaggtcgaggctaagttacgactaagtttacttacgccgttaggtactacgaaactaacggaaaccgagggtacgtacgttaccgtaacgtcctccgtagtactactagtcgacttcgacccttaccgaccgttaacaccgtaccggtaccgggtaccctacgttccgtttacgggtcctacgggacggcgtaacggttacgaaacggttcgggtacgggaacgtaacggttacggtaccctacttaccgtaccgtaacttacgtacccgtaggaacctcggtcctacgggacctaccggacgttacgggaatcgtttacgtaccgtaaaccgttaactttaacgtttacgtacgttaaaacgttaaagttaacgtaacctacttacccgttccctacgttaccggttaaccgtaccggggacgggtaaccggtacggtaagggacgtaacggtaacgaaccgtacgaggttcggtaccg

SEQ ID NO: 271410 - DNA, 717 bp, Homo sapiens
  misc_feature: GYAE6OF02GB8ZH.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgactaggacggtcgggcccaggactgggtgaacgccttcacacgtaccctcgtcccctcaccgtgcctacgtgtctcgtggtcgcctccatccacctaggtcgttactccaaccttacgtggacgtcgtggaccgtcccgccaacgccctaacccggaaggggaacgggccgtgggtagtggtagttacgggtacagttcgtacggttaccggtgggacgtacctacccgttactacccgtaaccccgtcctaacgtaagttaccggtacgaacgtaccaccctattacctactaacgttaacgaccctacgttaaccgtaaaccgacccttaacgttccctaccgtaaggtaaacgttcgaaacttcgtaggttcgtaccgttcggcccggtacggtccgtacggtcccgttagttaacgttcgtcggtacggccgtaactacgttaaccgaactcgtaaaccgtgggttaacgcctaacgttaagtccccaacggtacttaaccggacttacgttcggtttactttaggacctttaaggtccggtacgggtaacgg

SEQ ID NO: 271411 - DNA, 680 bp, Homo sapiens
  misc_feature: GYAE6OF02HBGNZ.25.4.A04.1.454.CMB.1.raw
tcagactgtacagtcacgaccggtgctcgatttagagtagtgatcagggggcagaagtctctctcagtcaggacacagcatggacatgagggtccctgctcagctcctgggactcctgctgctcgtggcctcccagactaccagtatgtggaccgtccagacttcgacccagtcctcccactccctccctgtcctgctactcgttggttggacgacagaatcagcatacctaccgttcggcccgggtacgacgtcggacggtcctagttacacgttaaatttaagttcgtaccgttggtactacaacgaacggaaccgaggtacgtacgttacctaaggcctccgtagtactctatcgtctaccgtcctacctaccgtacgtactaccggtacgggtccctacgttccggttccggttacgacggcggtacgtcggtagacggttcgtcgggtactacgggttaccttcaacttccgtacacttactacgacgcgtaccgtcctacgtacacggactaggtactagttacgttactacttaactttgttaacgttaacctaaagttaaacttaagtacctaccgttcctaccgttacgtacgttccgggttaccggacgggtaaccggtacggttaaggacggtaacgtaccgtaaggaacccgttagttccggtaacgg

SEQ ID NO: 271412 - DNA, 860 bp, Homo sapiens
  misc_feature: GYAE6OF02H9HWT.25.4.A04.1.454.CMB.1.raw
  modified_base (175)..(175): a, c, t, g, unknown or other
  misc_feature (175)..(175): n is a, c, g, or t
  modified_base (781)..(781): a, c, t, g, unknown or other
  misc_feature (781)..(781): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctacccagactaccagatgtgacgtccagatcgacccagtcctaccnctccctccgtgtctcgctatcgtggttaggaacaacgtagtaactcagactaactcctacggttccggaccggggtacgtaggtaccggagggtccttaagttacggaccttaaagttttactttacggtccgtagttaacaacctaaacgaaaccggaaaaccgtaggggtaacttaccggtaacctacgcccttacccgtaatccgtttacgttacgtacgtccgttaccgtacccgttaacccgttaacgttaaccctaacggttaccccggggtaacggggtttccccctaagtttcccgggtttacggttccggaaacggtccccggtaataacggttccggtaaacgtaccgggttacggtaaccgtaggttacccgtttaccgtacccgttacctaaaccgttaccgtataccccgggagtaccgtaccggtaaccgtcgtaaaccgtcggtacggttaaacgacggtttaattccggttaaataaacccggtttactttaaacgttaccggttaaagtaaaaccttaaagttaaccgttaaaacccgtcccgttaccgtaccccgtttcggttaacccgttcgggggttaaaccgggngggtaaaaccccgggttacgtaaaggggtaccgtaacgttaacccggaaacggttaacggtcccggtttagggacccgg

SEQ ID NO: 271413 - DNA, 808 bp, Homo sapiens
  misc_feature: GYAE6OF02GHJH5.25.4.A04.1.454.CMB.1.raw
  modified_base (175)..(175): a, c, t, g, unknown or other
  misc_feature (175)..(175): n is a, c, g, or t
  modified_base (219)..(219): a, c, t, g, unknown or other
  misc_feature (219)..(219): n is a, c, g, or t
  modified_base (293)..(293): a, c, t, g, unknown or other
  misc_feature (293)..(293): n is a, c, g, or t
tcagactgtacagtcacgaccggtgctcgatttagagtagtgatcagggggggagaggagccccagccgtgagattcccaggagtctccacttggtgatcagcactgaacacagaccaccaaccatggagtttggcttaactgtacctttttcctgttgcttaggtttaaaaggngtccaatgtgagtgcaacgtggtgagtcgtggggagtcttgganagccgaggtcccggtccctagacctacgtcctcctgccgaacgcggtcccttcccggattccgaccgttttggngacgtccagtcggactacggtcgaccggttcggtcccgaccgagggtcccttaaccgggagggtaacggtcctagggtactacgggtccgtttagggtactaagtttacggacggaacgtaacgtccgtaaaggttcgggacggacctaaacgaaccgtaagtcccggcggaccttacgttaaacggtaaaacgggcctaagggttaccttaccgacggtaccccttacgaacgtaacggtacggtaacgttcgggtaacttaaaccggaaagtccgttaacgtcccgtaacgttacgtagtaccgaccttaagtaccggtacgtaacccgcgttacggaccccgttagtaacggaaccggttacgggaaccgtaccgttaaccgtaccggaacccggtttagttaccggttaacgtttcccgggttaatttacccggtttaaacgttccgtaagggtaaccgtagggtttaaaccgttacgggtttaacttttacgttaaccccggtttaaccg

SEQ ID NO: 271414 - DNA, 768 bp, Homo sapiens
  misc_feature: GYAE6OF02ITGP0.25.4.A04.1.454.CMB.1.raw
  modified_base (150)..(150): a, c, t, g, unknown or other
  misc_feature (150)..(150): n is a, c, g, or t
  modified_base (519)..(519): a, c, t, g, unknown or other
  misc_feature (519)..(519): n is a, c, g, or t
  modified_base (535)..(535): a, c, t, g, unknown or other
  misc_feature (535)..(535): n is a, c, g, or t
  modified_base (552)..(552): a, c, t, g, unknown or other
  misc_feature (552)..(552): n is a, c, g, or t
tcagactgtacagtcacgaccggtgctcgatttagagtagtgatcagggggcagaagtctctctcagtcaggacacagcatggacatgacgggtccctgctcacgctccgtgggactcctgctgctcgtggctcccagactaccagatgngtacctcagatacgacctagtcctccacttcctcccgtgtcctagcctagttgtggtggacacgaaggactacggacactaactcgtccgttagggcccgggtatacggacgaagggtctattaagaccttaagtttacttacggaccgttagtaactacgaaaccgtaaacgaaaccggagggtagtacgtacctaagtacgtacctacgtaacgtacttaggtccgtaacctcgtaccgtaccttacgttaaccgaccgtcggaacccgggttacacgtttacggttccggacggtacgacggacgttaggaacgtacgttcggaaggtacgtacgtaccgtactacctacgtccaacgtacgtacncgaacttccgacgttnaccggacgtacggtaanacgtggttaccgtattaaaccttaaccggtttacttaaaggttaccccaaaattaaaccttaaaactaaactttaaaggttaactttttaacccgtaacgttttaaccccggttaacgggtttaaccgggaaacccggttaaaccggggtaacggtttaaaccgggtagaaaccggttaaccggaaacggtttaacgttaacggttcggtaacccg

SEQ ID NO: 271415 - DNA, 929 bp, Homo sapiens
  misc_feature: GYAE6OF02FIS5S.25.4.A04.1.454.CMB.1.raw
  modified_base (191)..(191): a, c, t, g, unknown or other
  misc_feature (191)..(191): n is a, c, g, or t
  modified_base (912)..(912): a, c, t, g, unknown or other
  misc_feature (912)..(912): n is a, c, g, or t
tcagactgtacagtcacgaccggtgctcgatttagagtagtgatcaggggagctctgggagaggagccccagccgtgagattcccaggagtctccacttggtgatcagcactgaacacagaccacaacatggagttggcttaatgtctttcgtagtgtcttagtttaaagtgtaccaatggtagtaggtanactaacgtgggtcggtagtcggtggggggtaacgtcgttagggtaccgagcccggtacgggtccccggttccctaggacctaccttaccgtcctcggacctacgtccgtaccggttacccggaactttccctacggtttacgggtagaacgtacgtaacgttcgtaaccttaacggttacgtaccccgtttcggggtaccccgtaccggtacggtacccgttaacccgggtaaggggggtaaacccgggttttaccggtaggggttaccggggttaaaccgggtttcggggtttttaccggggttaccgtttaaaacggtttaaacgggaaccgggttaaaccgggtacccggttaaccccggtttaaagggggttccgggggttaaaccgggggaacttaaaaccccgaaaaccggggttttaaacgtaacccccggggtacccgggtttacccggtttttaacggtaaaacgggttaaaccgggccgttaaaacgggttacgtttaccggaccgttacccgttaccgtaacgaacgggtaaggttacgttaaccgtaacgttaaaccggaaacgtaccttaacgtaccggtcttaacgtcgtaccgtacaactacgggataccgtacgacgttgaaacggaggtaacggacccgtaggacctacgtacgggtaccttagggtttacctacggttatttaccttacgtacgtgttacggntttacgggttaattacg

SEQ ID NO: 271416 - DNA, 628 bp, Homo sapiens
  misc_feature: GYAE6OF02HJWH9.25.4.A04.1.454.CMB.1.raw
  modified_base (231)..(231): a, c, t, g, unknown or other
  misc_feature (231)..(231): n is a, c, g, or t
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtccagatcgacccagtcctacccatccctccctgttctgcatcgtgttggaagacagtaactcagcatcacttcggccggngacgtcgaggctagtagactaattactttagccgttggtactacaaacgaacgaaaccggtagggtacgtaacgttacctaagtccgtaccgttagtactcgtaagtcgtccgtccggtacccttacccgttaacgttacgtacccgttccggtaaccggggtccctacggttccgtttacggttccgacgtcggatacggtagaacgtcggtaggactacggtctccacttaccgtactactctacgacgcctacgcttagcgtacgtcgtaggatagtcgtataccttattactagtagtaaactaagtactacgtaccgtccgtcccttagtcccgttaacggtcgggaacgggtacggaacgtagggacgtagaccgtaagaccgttgtgtcg

SEQ ID NO: 271417 - DNA, 703 bp, Homo sapiens
  misc_feature: GYAE6OF02GC7J3.25.4.A04.1.454.CMB.1.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcggcccaggactggtgaagccttcacagaccctgtccctcacctgcactgtctctggtgctcatcacagtgttancactacgnggagctggactccgccagccacccgagggaacgggcctggagtggagttcgggtacacgttcgtaacgtttaccgggtgggacgtcctaccgtttacgtaaccctaaccccggttccctactaaacttacggtcgaagtccaaccagttcctataagtttaccgactaacgttacctaaacgtaacccgtagtttcctacccctaggtaaacgtttacgaaaccttcgttagtacgaaccgttcggacccggacggtacgaacccgggtccgttacggttaacgtttaccgtcggttcggaccgggttactaacgttaaccgttaaccgtaactttaaaccgtagggtaccggttaccgaactttaacgtacccgaaccttaaccgtaccgtacgttaacgttcggtttactttttaggaacgtttacgttaccgggtacgggtaaacccggg

SEQ ID NO: 271418 - DNA, 779 bp, Homo sapiens
  misc_feature: GYAE6OF02JULF0.25.4.A04.1.454.CMB.1.raw
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
  modified_base (361)..(361): a, c, t, g, unknown or other
  misc_feature (361)..(361): n is a, c, g, or t
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgttcttttccttgttgcttagttttaaaaggtgtcctaagtgtggaggtcgctaacgtggtggagtcgtgggggagtcgttggacagccaggccggtcctgacactctcctgccacngtccttaccggactccgtacgtttggnagctagtcgcgttanacggtccccgttgggtcccgccgtacggccgttaccgaagggggtaccgttcgngggtaacggttggcgttttggggttacctaagggttacgaaaacgggtcgtaaacgtacggttacggtcggggtacggggactaaaacgaaaccggtaacggtacccggtcccggtacgtaaccggttaagggtaaaaaaccggcgttaacgtaagtttaccgaaccgtcccgttacgtaaggaaacgaggtaagttaacgtactaaaccgtaaaacggcttactaccgtccgttaatccgtacgaacctaagtacgtaacgtagaaccgacggttaaccttagggaaacgaacgggaccgggtaacggtacccgtaacggtaaccgggtaccggtttacctttaagtaaccggttttacttaccggtttaactttaccggacgtttaagggaaccgttagggttttaagtttaacgg

SEQ ID NO: 271419 - DNA, 730 bp, Homo sapiens
  misc_feature: GYAE6OF02F4O7H.25.4.A04.1.454.CMB.1.raw
tcagactgtacagtcacgaccggtgctcgatttagagtagtgatcaggtctgtgaaggcttcaccagtcctggacctcctgtgcaagaacatgaaacacctgtggttctccctcctgctggtggcagctccagatgggtcctgtcccaggtgcagctgcaggagtccgggccaggactggtagaacgccttacacagaccctgtccctcacctgctactcgtctcgtggcgcctccatcactagttgttatcactacgtggacgcgtggactccgccgagtccaacccgagggaacgggccgtaggaggtggtacgtttacgggaactagttcgttaacgtttaccgggtgggtactacccgtaaccctttaccgtaaccgtaacccccgttccctactaaacgtacgtacgacgttaccaaccgtaacttctacctaaagtttaccgaacccgttacgttaacctaaacgaaccgttacgtttacccgttaacccgttacggtaaacgtttaccggtaaaccttccgttacgggttacgaccggttacggacccggtacccggggtaacctacgggtcccgtttacggttaacgtttaccgtcggtacgggtaccctacgtaccttaacggtaacgtacgtaaccgttggtaccgtacgtactacgtacccgaactactaccgtaagtacgttacgttccgtttagacttagttaccggcggtaaccgg

SEQ ID NO: 271420 - DNA, 650 bp, Homo sapiens
  misc_feature: GYAE6OF02JGMJU.25.4.A04.1.454.CMB.1.raw
  modified_base (181)..(181): a, c, t, g, unknown or other
  misc_feature (181)..(181): n is a, c, g, or t
  modified_base (190)..(190): a, c, t, g, unknown or other
  misc_feature (190)..(190): n is a, c, g, or t
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (371)..(371): a, c, t, g, unknown or other
  misc_feature (371)..(371): n is a, c, g, or t
tcagactgtacagtcacgaccggtgctcgatttagagtagtgatcagggtcgtgtgaaggcttcaccagtcctggacctcctgtgcaagaacatgaaacacctgtggttctccctctgctggtgcagctccagatgggtcctgtcccaggtgcagctgcaggagtccggccaggactggtnaagtccttnacacgccctgtccctcactgcactgtctcnggtgctccatccgactagtgttaatctactcgtaggnctggacnccgcacgcaccgaggaggctggagtggatggacattcgtagtacggtcggagacctacgttacacccgaccgtcctacgtaagtcgtacgacgtaccactactactntaacgttacggaacttaccggtacctaaacgtaaccctaacggtttcctcccgtaacggtaacgttacgtaacttccgttggtacctaacgtccggtaaccggccgtaacgtacccggttgtaccgttaagtttcggtacgtcggtacgactaacggtaccttaacaacgtttaacgtacgggtacgtaccgttaactcggttaaaccctacgtacctaaccggtacgtacgttacgttttaccgttaagacgtttaacggcggttaccgggaaccggg

SEQ ID NO: 271421 - DNA, 715 bp, Homo sapiens
  misc_feature: GYAE6OF02JK51X.25.4.A04.1.454.CMB.1.raw
  modified_base (158)..(158): a, c, t, g, unknown or other
  misc_feature (158)..(158): n is a, c, g, or t
tcagactgtacagtcacgaccggtgctcgatttagagtagtgatcagggggcagaagtctctctcagtcaggacacagcatggacatgagggtccctgctcagctcctgggactcctgctgctcgtggcctcccagactaccagatgtgacgtccagntcgaccctagtcctaccatcccctccctgtctgcctatctggtgagacagactcagccagtcctacgttcgggccgggtagtacggtccggtagggtactaagttacggacctaaagttttacttacggtccgttagttaactacccgaaagtaacgaaaacccggaggggttaactaccgttttacccgaaggtcccttaccgtagtaacgttctaaggttcgacttccggtacccctaccgttaaccgttaccgaccgttacggtacccgggttacctacgtcgtttccggactacgggcccgtgtaacgtagtacgtcgggtagtaccgtagggtacccttcaaccttccgtacttaacgtactacgaccgtacgccgaccgttgaccctacgtaccgtagaaccgtgtttacggtacttaacttaaccgtttactaactaacgttaaacaaagttaacctaacgtaaccgtccctccttacgtacccgtccggttacgggcgggtaacgtaccggagtaacggtacgacgttaaccgaaacgttcgtgtacgg

SEQ ID NO: 271422 - DNA, 760 bp, Homo sapiens
  misc_feature: GYAE6OF02HD5QQ.25.4.A04.1.454.CMB.1.raw
  modified_base (199)..(199): a, c, t, g, unknown or other
  misc_feature (199)..(199): n is a, c, g, or t
tcagactgtacagtcacgaccggtgctcgatttagagtagtgatcagggggcagaagtctctctcagtcaggacacagcatggacatggagggtccctgtctcagctcctgggactcctgctgctctggcctccagataccagatgtcgacgtccagatcgacccagtcaccactcctcctgtctgctatcgtgtgganacagaactcacgtcactcgacgttcggaccggtgagtcgagggtctaagttagactaacttagttacgtccgttaggtaactaccaaacgaacgtaaaaccgaaggggtaacgtaacgttacctaacggtcctaccgtacgtacttacgttatacgtccttccggtaccctaccgtaacgttaccacgtaccggtaccggggttaccctacgttccggttcggtactaacggtcgtacggacgtaaggtacggtaacgttacggtacgggtaaccgtaggttacggttaacctaccgttaccgttaccgtaaccgttacgtacgtaccggtaccgtaaccgtaccgttcggacctaacggtaccgtaaggacgtaagtcggttacgtaacctaaacgttttaacgttacgtaaacggttaaaccgtaaaaagttacgttaaaacgttacccgtacccgtaccctttaaccgtaacgtttacccggtttaaccggggacgtaaaccgggtacggtaacggtacggaacgttaaaccgtaacgtaaccggtacgttaaccggg

SEQ ID NO: 271423 - DNA, 738 bp, Homo sapiens
  misc_feature: GYAE6OF02G2VF3.25.4.A04.1.454.CMB.1.raw
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (485)..(485): a, c, t, g, unknown or other
  misc_feature (485)..(485): n is a, c, g, or t
  modified_base (717)..(717): a, c, t, g, unknown or other
  misc_feature (717)..(717): n is a, c, g, or t
tcagactgtacagtcacgaccggtgctcgatttagagtagtgatcaggggagctctgggagaggagccccagccgtgagattcccaggagtctccacttggtgatcagcactgaacacagaccaaccaacatggagtttgggcttaactgttcttttccttgttagtcgttagttttaaaaggtctacgtaattggtgaggtgacctaagtgggttaggcgtgggtagggggacgtcgtttaggacgacgccgagggcccggttcccgtanaaccacgttctaccngaccacgtagtccgttccggaacttctccgtttaggtgtacgacttacgcttacgtacgtcggacccggttcgggtcccgacgaccggttccggaaccggttaccgggggaaagtttaccggtggggtacggtttacgggtccggttttacggtaacgtttaaagttacgggaacgtacgtaaacgcccgtttaagggngggttcggggaaacctaaaccagaacgtaaccgcccggtacgttaacgtaacgggtaaacgtcggtaagacgttaccgaacgttcgtaccgtaagtaacgagtacgtacgtaacgttaaacgaacgcgaacgttcgaccttactcgtacgactaccagtccgtagaccagtaccgagacgacgacgacgttacacgtcgtacgtataggttcttagtttctaacgtttaccnggttaagcgttagtgtttaag

SEQ ID NO: 271424 - DNA, 744 bp, Homo sapiens
  misc_feature: GYAE6OF02IER1Q.25.4.A04.1.454.CMB.1.raw
tcagactgtacagtcacgaccggtgctcgatttagagtagtgatcagggtctgtgaaggcttcaccagtcctggacctcctgtgcaagaacatgaaaacacctgtggttctcccctcctgctggtggcagctcccagatgggtcctgtcccaggtgcagctgcaggaggtcgggcccaggactggtgaacgtccttacacacgacctcgtccctcacctgcctactgtctcgtgggtcgtcctaccactccaacctaggttacggtttatactaactacgtagggacgcgtacggacctcccgaccgacgacccgaacccggaaggggtaaccgggccggttaggggacggttagggtaacggtttcggggttacacgtttaccgttaacgtttaccgggacgggtaacgtaccgtaaccctttacgtaacccgtaaccccggttccctacgaaacgttacgtaccgtacgtacactacctcttacacgttacgaaccgttaccgtactaaacgtaaccgttacgttaccccgttccgtaagttaaacgttaacggacctttacgtcgttaccgtacgttaccggcccggtaaccggaccgtaccgggtacttagtaacttgtcggcgtaccgactacgttacgtaaacgtcgtaacgtaggtccgacgtactactaaccgtacctagtaaccgtagtacttcgttactttagaacgtttcggtaccgggtaacggtaaccggg

SEQ ID NO: 271425 - DNA, 778 bp, Homo sapiens
  misc_feature: GYAE6OF02GYJH0.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagcctccagatcgggtcctcgtcccaggtcgcagctgacgaggacggtccgggacccgaggtacgtggtagaaacgtccttacaacgacgtaccccttcggtccctcaccgtcgcctacgtcgtctcgtcggtcgacctcactccacgtagttcgtaactccgtactacgtcggacgtcgtacgaccgtcccgacgaacgccgaaccgggaagggtacggacgtaggagtacgggtacgttacggtaactacgttacgttaacgttaccggtcggtaacgtcctaacccgtttccgaaacccttaacccggtcctaaactaacgtaggtaccgtactaaccgactactacctagtaacgtacgtaccgaacgtacgtaaacgtaccttagttacccgttcgtaaacgtaacgtttcaaccgttacgtcgtaaccgtcgtccgggtaccggtaccggtaaccggtaccggttcggttaacttaccgggttacggttaaccgcgggtaaaccgttacgtaacgtttaacgtaaccggttaaacttacggggtacgtccgtaacgttcgtaaactaccgaaaccgtcggttaaccttaacgtgtttacccgtttaaggtaaccgttcggttacgtaccggggaacgtaacccggg

SEQ ID NO: 271426 - DNA, 877 bp, Homo sapiens
  misc_feature: GYAE6OF02GKGIZ.25.4.A04.1.454.CMB.1.raw
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggacgtcggcccaggactggtgaagtccttcacacgacccttgtccctcacctgcctacgttcgtccttcgtggtcgtacctccgactccgaaccgtacggtttcggttacttaccgtaactcgtaggacgtacgtcggactccccgaccacgtaccgacccgggaagggtaacgggtcccggtaggggtaaggttacggggttacggtttacggggtaacctacgttaccgtttaaccgggtttaccggggtacgggtactacccgttacctttacccgtaaaccccgttaaccccgtcccgttaacgtaaacgtcggtacgaccgtacctaacctacttcgtactagttaaccgaccttaacgttaaccgaacgttaacccgtacgttttaccccgaacccgtttaaggtaaaccgtttacgtaaacccgttcgtttcggtaaccggtccgttacccgggtacccggtaaacccgtacccggttaccgttacccggtttattacccggtttaacggtccgggtttacgggaccgttaaccgttaaccgttacctaaacggttaacgttacccggttacggggtaaccttacgtaaccggttaacccttacccggtaaccctaacggttaccgtaaccgtttacgtttacgggtttaacctttaacggggttacctttacggggttttacccggaacggggggttaaaccccgg

SEQ ID NO: 271427 - DNA, 793 bp, Homo sapiens
  misc_feature: GYAE6OF02FFMLI.25.4.A04.1.454.CMB.1.raw
  modified_base (253)..(253): a, c, t, g, unknown or other
  misc_feature (253)..(253): n is a, c, g, or t
  modified_base (608)..(608): a, c, t, g, unknown or other
  misc_feature (608)..(608): n is a, c, g, or t
  modified_base (633)..(633): a, c, t, g, unknown or other
  misc_feature (633)..(633): n is a, c, g, or t
  modified_base (640)..(640): a, c, t, g, unknown or other
  misc_feature (640)..(640): n is a, c, g, or t
tcagactgtacagtcacgaccggtgctcgatttagagtagtgatcaggggagctctgggagaggagccccagccgtgagattcccaggagtctccacttggtgatcagcactgaacacagaccaaccaaccatggagttgggtcttaactgttctttccgttgttgacttaggttttaaaaggtcgtacctaatcggttaggaggtgacaacgtgggtggacgtcggtaggggggacgtcgttacgggtaacncggtcccgacggggcccccggttaccccgtacggacctaccgttccttcccgtacggacccaaccgtacggtacccgttttacccggacttaaccccgttaccggtttttgggacgtaacggtctaacgttcgttaaccgtaagtccgggtacccgtacggggtccccgaccgtacggtccgtaccggaagggtaacgggtcgtgggtaggtcgggttcgtttagggtacctaggtaagacggacgtacggcgttagtggggacggaactaacgtaacacgtacgggtacctcgtaacgtaacggtaaacggctaacgtacgttcacggtcctacacgtaaggactaagtctaanaacctaaagctaacgtccaaccttntaccganacgaactattcggaactcgaactaccgtaaaaccgggtagcggtaccgtaaccgtcgggtaccggtaacggtttacttacggtttaacttacccggttttaatttaccgtttacggtacgggtttccgaagggttagttttacggtttaaccg

SEQ ID NO: 271428 - DNA, 804 bp, Homo sapiens
  misc_feature: GYAE6OF02HA908.25.4.A04.1.454.CMB.1.raw
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
  modified_base (635)..(635): a, c, t, g, unknown or other
  misc_feature (635)..(635): n is a, c, g, or t
tcagactgtacagtcacgaccggtgctcgatttagagtagtgatcagggtctgtgaaggcttcaccagtcctggacctcctgtgcaagaacatgaaacacctgtggttctccctcctgctggtggcagctcccagatgggtcctgtcccaggtgcagctgcaggagtcgggcccaggactggtgaagtccttcacacgaccctgtccctcacctgctaccttgtcctcgtgggtcgctaccatccaccgagttggttatcactacgtggacgtctggactccggcctaacggccgaacccgagggggaaccggtcccgtagggtaggtaggtagttcggggtaactacgtacgtttaacggtttaccggngggtaacnccgttaaccctttaccgtaaccgaacccccgtttacccaacgtaaacgttacgtaccgtaacgtcctaaacccgtcttaccttacgaacgtttaacgaacctaaccggttacgtaaaacggtaaacccttaacggttttcccgtaaccccgttaggttaaaccgtttacggaaaccctttgttacgtacggtacccgtgggtacccccgaacgggaccgtaacccgggtccgtttaaacggttacgtttaacccggngggtttacggacccgtattaaaccgttagttaaaccggtaagttaacccgttagggttaaccgacccgttaataacccgttaaccaaccctaagtttaccgaacggtttacttacgggtttacgttttaaggtcgtttaacccggttacgggttacggggaaaacccgg

SEQ ID NO: 271429 - DNA, 617 bp, Homo sapiens
  misc_feature: GYAE6OF02FZ1DP.25.4.A04.1.454.CMB.1.raw
  modified_base (279)..(279): a, c, t, g, unknown or other
  misc_feature (279)..(279): n is a, c, g, or t
  modified_base (424)..(424): a, c, t, g, unknown or other
  misc_feature (424)..(424): n is a, c, g, or t
  modified_base (442)..(442): a, c, t, g, unknown or other
  misc_feature (442)..(442): n is a, c, g, or t
tcagactgtacagtcacgaccggtgctcgatttagagtagtgatcagggggggagaggagccccagccgtgagattcccaggagtctccacttggtgatcagcactgaacacagaccaccaaccatggagtttgggcttaactgtcttttccttgttgctgttttaaaaggtgtccaatgtgaggtgcaacgtggtggagtcgtgggggaggcttggtacagccaggccggtcccctgacactctcctgcacagcttccggactctacctttggtgagnatgctatgacctgggtccgccaggctccgagggaagggtcgtggaggtggcgttgggttcgattagaagcgagaccgtagtggtgggcaacaacaacgacgccggcgtctagtaaaaggcgagattccagcctcgtacagaagtntagtaattaccgaaagcngtccgcctatcgtgaccacagtagacgacacggtccaggaagaacgcggaacgccttacgacgggtcccgttagttactttacgtttcgtttaccttttaactttaccgttcgttaaggtaacgggttaaggtttacggttagggtttttaacctttaattttaccgttaaaacc

SEQ ID NO: 271430 - DNA, 777 bp, Homo sapiens
  misc_feature: GYAE6OF02JG927.25.4.A04.1.454.CMB.1.raw
  modified_base (435)..(435): a, c, t, g, unknown or other
  misc_feature (435)..(435): n is a, c, g, or t
tcagactgtacagtcacgaccggtgctcgatttagagtagtgatcagggggcagaagtctctctcagtcaggacacagcatggacatgagggtccctgctcagcctcctgggactcctgctgctctggctcccagactaccagatgtcgaccgtccagactcgaccctagtctacccagtccctccctgtctcgactatcgttaggtggacaacgtagaactcgagctatcctacgttcgggccgggactacggtcggacgggtactaagttaacgaccttaaagtttacgtttaccgccgttaaggtactaacctaaacgaaaccggtaaacccggtaggggtaacgtaccggtttaccgtaaacgtcctaccggtacgtacttaccgttaagtccggtcgtcccgtaccccgttaccggtaaccggttaaccnccggttaacggacccggggttaccctaacgtttcccggttaccgttacggtaccggacggtaacgttacgggttaacgtaaacgttccgggtacgggtaaccgtacgtacggtttacccttaccggttacttaacctaactacgtaccgttacgaccgttaccgcgttacgtaccacggttcctaaaggtactagggttactacgtaactttaacctttacgttactaacgttacgtaaaaactttaactaccgttaccttcccgtaccgttctaccggttaccgtacgggtacgggaatacccggtaggaacgtactaccgtaacgaccgttagcgtacgg

SEQ ID NO: 271431 - DNA, 731 bp, Homo sapiens
  misc_feature: GYAE6OF02HQ5BM.25.4.A04.1.454.CMB.1.raw
tcagactgtacagtcacgaccggtgctcgatttagagtagtgatcagggggcagaagtctctctcagtcaggacacagcatggacatgagggtccctgctcagctccgtgggacttcctgctgctctggctcccagataccagatgtcgacgtcagatcgacccagtcctccactccctccttgtctgcactcgtgttaggacgacaagtaactgacgctactaccgtacgttcgggccgggatacggtccgagggtacatttacgactaattttaagttcgtaccgtaggtaacttaccaaacgaaacggtaaaccggagggaacgttaacgtttaaccgtaacggcccttaccgtagtaccttacgtacgtcgtcgtacgtcccccgttaccgttaacgttaccaccgtaccggtacggggtaccctaacgtttccgttaccggttaccgaacgggtccggtacgtacggtactaacggttcgggaacggtaacgtacgttaacgttacctaccgtacttacgtaaccttagtaccgtaggaacctacggtaccgtacgaccgtacggtaccgtaaggtaacgttggttacgttaccggtaacttaacgttatttaaacggtacgttaaacgtaaagttactaaccgttacgtccctaccgttactaccgtacgttccgggacgtacggaacccgaggtacgaagaccgtaactaacggagtcggtacg

SEQ ID NO: 271432 - DNA, 666 bp, Homo sapiens
  misc_feature: GYAE6OF02FHNWR.25.4.A04.1.454.CMB.1.raw
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
tcagactgtacagtcacgaccggtgctcgatttagagtagtgatcaggggagctctgggagaggagcccccagccgtgagattcccaggagtctccacttggtgatcagcactgaacacagaccaccaaccatggagttgggcttaactgtctttccttgttgctgtttaaaaggtgtccaatgtgaggtgcaactggtggagtcgtggggggagtcttgggtacagccgaggcccggtcccctgaccactcctcctgccacagcttccggctcaccgtttggngagnatgctatcgaccgtcgggtccgccgacggctaccgagggtaacgggtcgtgggagtcggacgtttgggtactaagttagaacggacgacgcctagtggggtgggtacaacgacgaacgtaccgcccgtcgttacgtaggaaaacggcgaagtattcagccctactacaagagtatacgacttaccgaaaagtccacgtccggtacctaagtcctagtacctaacgagtacggacgacgaccggccctaagggaaacgtaaggaccgtaacgggaccctacgaccgggtacccgttaaggttaacctttaccggttacgttttaaccttttaacggtttcccttaggttacggtaaaggtttaggttacggtttaaagg

SEQ ID NO: 271433 - DNA, 719 bp, Homo sapiens
  misc_feature: GYAE6OF02GK61W.25.4.A04.1.454.CMB.1.raw
  modified_base (134)..(134): a, c, t, g, unknown or other
  misc_feature (134)..(134): n is a, c, g, or t
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
tcagactgtacagtcacgaccggtgctcgatttagagtagtgatcagggtctgtgaaggcttcaccagtcctggacctcctgtgcaagaacattaaacacctgtggttctccctctgctggtgcagctcccagntgggtcctcgtccaggtgcagctgcgaggacggtccgggacccgaggtctgggtgaacgtccttacacacgtacctccgtccctcacctcgcactcgttctcgtggtcgctccatccacgagttcgttanacactacgngtatcgtggactccgacacaccgaccggagggacggcggtggacggtagtacgttggtactattcgtacgttaccggcggacgaccgttaccttaccgtaaccccgacccttcccaagtaacgtacgtaccgggtactaccgtaccctacttcctacgttaaactacgtaacccgtaacgtttaaacccgaagtacccttacgtttaccctaccggttaagtaacgttaaccgtacgtacgtaggttacgacggtccgtaccggaacccggtacccgtaaccgggttaccgtttacgttaacgtttacggtggtaacccggtccgtacgtaaaccgttacgttaacgtaacttacggtaacgtcggtaacgtaacttccgactaacacctagtaccgttacgttcgttattcgtagtaccggttcgggaaccggtcggaaaacggg

SEQ ID NO: 271434 - DNA, 801 bp, Homo sapiens
  misc_feature: GYAE6OF02H14NN.25.4.A04.1.454.CMB.1.raw
tcagactgtacagtcacgaccggtgctcgatttagagtagtgatcagggtctgtgaaggcttcaccagtcctggacctcctgtgacaagaacatgaaacacctgtggttctccctcctgctggtggcagcctcccagagtgggtcctgtcccaggtgcacgcgtagcgagggtacggtccgggcccgagggacgtggtagaacgtccttacacgacgtaccctcgtcccctctaccgtgacctacttcgttcgttcgttgggtacggcctactactacctaaccgtaggttacggttactacctaacgttaccggtgggacgtcgtacggtaccgtcccggaccgaaccggacccgaacccgggtaacggggaaccgggtccggttaaggggtacgggttagggtacgggttacggtaaccgtaccgtttaaccggtttacggttaccggggtagggtaaccggtaccccttaccctttaacccgtaacccggttaaacccccgttcccgtaaccgtaaacgttacggtcgtaaacccggttccaaaccgttctaccgtaactagttaacgacctacgtaacctaacgtacgtaccgttaccgtaccgtagtaaacgttctacgtagttcggactaccgtccgaccggacgtaacccgtcggtacgaactttacgttacggacggtcgtaccggtactacgttaccgagttaaccgacgtacgttacaccgtactcgtaaccgaccttacgactacggtatttaccgttattaccgtagttaccgtcgggaccgtaacggg

SEQ ID NO: 271435 - DNA, 542 bp, Homo sapiens
  misc_feature: GYAE6OF01D36LW.3.17.B06.1.454.CMB.1.raw
  modified_base (273)..(273): a, c, t, g, unknown or other
  misc_feature (273)..(273): n is a, c, g, or t
tcagagacgcactccacgaccggtgctcgatttagtcgatagtgagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaancccctaagctcctgatctatgctgcatccactttgcatggtgggtccatcaagcttcagtggcagtggatctgggacagatttcactctcaccatcagcaatctgcaacctgaagtattttagctaaactttactactagttacaaacgtagtagttaacctacggtaccccttaccgtaccgtttttcggacccgtaagggggaccctaaaggccgtagggaacgtactaaccgtaaaacggtaacgtaggttacgggcttgggaccc

SEQ ID NO: 271436 - DNA, 502 bp, Homo sapiens
  misc_feature: GYAE6OF01COQC4.3.17.B06.1.454.CMB.1.raw
  modified_base (273)..(273): a, c, t, g, unknown or other
  misc_feature (273)..(273): n is a, c, g, or t
tcagagacgcactccacgaccggtgctcgatttagtcgatagtgagggaaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagtgttagcagctatttaaattggtatcagcagaaaccaggaaancccctaagctctgatctatgctgcatccactttgcagtggtgggtcccatcaagtctcagtggcaggtgatcgtgggactagtatttcactctcaccatcagcaatctgacaacctagaagtattttgacctaacttactacttagtacaactagaacttacacgtacccctcgtactttcggaccgtacgggaccaaggctggaacatacgaaacgactgcgctgacc

SEQ ID NO: 271437 - DNA, 772 bp, Homo sapiens
  misc_feature: GYAE6OF01AB3CZ.3.17.B06.1.454.CMB.1.raw
  modified_base (218)..(218): a, c, t, g, unknown or other
  misc_feature (218)..(218): n is a, c, g, or t
  modified_base (274)..(274): a, c, t, g, unknown or other
  misc_feature (274)..(274): n is a, c, g, or t
tcagagacgcactccacgaccggtgctcgatttagtcgatagtgagggaaagggggagtcagtctcagtcaggacacagcatggacatgagggtccccgctcagctcctggggctcctgctactctggctccggaggtgccagatgtgacatccagatgacccagtctccatcctcctgtctgcatctgtaggagacagagtcacatcacttgccggnaagtcagagtgttagcagctatttaaatggtatcagctaagaaacctagggaaacnccctaagcctcctgatcctagtgctgctactccctaacttttcgctaaggttcgggtacggggtccccaagttccgaaaggttcctttacgaaggtcggtacgtagttgggaacttcgtaggggtacctaagtactttaccgtacgttaccgtacctaacccgtaacgtacgtaacgtaccgtaaacgtaccgtacgtaccgtaaacccgtaacgtaaacgtttaacgtttttacgtaccgttaaaccgttttaaaccgttaaccgttaaccggttaaaccgtaaaccgttaaaccggttaaccggttttaaacccgtaacccggttaacccccgtttaccggttaacccccccccggttttagggtaaccccggtaaccgggggtaaacccgtaaaccgggttaaccggttaaccgggtaacgggtaaaaccgttaacccggtaaaaacccggttaaccggttaacgggttacgggtccggttaacggtaaccccgg

SEQ ID NO: 271438 - DNA, 519 bp, Homo sapiens
  misc_feature: GYAE6OF01AE9DD.3.17.B06.1.454.CMB.1.raw
  modified_base (274)..(274): a, c, t, g, unknown or other
  misc_feature (274)..(274): n is a, c, g, or t
tcagagacgcactccacgaccggtgctcgatttagtcgatagtgagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaancccctaagctcctgatctatgctgcatccactttgcagtggtcgggtcccatcaagtcttcagtggcagtggatcgtgggacagtatttcactctcaccatcagcaatctcgacaacctgaagtattttgactaactttactactcgtactaacagtacgttaacacgttacccctaccgtaccgttttcggaccgtacggggaccagcgtggacgactacgaaacgtactagtcggcgtgtacc

SEQ ID NO: 271439 - DNA, 584 bp, Homo sapiens
  misc_feature: GYAE6OF01BCK3Y.3.17.B06.1.454.CMB.1.raw
  modified_base (195)..(195): a, c, t, g, unknown or other
  misc_feature (195)..(195): n is a, c, g, or t
  modified_base (271)..(271): a, c, t, g, unknown or other
  misc_feature (271)..(271): n is a, c, g, or t
tcagagacgcactccacgaccggtgctcgatttagtcgatagtgagggaaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagtgtagcagctatttaatggtatcagcagaaaccagggaaacncccctaagcctacctgactctatgctgcactcctactttgctagtcgggtcggtcccatcaagtcttacgagttcggctagtggatcgtgggactaggtatttccacgttcctaccgtaacctataccgaacgtacctaaacgttccgtacgacctaaaccgtagtaactacgttttacgaaccttaactttactaacttacgtactaacgtagtaacttactacgttacccctcgttacgtttcggaccgtaacgggacctaaggcgtaggaacgtacgtaaccgtaaacggtactaggtcgtctcgtaccg

SEQ ID NO: 271440 - DNA, 681 bp, Homo sapiens
  misc_feature: GYAE6OF01BWKMY.3.17.B06.1.454.CMB.1.raw
  modified_base (103)..(103): a, c, t, g, unknown or other
  misc_feature (103)..(103): n is a, c, g, or t
  modified_base (288)..(288): a, c, t, g, unknown or other
  misc_feature (288)..(288): n is a, c, g, or t
tcagagacgcactccacgaccggtgctcgatttagtcgatagtgagggaaaggggggaggtcagtctcagtcagggacacagcatggacatgagggtccccgntcagctcctggggctcctgctactctggctccgaggtgccagatggtgacatccagatgacccagtctccatccctccctgtctgcatcgtgtaggagacagagtcaccatcacttcgccgggcaagtcagagtgttagcagacttaatttaaacttggtattcgagcaagaaaccagggaaacnccctaagcctaccgtagactcgtatgtctggctactaccgtagtttcgactaagggtcggggtaccctagtacgtaaggttcaaggtcggacgtagtaggtactcgtaggactaggtactttacactactaccaactacgtacgacggtactacggttactaacgacgtaccgttaaggtaaacgtttacgtttacgacctttaaactttacctaacgttacgttaacctaacgtaacgttaacgtttaactacggtttaacgtttacggttaactttccgttaaccggtttaccggaccccggttagggtaaacccgtaaagggtcggtaaacctaacgttaaccgtaaaacggtacgttacgggtacggtaccgttacgaccgttaacccg

SEQ ID NO: 271441 - DNA, 606 bp, Homo sapiens
  misc_feature: GYAE6OF01D8HD8.3.17.B06.1.454.CMB.1.raw
  modified_base (101)..(101): a, c, t, g, unknown or other
  misc_feature (101)..(101): n is a, c, g, or t
  modified_base (276)..(276): a, c, t, g, unknown or other
  misc_feature (276)..(276): n is a, c, g, or t
tcagagacgcactccacgaccggtgctcgatttagtcgatagtgagggaaaggggggagtcagtctcagtcaggacacagcatggacatgagggtccccgntcagctcctggggctcctgctgctctggctcccaggtgccaaatgtgacatccagatgacccagtcctccctccaccctgtctgcatctgtaggagacggatcaccatccacttgccgggcagtcagagtattagtacctggttggcctggtatcagcagaagccgaaggaaacncccctaactctgatctatgatcgcctcgtagtttgactaaggtcggtaccagtcaaggttcaggcgcaggtgatcgtagggacagtattcgactctacacatacagcagtcctgcaacgtcctagacttgttactttacgacttaacgtttattacgtacgaacctaaacgtaagttaactaaaccgttaccccggtagttacggtaaccggttaccgggaaccgtaaacggggtaacccgtaaaggggtacggaagtaccttagtaaccgttaaaccggtaacgttggtacggtaccttacggacccttaaccgtagttcccgttaacg

SEQ ID NO: 271442 - DNA, 815 bp, Homo sapiens
  misc_feature: GYAE6OF01CXZDA.3.17.B06.1.454.CMB.1.raw
tcagagacgcactccacgaccggtgctcgatttagtcgatagtgaggggaaagggggggagtcagtctcagtcaggacacagcatggacatggacgggtcccccgctcagcctccgtgggggctcctgctactctggctccggaggtgccagatgtgacatccagatcgaccctagtcctccactccctcctgtctgctacttcgtaggtaaggacgaacgagtacgtaccaacctatacctacggttcgggaccgggtactaaggtcgaaggtaggttacggttacgacgtaacgttactttaaagttttaaaggttggtaatacgaacggaaccgaaaacggaaaacccgggaaggggaaaacccccgtacccgtaaacgtcccttaccgtagtacttcttagcggtctacgacctacttcccgttagttggacgtagggttcgggggtaccgtaccagtacgtacgtcgttagaggtcggacgtagggtagtacggttacggtagggacctttagttaccgttacctaccgttacccgtaaccgtaacctactaaccgtacgtaacttacccttcgaacccgtaaacctaacggttactttaaaggttaccgttttacaacccttttaactaccgttaacggacctaaacgtaaccggttaaacgttccgttaaacccctaccccgggtttaccccgttaacggttaccggtacccggggaaacggtaaccgggtaaccctaggtaccggtaaggtaacgtaaaccttaaaaccgggtacgttacggttccgggcggtaaccgcgtaacccg

SEQ ID NO: 271443 - DNA, 722 bp, Homo sapiens
  misc_feature: GYAE6OF01EUVKZ.3.17.B06.1.454.CMB.1.raw
tcagagacgcactccacgaccggtgctcgatttagtcgatagtgagggaaaggggggagtcagtctcagtcaggacacagcatggacatgagggtccccgctcagctcctggggcctcctgctactctggctccgaggtgccagatgtgacatccagatgacccagtcctccatccctccctgtctgctatctggtaggagacagagtacacctatccacttcggaccggacaagtcaaggagttagttagcagtacttaatttaaagttggtatcgagtacaaacgaaaccgaagggaaaccgtacccccgtaaagccttacccgtgtaacttctaatcgctgactactaccttactttcgacgtaggttcggggtaccgggtacctagttacaagttcgttaacagggtgacgtaggtaggtagttcggtagggaacttagtaacgtttcctacctaccgtacctaacctacgtacaagtacctaattcccgtaacggtaccctaaaccgttaggtaacgtttacttttaacgaacctttaaacctttaactaaccgttaaccgtaacgtaaaccgttaacggttaaaccgtttaacccacccggtttaaccccgttaccggtttaccgttttaccggacccggtaaacgggtaccctaaggtcccggtaaggacgtaaacaacggttaaaccgacgttaggacgtcgtacggtaacccg

SEQ ID NO: 271444 - DNA, 708 bp, Homo sapiens
  misc_feature: GYAE6OF01C6TDP.3.17.B06.1.454.CMB.1.raw
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
tcagagacgcactccacgaccggtgctcgatttagtcgatagtgagggaaaggggggagtcagtctcagtcaggacacagcatggacatgagggtccccgctcagctcctgggctcctgctactctggctccgagatgccagatgtgaccacccagatgacccagtctccatccctccctgtctgcctatcgttggngggaacgacagagtccatcaattcctcgttggcccgggnaaagtcgagagttagttttaagttatttttaaattttaaaagttcggttaactacgtaacgtttaaaccaaaaccgtaaacgggaaaacgtaccccctaaaggtcctaccgttagaacttaccttatacggccttgaccttacttaacccgttaagtttaaaacggaacggtttccggggacccctaagttaccgtaaacggttcgtaacggtacggtacggtaggtacggtaatccggttacggggaacctagttacctttaccaaccttctacctaacctacgtacctaagttaacgtaactacctaaaccgtagtaagtattacgtactaacgttactactacgtaacaactagtacgtaacgtacctacccgtaccgtctctacgttcggacggtaacggacgtaaggtacgaagtaacgtacgtaaacgacgtaggtcgacgttcgactaactagtctgttccttac

SEQ ID NO: 271445 - DNA, 617 bp, Homo sapiens
  misc_feature: GYAE6OF02IXE58.3.17.B06.1.454.CMB.1.raw
  modified_base (195)..(195): a, c, t, g, unknown or other
  misc_feature (195)..(195): n is a, c, g, or t
  modified_base (363)..(363): a, c, t, g, unknown or other
  misc_feature (363)..(363): n is a, c, g, or t
tcagagacgcactccacgaccggtgctcgatttagtcgatagtgagggaaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccgggcaagtcagagtgttagcagctaatttaaatggtatcagcaagaaaccgaggaaacgaccctaagctacctgatactatcgctgacatcctactttgctagtggtcgggtcccatcaagtcttacaggtgactagtggattcgngggaactagtacttactactctacactatactagactaatcgtagtacctaaccgtagaaagttacttttacgaccttaaactttaccgtaacgttacgtaacctaaacgtaacgttaacgttaacctaaccgtaaccccgttaccgttacggttttaccgacccggtacgggtaaacccgtaagtacggtaacggtaacgaaggtaaccctaaaacgggtaacccttgggtaaccggtaccgtacgtaacccg

SEQ ID NO: 271446 - DNA, 552 bp, Homo sapiens
  misc_feature: GYAE6OF02JY9HS.3.17.B06.1.454.CMB.1.raw
  modified_base (273)..(273): a, c, t, g, unknown or other
  misc_feature (273)..(273): n is a, c, g, or t
tcagagacgcactccacgaccggtgctcgatttagtcgatagtgagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaanccctaagctcctgatctatgctgcatccactttgctagtggtcggtcccatcaagtcttcgagtggcagtggatcgtgggactagtattcactctacaccatcatacaatctagtaacctgaagttatttgaccttaacttactactagtaccaactacgtacgttaacaccgttaacccctccgttaacgttttcggacccgtaacggggtacctaacggcttacgggaacgtaacgtaaccgtaaacgtacgttaggtcggacttcggacctaaccg

SEQ ID NO: 271447 - DNA, 636 bp, Homo sapiens
  misc_feature: GYAE6OF02GAQ1J.3.17.B06.1.454.CMB.1.raw
  modified_base (196)..(196): a, c, t, g, unknown or other
  misc_feature (196)..(196): n is a, c, g, or t
tcagagacgcactccacgaccggtgctcgatttagtcgatagtgagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccggcaagtcagagtgttagcagacttatttaaattggtatcagacaagaaaccgagggaaacgccctaagcctcctgatctatgctgcactcctactttgctagtcgggtcggtcccagtacaagtcttacgaggtcggacgtaggtcggtatcggtacgggactaggttacctttacacttccgtaccaacctactacgacgtactaactcgtacgacctaacgtagtaagttcttttacgtaaccttaacttaaccttacgttacgtaacctaaacgtacgttaacgttaacctacccgttaaccccgttaccgtttaccggtttcggaacccggtaacggggaaccctacggtaccgtaacggtaacgtaacgtaaccgtaaacggtaaccggttggtacggtacctagtaacccg

SEQ ID NO: 271448 - DNA, 659 bp, Homo sapiens
  misc_feature: GYAE6OF02HVLI7.3.17.B06.1.454.CMB.1.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (307)..(307): a, c, t, g, unknown or other
  misc_feature (307)..(307): n is a, c, g, or t
tcagagacgcactccacgaccggtgctcgatttagtcgatagtgagggaaaggggggagtcagtctcagtcgaggacacagcagtggacatgagggtccccgctcagctccgtggggctcctgctactctggctcgagatgccagatgtgacacccagatgacccagtctccatcctcctgtctgcatctggtggganacagagtcatcatctcttgccggnaagtcagagttgttagtatttaatttaaattggtattntagttacaaacgtaggaacaccctaagcctcctagacttcgtatcgntcgactacgttcctaaagttttaacgaaaggttcggggtaccctagtacgtaaaggtttcaaggttggacaaggtgggaacttcggtagggaactaggttactttcactttcactacattacgaacgttacgtacctaactaaacgttagtaacgttacttttacgaacttaactttaactacttacgtaactaaacgacgttaacgttaccgtaaccttaccccgtacccgtacttaccgtaccgtttccgggaacggtacgggtaaccgtaagggtacggaagtacgtaaccgtaaacgtaacgtcggtacggtacgtacgaccgtactacgttacgttcgttcttaccg

SEQ ID NO: 271449 - DNA, 640 bp, Homo sapiens
  misc_feature: GYAE6OF02IGKAD.3.17.B06.1.454.CMB.1.raw
  modified_base (197)..(197): a, c, t, g, unknown or other
  misc_feature (197)..(197): n is a, c, g, or t
  modified_base (307)..(307): a, c, t, g, unknown or other
  misc_feature (307)..(307): n is a, c, g, or t
tcagagacgcactccacgaccggtgctcgatttagtcgatagtgagggaaagggggagtcagtctcagtcaggacacagcatggacatgagggtccccgctcagctcctggggctcctgctactctggctccgaggtgccagatgtgacatccagatgacccagtctccatcctcctgtctgcattctttaggaganacgagtcaccatcacttgcgggcaagtcagtagtgttagcagacttattaattaggtatacagcaagaaaacgagggaaagaccctaagacctctacgagtactacgttnccgtagactatacctacttttgctaggtacggttcggggtccctaattccgaaacgttcgttacgaggtacggcgtagtagggttactcggtacgggaacgtaagtactttaactacctactaccttaccgaattcgaacgactaaacgtctacggtacaaacgttagaagtttacttcgtacttaaacttagtaacctattacgaactaaggtacttaaccgaccctttaacccgaccgttctactacccggtttacgggaccggaagggtacccaagggttacggaacttaaggaacccgtaaagaccgtttagggcgtccgtatacccgg

SEQ ID NO: 271450 - DNA, 582 bp, Homo sapiens
  misc_feature: GYAE6OF02IRUHE.3.17.B06.1.454.CMB.1.raw
  modified_base (275)..(275): a, c, t, g, unknown or other
  misc_feature (275)..(275): n is a, c, g, or t
  modified_base (342)..(342): a, c, t, g, unknown or other
  misc_feature (342)..(342): n is a, c, g, or t
tcagagacgcactccacgaccggtgctcgatttagtcgatagtgagggaaaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtccaccatcacttgccgggcaagtcagagtgtagcagctatttaaatgtatcagcaagaaaccagggaaacnccctaagcctctgatctatgctgcatcctattgctagtggtcggtccatcagtcttcagtcgctagnggtatcgtaggacagtattctactctacacatcagacactcacgtactaactagtaagtactttacgacttaactttaacttacttacgtacaatacgttaacgttaaccgtaaccgttaaaccccgttccgttaaccgtttaccgggtaccggtaacggggtaacccgaacggtaccggtacggtaacgtaaccgtaacgtaaaccggtaacgttacgggtacggtacgtaccgtaccg

SEQ ID NO: 271451 - DNA, 552 bp, Homo sapiens
  misc_feature: GYAE6OF02GI9ND.3.17.B06.1.454.CMB.1.raw
tcagagacgcactccacgaccggtgctcgatttagtcgatagtgagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagcttaatttaaatggtatcagcaagaaaccagggaaacgaccctaagctcctgatctatgctgctatcctactttgctagtgggtcgggtcccatcgaagtcttacagtggctaggtggtactcgtagggacagtactttcactctacacactcagacaactctcacaactagtaagtatttagactaacttacctactagtacaacgtagtacgttaactaccgtacccgtacgttaccgttttcggaccgtaacgggtaccaacggtcgtaggacgtaataaccgaacgtacgtaggtacggtcgtcgtacc

SEQ ID NO: 271452 - DNA, 522 bp, Homo sapiens
  misc_feature: GYAE6OF02IQONX.3.17.B06.1.454.CMB.1.raw
  modified_base (403)..(403): a, c, t, g, unknown or other
  misc_feature (403)..(403): n is a, c, g, or t
tcagagacgcactccacgaccggtgctcgatttagtcgatagtgagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctaatttaaattggtatcagcaagaaaaccagggaaacgcccctaagcctcctgatctatgctgcatcctactttgcagtggtcgggtcccatcaagtcttagagtgcagtggatcgtgggacagtatttcactctacacatcagcaatctgacaactgaattntttagacttaacttactactagtacaacgagtacttacacgtacccctacgtacgtttacggaccgtacgggaacctaagcgtaggacgagtaccgaaacgacgtaggtagtactgacc

SEQ ID NO: 271453 - DNA, 649 bp, Homo sapiens
  misc_feature: GYAE6OF02IHRI1.3.17.B06.1.454.CMB.1.raw
  modified_base (219)..(219): a, c, t, g, unknown or other
  misc_feature (219)..(219): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
tcagagacgcactccacgaccggtgctcgatttagtcgatagtgagggaaaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccggnaagtcagagtgtagcagctatttaaattggtatcagcagaacaggaacnccctaagctcngatctatgctgcatcctacttttcgactagtcgggttcgggtaccccatacgaagtcctttcaaggtggctacggttaggactcggtagggtactaggtactttacgaccttcctaccacctattacaacgtactaacttctacggtacctaaccgttagtaaacgtttactttttacgaaccttaaactttaaccttaacgttacgtaaaccaacggttaacgtaacgtttaaccgtaccggtttaacccccttcccgtttaccgttttacgggacccggtaacggggtaaccctaacggtccggtaacggtacgtaaccgttaaccgaaaccggttaacgttccgggtaaggtccctaggtaaccccg

SEQ ID NO: 271454 - DNA, 666 bp, Homo sapiens
  misc_feature: GYAE6OF02GIWCS.3.17.B06.1.454.CMB.1.raw
tcagagacgcactccacgaccggtgctcgatttagtcgatagtgagggaaaggggggagtcagtctcagtcaggacacagcatggacatgagggtccccgctcagctcctggggctcctgctactctggctcgaggtgccagatgtgacatccagatgacccagtctccatcctccctgtctgcatctgtaggagacagagtcaccatcacgttcggccgggacaacgtcaaggtagttggttagccagcttaatttaaagttggtatcagacaagaaaccgagggaaacgcccctaagcctccgtgatctatgctgactactacctactttcgactagtcggggttcgggccctaagtacgtaagtccgtttacgaggtcgggactagggttcggacttacggtagggaacgtagttactttacaccttcctacaacctagtacgaacgtctaaacgtccgtacgaacctaaacgttcgaaagtttccttttacgaaccttaaaccgtttactaccgttacgtacctaaacgttaagttaccgttaaccgttaacccgttaccccgttaccgtttaaccgtttaccgggaccgtaaccggggactaacggtcgtaaggtaacgtacgtaacgtaacggtaccgtggtaccggtactcggtacccg

SEQ ID NO: 271455 - DNA, 695 bp, Homo sapiens
  misc_feature: GYAE6OF02GBP8S.3.17.B06.1.454.CMB.1.raw
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
tcagagacgcactccacgaccggtgctcgatttagtcgatagtgagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcactgccgggnaagtcagngtgttagcagctatttaaatggtactcaganaagaaaccgagggaaacncccctaaagcctactgatctatgtctgctatccctacgtttgacctaggttgggtcgggtaccctagtacaaaggtcttccaaggtcggtacgtaggtaggacttacggtagggaacctaggttactttacgacttctaccgaacctagtaccgacgtactaacctcgtcgtaaccgtaaacctaggtaaacgttagttttacgaacctttaaacctttacgtaacgttcgtaaccgtaaaacgttacggttaaattaaaccgttagtttaaaccggttttaggtttaactttttaccgttaaacccgttttccccgggtaacccgtttaaccggggtaacccgtaaagggttaacccggtaacttaacccggttaaccgtaaaaccggttacgtttacgggtaccggtaccctacgg

SEQ ID NO: 271456 - DNA, 515 bp, Homo sapiens
  misc_feature: GYAE6OF01A1S0O.40.43.D10.1.454.CMB.1.raw
  modified_base (335)..(335): a, c, t, g, unknown or other
  misc_feature (335)..(335): n is a, c, g, or t
  modified_base (478)..(478): a, c, t, g, unknown or other
  misc_feature (478)..(478): n is a, c, g, or t
tcagtctagcgactcacgaccggtgctcgatttagactagcagtaaggggagagaggagcccagccctgggattttcaggtgttttcatttggtgatcaggactgaacagagagaactcaccatggagtttgggctgagctggcttttcttgtggctattttaaaggtgtccagtgtgaggtgcagttgttggagtctggggaggcttggcacagcctgggggtcccgagactctcctgtgcagcctctggattcgcctttcagaactctgccatgcactgggtccgccagcctccaggggaagggctggagtgggtctcgaggtattcggggtnatgggtactgacacatactacgcagactctgcgaaggccgttcaccatctccagagacatttccaagaacacactctatctgcaaatgaccaactcagaggcgaggacacggccatatatactgtgcgaaaggtgtagactangaccacgtgggccagggaaccctggccaccgtctccc

SEQ ID NO: 271457 - DNA, 510 bp, Homo sapiens
  misc_feature: GYAE6OF01DZ4TF.40.43.D10.1.454.CMB.1.raw
  modified_base (196)..(196): a, c, t, g, unknown or other
  misc_feature (196)..(196): n is a, c, g, or t
  modified_base (480)..(480): a, c, t, g, unknown or other
  misc_feature (480)..(480): n is a, c, g, or t
  modified_base (506)..(506): a, c, t, g, unknown or other
  misc_feature (506)..(506): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaanagccaccctctcctgcagggccagtcagagtgtcggcaccttcttagcctggtaccaacagaagcctggccaggctccaggctcctcatttatgaagcgtcgaacagggccactggcatcccagccaggttcagtgccagtggtctgggacagacttcactctcaccatcagcagcctagagcctgaagtattttgctaactttattactgtcaccagcgtagcagctggcctcgacgttcgacagggaccaaggtgacatcaagcgaactgtggctgcacctntctgtccttcacttccttcccgcctntccg

SEQ ID NO: 271458 - DNA, 616 bp, Homo sapiens
  misc_feature: GYAE6OF01C5M13.40.43.D10.1.454.CMB.1.raw
  modified_base (296)..(296): a, c, t, g, unknown or other
  misc_feature (296)..(296): n is a, c, g, or t
  modified_base (385)..(385): a, c, t, g, unknown or other
  misc_feature (385)..(385): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggcttaattttaaaaggtgtccagtgtgaggtgcagttgttggagtcgtgggggagcttggcacagccgtggggggtcccgagactctcctgtgcagcctctggattcgcctttcagaactctgccatgcacgtgggtcccnccagccctccgagggaaggggctgggagtggggtctcgagggttagttcgggggtgagtgggtactggaccacatactacgcagacctncggacgaacgggcccgttacaccatcctaccagacgactactttaccaaagaacacactctaatctacgacaaatcgaacccaacctacgaacgacggaccggaacggaaccgaaccgggtaccaattaacgttaacttacgtgttacggacggtaaagggtggtacgtaactagtacgaccgacgtcggggaccgtaacgggaacccgtggtacccgaccgtcctacccg

SEQ ID NO: 271459 - DNA, 750 bp, Homo sapiens
  misc_feature: GYAE6OF01BFO9B.40.43.D10.1.454.CMB.1.raw
  modified_base (145)..(145): a, c, t, g, unknown or other
  misc_feature (145)..(145): n is a, c, g, or t
  modified_base (211)..(211): a, c, t, g, unknown or other
  misc_feature (211)..(211): n is a, c, g, or t
  modified_base (484)..(484): a, c, t, g, unknown or other
  misc_feature (484)..(484): n is a, c, g, or t
  modified_base (737)..(737): a, c, t, g, unknown or other
  misc_feature (737)..(737): n is a, c, g, or t
tcagtctagcgactcacgaccggtgctcgatttagactagcagtaaggggaggggaactagctcagttaggtacccgacgaggggaaccatggaaggacccacgctcagcttctcttcctcctgctactctggctcccacgaaanaccggagaaattcgtagttagacacagtctccaggcaccctgtctttcgtacctcgaggggtaaangtcccacccgtaggtacctgccacgggcctagtcaggaggtcgtacggcaccgtttcgttaggcctggtaaccaacaggtaacgccgtaggacccaggcctacccgaggccgttccctacgtacttttacgacggaacgtcccgttacgaaactacgggggtaccctagttcgggaccaacgttccccgaaggtcccgaacggtttcacggttcgacccaagggttcggggtacgtggggacaggtacttcgacgttctacgacctatcgacncacgacctagacgtcctagaacgtactttcgacttaacttttagtacgtgttacctacgttagtacgtttaagtacctagtccgtacgggtaccctacggttaacgtttcccggaaccgtacggggaacccgtaggttaccgggaacgttaacggtaccgaacggacggtaaaccggtcgggacggttacgacgtacccgaaccggtacttcggttacggttcccttaccgtacgttacccgtttccccggtntacggtttacccg

SEQ ID NO: 271460 - DNA, 812 bp, Homo sapiens
  misc_feature: GYAE6OF01EBMA8.40.43.D10.1.454.CMB.1.raw
tcagtctagcgactcacgaccggtgctcgatttagactagcagtaaggggaggggaactggctccagttaggacccagaagggaaccgagtggtaacgccctaggctcagcttctccttcctacctgctacgtctggcctccaggaaaactccgggacgtaaattacttgggttttcgactacacgttctttaccgagggtcaccctgttcttttgtcgtccgaggggaaagcgtccgtacccgtcgttccgtggggcgacggggtccgtacgtcgacggtagggtcggttccggctaccttcttaggcccttgggtaccaacaggaacgtcctgggaccaggcctcccgtaggaccttccctatagtttacagtaaggccgtaccgaacggacgggcccaacggtcgggacccaggtccccgaagggtcccgtaaggggtttcgagggttcggcccgtaaggggtttcgggtttcggttagggggaactagggtaacttttacaacgttaccttacaacctagtccgaaggtaccgtacggtaccgtaagggaccgtaccttacgaacgttacttttcgaccttaacgttttaacttaacctttactaaccgaaggtacgttaacgttctaacgtccgttacggaccttaggtaaccggtacggtaccggtaaaccgggtaccggaaaggggtacggtaaccggtaacgtaccgaacgggtacgttaacgttggtacgttacgtcggtacctaccgtagttccgtagttcgttacgtacgttacccgttacccggtacctggtcggtaacg

SEQ ID NO: 271461 - DNA, 606 bp, Homo sapiens
  misc_feature: GYAE6OF01CG3G6.40.43.D10.1.454.CMB.1.raw
  modified_base (172)..(172): a, c, t, g, unknown or other
  misc_feature (172)..(172): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcggtgtgtttctaggtggctaatttaaaaggngtcagtgtgaggtgcagttgttggagtcgtggggaggcttggcacagccgtgggggtcccgagactctcctgcgcagcctctggattcgcctttcagaactctgccatgcactcgggccgccagcctccgagggaagggctggagtgggtctcgaggtnttcggggntatgggtactgacanatacgtacgcaagtcctgtgacggtaacgggccgtttacactaatctaccgagacgactaactttccaaacgaacacacttcctaagttccagacaaactcgaaccaactacaaggacgcggaacggacaccgggtacaattaattaacttacgagttacggaacggtaaaggtaggttcgaactaagtacggacccacgggttaccgggaccgaaccggggtaaccctggtacccgaccgtccgttacccg

SEQ ID NO: 271462 - DNA, 563 bp, Homo sapiens
  misc_feature: GYAE6OF01EM1FX.40.43.D10.1.454.CMB.1.raw
  modified_base (490)..(490): a, c, t, g, unknown or other
  misc_feature (490)..(490): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttattttaaaaggtgtccagtgtgaggtgcagttgttggagtcgtggggggaggcttggcacagccgtggggggtcccgagactctcctgtgcagcctctggattcgcctttcagaactctgccatgcacgtgggtcccgccagccctccgaggggagggctgggagtgggtctcgagggttagttcggggtgagtggtactgacacatactacgcagctctggcggaacgggccgttacacctatcctccagacgactatttaccaaagacacactctatctagacaaatcgaaccaactcagaggcgaggacacggccatatacttacngtgacgaaaggtggtagacttagcgaccgacgtcggggaccctaaggggaacccctgggtcccaccgtctccg

SEQ ID NO: 271463 - DNA, 502 bp, Homo sapiens
  misc_feature: GYAE6OF01ACMVL.40.43.D10.1.454.CMB.1.raw
  modified_base (481)..(481): a, c, t, g, unknown or other
  misc_feature (481)..(481): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgctactttatactgtcaccagcgtagcagctggcctcgaacgttcggaccaagggaccaaggtgacatcaagcgaactgtggctgcacntctgtcttcatcctccncntc

SEQ ID NO: 271464 - DNA, 572 bp, Homo sapiens
  misc_feature: GYAE6OF01DCGEW.40.43.D10.1.454.CMB.1.raw
  modified_base (297)..(297): a, c, t, g, unknown or other
  misc_feature (297)..(297): n is a, c, g, or t
  modified_base (351)..(351): a, c, t, g, unknown or other
  misc_feature (351)..(351): n is a, c, g, or t
  modified_base (524)..(524): a, c, t, g, unknown or other
  misc_feature (524)..(524): n is a, c, g, or t
  modified_base (560)..(560): a, c, t, g, unknown or other
  misc_feature (560)..(560): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggctttttctgtggcttaattttaaaaggtatccagtgtgaggtgcagttgttggagtcgtgggggagcttggcacagccgtggggggtcccgagactctcctgtgcagcctcgtggattcgcctttcagaactctgccatgcacgtgggtccnccagccctccgaggggaaggggctgggagtgggtctcgaggttagttcggggtnagtggtactggacacatactacgcagactctgcgaacgggccgttcacctatcctaccagacgactaactttaccaaacgaacacaactctactctagactaaatcgaaccaacctcagacggacgaggacacggcctaatactattactgtgacgaaaggtggtagacgtancgaccacggtcgggaccgacgggaaccctggtaccnccgtcctacccg

SEQ ID NO: 271465 - DNA, 559 bp, Homo sapiens
  misc_feature: GYAE6OF01BQ1YS.40.43.D10.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccgaggggaaanagccaccctctcctgcagggccagtcagagtgtcggcacttctagcctggtaccaacagaagcctggccaggctcccgaggctcctcatttangaagcgtacgaacagggccactggcatcccagccaggttcagtcgccgaggtgggtctggggaactaggacttcacttctcaccatcagcagcctagacgcctagaagtattttgacttactttattactgtaccactagcgtagcagctggcctacggaacgttcggaccgtaacgggaccgaagggtcgaactatacgaagcgtaacgtcggtaggcgtcgaccactacgttctacgttcttaccacttccctttcccgcctatacg

SEQ ID NO: 271466 - DNA, 714 bp, Homo sapiens
  misc_feature: GYAE6OF01BQ7KH.40.43.D10.1.454.CMB.1.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (417)..(417): a, c, t, g, unknown or other
  misc_feature (417)..(417): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggtcttttctgtgctatttaaaggtgtcagtgtgaggtgcagttgttggagtcgtgggggagcttggcacgagccctggggggtcccgagacctctccgtgtgcagcctntggatcgcctttcagtaactctgccatgcacgtcgggtccnccagccctcgaggggacgggctggagtggtctcgaggtagttcggggnagtggtactgacgacactacgtacgacaaggccttcgtcgggaccggtaacggggtcccggttaccaaacccgtnttacccgtaccgacgtaacgtacctaacgttttacccgaaaacgtaaaccaccgtaaccttaccttaactccgtacgtaacctaaagttacggaacccctaaaccgtacgaaggtacgggaacggtaacgggaccgaaccgggtacctaagttaacgttaacgttaaccgtacggttaacggtaaccgggttaaagggtcgggttacgtaaccgttaggtaccggaacccggtacgggtaccggggaccgaaaccggggttaccccgtagggttcccgtacccggttcgttaccccg

SEQ ID NO: 271467 - DNA, 600 bp, Homo sapiens
  misc_feature: GYAE6OF01EY4T9.40.43.D10.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaangccaccctctcctgcagggccagtcagagtgtcggcaccttcttagcctggtaccaanagaagcctggccaggcctcccgaggcctcctcatttatgaacgcgtacgaacagggccacgtggcatcccagcctaggttcagtcgcctaggtgggtctgggacagtacttcactctcacatcagcagtcctagacgtccgtagtaagtattttgactactttatactgtctaccgagtcgtagctacgtcgtcggtcctacggaacgttccggaccgaacggggaccgtaagggttacggaacaacgtacgaacggaccgtaacgtggtcggacgtcggaccaaccgtacgttccgtacgttacctttaccgtacttaccccgtttccccgtcctacgttacccg

SEQ ID NO: 271468 - DNA, 729 bp, Homo sapiens
  misc_feature: GYAE6OF01CVJH0.40.43.D10.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (235)..(235): a, c, t, g, unknown or other
  misc_feature (235)..(235): n is a, c, g, or t
  modified_base (290)..(290): a, c, t, g, unknown or other
  misc_feature (290)..(290): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcacctgtctttgctcgaggggaaangccacctntcctgcagggccagtcagagtgtcgctaccttntagcctggtaccaacgagaacgcctggccaggcctccgaggctcctctattttangaagtcgtacgaacgagggccacgtggacacgtcccgagtcctagggttccaggtcgccgagggttcgggtctacggggacaggtacctttcgacttctacaacctatcgagcaacggtacctaaggacgtccgtaaggtaaacgtttacgttttacgacctttaaacttttaacgtttaaccgttacgttacccgtaaaccgtacggtacggttaacgaccgtaacggtccgttaccgggtacccgttaaccgggtaaaccgggtttcccgggaaacccgggtaaaccgggggtaacccgtaaacggggttacggaaccttaacggtaccggtaaacggaaccggttaaaccgtcgggtacggtaccgtacggtaccctaaccgtacgttccgtacgtttaccttaccgtactttcccgtacccgccttacgttaccg

SEQ ID NO: 271469 - DNA, 550 bp, Homo sapiens
  misc_feature: GYAE6OF01BG38D.40.43.D10.1.454.CMB.1.raw
  modified_base (168)..(168): a, c, t, g, unknown or other
  misc_feature (168)..(168): n is a, c, g, or t
  modified_base (342)..(342): a, c, t, g, unknown or other
  misc_feature (342)..(342): n is a, c, g, or t
  modified_base (538)..(538): a, c, t, g, unknown or other
  misc_feature (538)..(538): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtgcttttctagtggctatttaaaggngtccagtgtgaggtgcagttgttggagtctgggggagcttgggcacagcctggggggtcccgagactctcctgtgcagcctctggattcgcctttcagaactctgccatgcactgggtccgccagccctccgaggggaagggctgggagtgggtctcgagggtattcgggggtnagtgggtactgacacatactacgcagactgtgcggaaagggccgttacaccgatcctaccgagacgactactttaccaaagtaacacactctatctgacaaatcgaccaactcagaggacgaggacacggccatatatactgtgacgaaggtggtagactagcgaccacgtcggggacctacgggaccctggtccnccggtctacccg

SEQ ID NO: 271470 - DNA, 551 bp, Homo sapiens
  misc_feature: GYAE6OF01AUK01.40.43.D10.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (237)..(237): a, c, t, g, unknown or other
  misc_feature (237)..(237): n is a, c, g, or t
  modified_base (301)..(301): a, c, t, g, unknown or other
  misc_feature (301)..(301): n is a, c, g, or t
  modified_base (386)..(386): a, c, t, g, unknown or other
  misc_feature (386)..(386): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgctccaggggaaangccaccctntcctgcagggccagtcagagtgtcggcaccttnttagcctggtaccaacagaagcctggccaggctcccaggctcctcatttatgaagcgtcgaacngggccactggcatccagccaggttcagtgccagtggtctgggacagacttcactctcaccatcagcagcctagcgcctagaagtntttgctactttattactgtacaccagccgttagcctagcttacggccctacgaacggttcgaccgtaacgggaccgtaaggtggacagtacgaacggcgaacgtgtagggtctggccaccagttccgttacgttcttccaacttccgttcccgccgtagttaccg

SEQ ID NO: 271471 - DNA, 744 bp, Homo sapiens
  misc_feature: GYAE6OF01DWAK5.40.43.D10.1.454.CMB.1.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
tcagtctagcgactcacgaccggtgctcgatttagactagcagtaagggggaggaactgctcagttaggacccagagggaaccatggaagcccagctcagcttctcttcctcctgctactctggctcccagaaaacaccggagaaattctgttgacacagtctccaggcacctgtctttgtctccaggggaanagccaccctctcctgcagggccagtcagagtgtcggctaccgtttcttagcctggtaaccaacagaacgcctggccaggcctcccgaggcctcctnattttacnggaagcgtcgaacgnggccacgtggacactcccgagccgtaggttcagtcgcctaggtcgggtctggggacagtacttcacgttctacgaaccctatccgacgtcacggtacccttaagggacgtaccgtaggtaaacgttactttttacgggaccttaactttttaacgtttaacgtcggtttaacctaaacccgtacgggtaccggtttaacggccgtaacggtcccgtttacgggtaccccgttacgggtaaacccgggtttaccgggacccggtaaaaccggggaacccgtaaacggggttacgggaaccgtaagttaccgaaaggtaccggtaaaccggttcgggtacggtaccgttacggaccgtaacccgtaagtttcccgttcggtttacctttaccgtaaccgtttccctttaccccggtcccgttaacgttacccgg

SEQ ID NO: 271472 - DNA, 582 bp, Homo sapiens
  misc_feature: GYAE6OF01EMO21.40.43.D10.1.454.CMB.1.raw
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
  modified_base (352)..(352): a, c, t, g, unknown or other
  misc_feature (352)..(352): n is a, c, g, or t
  modified_base (404)..(404): a, c, t, g, unknown or other
  misc_feature (404)..(404): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggtcgttttcttaggtggctattttaaaagggtgtccagtgtgaggtgcagttgttggagtctggggggagcttggcacagcctggggggtcccggagactctcctgtgcagcctntggattcgcctttcagaactctgccatgcactgggtccnccagccctccgaggggaaggggctgggagtgggtctcgaggttattcgggggtnatgggtactgacacatactacgcagactcgtgcgaagggccgttcaccatcnccagagacatttccaagaacacactctatctgacaaatcgaacccaactcagaggcgaaggaccacgggaccaattactattacgtgtgacggaaagggttggtagacttagtacggaccctacggtgggggacccctaaggggaaccccttgggtaccctaacccgttcctaccccg

SEQ ID NO: 271473 - DNA, 635 bp, Homo sapiens
  misc_feature: GYAE6OF01DNCQQ.40.43.D10.1.454.CMB.1.raw
  modified_base (368)..(368): a, c, t, g, unknown or other
  misc_feature (368)..(368): n is a, c, g, or t
  modified_base (555)..(555): a, c, t, g, unknown or other
  misc_feature (555)..(555): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagttgtggagtcgtgggggagcttggcacgaggccgtggggggtcccggagactctcctgtgcagcctcgtggattccgcctttcagaacctctcgccatcgccacgtcgggtcccgccagcccgtaccggaggggaacggggctgggaggtcgggtctcgagggttagttcggggtntagttggtactgacacactaactacgcaacgctcgtggacggaacgggtcccggttacaccgtatccgtaccgagaacgtaacctactttaccaaagaaccaacctacctactaatcgtacgaactaaactcgaaccctaacctcgaaggacggcgaaggaccacggacctaagttacttattacgngtagacgtaaaggtgtacggactagacgacccgtacggacgggacccgtaacgggacccttaggcctcccgttctacccg

SEQ ID NO: 271474 - DNA, 600 bp, Homo sapiens
  misc_feature: GYAE6OF01CICVL.40.43.D10.1.454.CMB.1.raw
  modified_base (193)..(193): a, c, t, g, unknown or other
  misc_feature (193)..(193): n is a, c, g, or t
  modified_base (283)..(283): a, c, t, g, unknown or other
  misc_feature (283)..(283): n is a, c, g, or t
  modified_base (297)..(297): a, c, t, g, unknown or other
  misc_feature (297)..(297): n is a, c, g, or t
tcagtctagcgactcacgaccggtgctcgatttagactagcagtaagggggaggaactgctcagttaggacccagagggaaccatggaagcccagctcagcttctcttcctcctgctactctggctcccagaaaacaccggagaaattctgttgacacagtctccaggcacctgtctttgctcgaggggaaangccacctctcctgcagggccagtcagagtgtcggctacttcttagcctggtaccaacagaagcctggccaggctccaggctctcatttangaagcgtacgaacngggcctacgtggcactcccagccagggttcagtcgccgtaggtcgggtctaggggaactaggtactttcaactctacacctatcaagccaagccctaagacgtcctagaagtattttgcttaactttattactgtacacagccgtagcagtctcggtctacgtaacgttccggaaccgaacgggaaccgtaagggtacggaacaacgtacgaaaggaccgtaacgtaggtcggaccgtacggcaacctacgttcgttacgtttccgttactaacgtttacccttcccggtcctacgttaccgg

SEQ ID NO: 271475 - DNA, 653 bp, Homo sapiens
  misc_feature: GYAE6OF01C839D.40.43.D10.1.454.CMB.1.raw
  modified_base (293)..(293): a, c, t, g, unknown or other
  misc_feature (293)..(293): n is a, c, g, or t
  modified_base (347)..(347): a, c, t, g, unknown or other
  misc_feature (347)..(347): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctattttaaaaggtgtccagtgtgaggtgcagttgttggagtcgtgggggagcttggcacagccgtggggggtcccgagactctcctgtgcagcctctggattcgcctttcagaactctgccatcgcactgggtccnccagccctccgaggggagggctgggagtgggtctcgagggttagtttcgggggnagttcgggtactgaacacatactacgcagactcgtggacgaaggggcccgttacaccctatcctaccgagacgtacctaacttttacccaaacgtaaacccactaacgttactacttctacggaccaaatccgaaccctaacctaccgaaggtacgggacgaacgggaccaaccgggtacctaattaacgttaacgttactaggtacgtaacggtaaagggttcggtacggtaacgtagtacggaaccctacggtacggggacccgtaacggggtaacccctgggtacccacccggttcctacccg

SEQ ID NO: 271476 - DNA, 563 bp, Homo sapiens
  misc_feature: GYAE6OF01BAWVH.40.43.D10.1.454.CMB.1.raw
  modified_base (350)..(350): a, c, t, g, unknown or other
  misc_feature (350)..(350): n is a, c, g, or t
  modified_base (380)..(380): a, c, t, g, unknown or other
  misc_feature (380)..(380): n is a, c, g, or t
  modified_base (398)..(398): a, c, t, g, unknown or other
  misc_feature (398)..(398): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtcgtgggggaggctttgggcacagccgtggggggtcccggagactctcctgtgcagcctctggattcgcctttcagaactctgccatgcacgtggtccgccagccctccaggggaacgggctggaggtcgggtctcgaggttagtcggggtnagtggtactgacacatactacgcagactcngacgaaggccgttcaccntcctcagacgactacttaccaaagaacacactactatctgacaatcaaccaactcagacgacgacgacacgtaccatatagtactgtacgacgaaaggtgtacgtacgtatacggacctacggtcgggaccaacgggtaccctaggtccctaccgtccgtacccg

SEQ ID NO: 271477 - DNA, 619 bp, Homo sapiens
  misc_feature: GYAE6OF01BF4BQ.40.43.D10.1.454.CMB.1.raw
  modified_base (172)..(172): a, c, t, g, unknown or other
  misc_feature (172)..(172): n is a, c, g, or t
  modified_base (252)..(252): a, c, t, g, unknown or other
  misc_feature (252)..(252): n is a, c, g, or t
  modified_base (291)..(291): a, c, t, g, unknown or other
  misc_feature (291)..(291): n is a, c, g, or t
  modified_base (336)..(336): a, c, t, g, unknown or other
  misc_feature (336)..(336): n is a, c, g, or t
  modified_base (394)..(394): a, c, t, g, unknown or other
  misc_feature (394)..(394): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtgtcgtttctaggtggctaattttaaaggngtcagtgtgaggtgcagttgttggagtctgggggagcttggcacagccgtggggggtcccgagctctcctgtgcagcctntggattcgcctttcagaactctgccatgcactgggcccncacgcctcgaggggaggctggagtggtctgtaggttgtcggggtnagtggtactgacacatacgtacgcagactcgtaggacggtaacgggtccgttacactntcctacgagacgtactacttaccgaaagaacactactactatctagactaaagtcgaacctaaccgtacgaacggacggacgaacggtaccgaccgtactaattaatacgttacgtaggtacgaacggtaaagggtcggtaagtacgtaagtacggtaacccgtacgggtaccgggaccgtaaaccggggtaacccgttacggtaccctacccggttcctacccg

SEQ ID NO: 271478 - DNA, 540 bp, Homo sapiens
  misc_feature: GYAE6OF01DTJHF.40.43.D10.1.454.CMB.1.raw
  modified_base (197)..(197): a, c, t, g, unknown or other
  misc_feature (197)..(197): n is a, c, g, or t
  modified_base (240)..(240): a, c, t, g, unknown or other
  misc_feature (240)..(240): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
  modified_base (510)..(510): a, c, t, g, unknown or other
  misc_feature (510)..(510): n is a, c, g, or t
  modified_base (534)..(534): a, c, t, g, unknown or other
  misc_feature (534)..(534): n is a, c, g, or t
  modified_base (537)..(537): a, c, t, g, unknown or other
  misc_feature (537)..(537): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccgaggggaaanagcccaccctctcctgcagggccagtcagagtgtcgcaccttntagcctggtaccaacagaagcctggccaggcctcccgaggctcctcattttangaagcgtcgaacngggccagtggcactcccagccaggttcagtgccaggtgggtctggggacagtacttcactctacacatcagcagcctagacgtcctagaagtattttcgacttacttttattactgtaccaccagtcgtagcagtctcggcctacgtaacgttccggacgaacgggaccagggtcgacagtcaagcgtacgtgtgctgacactntcgtgttccttctactccttcccnctntcg

SEQ ID NO: 271479 - DNA, 607 bp, Homo sapiens
  misc_feature: GYAE6OF01A2RXN.40.43.D10.1.454.CMB.1.raw
  modified_base (292)..(292): a, c, t, g, unknown or other
  misc_feature (292)..(292): n is a, c, g, or t
  modified_base (348)..(348): a, c, t, g, unknown or other
  misc_feature (348)..(348): n is a, c, g, or t
  modified_base (399)..(399): a, c, t, g, unknown or other
  misc_feature (399)..(399): n is a, c, g, or t
  modified_base (498)..(498): a, c, t, g, unknown or other
  misc_feature (498)..(498): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtctgggggagcttggcacagccgtggggggtcccgagactctcctgtgcagcctctggattcgcctttcagaactctgccatgcactgggtccnccagccctccgaggggaacggggctgggaggtgggtctcgagggtattcgggggtnagtggtactggacacatactcgcagctctgcggaacgggccggttcacctntcctccagacgactacttaccaagaacacactctatctagacaaactcaaccctaacctcgaagacggccgaaggaccacggacctataactagttacnggtagacggaaaagggttggtacgtaacgttagtacggaacccgacgggtcggggaccccgtaaacggggtaaccccttggggtaacccctacccggtcccttaccccg

SEQ ID NO: 271480 - DNA, 805 bp, Homo sapiens
  misc_feature: GYAE6OF01CYVRX.40.43.D10.1.454.CMB.1.raw
  modified_base (196)..(196): a, c, t, g, unknown or other
  misc_feature (196)..(196): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgctccgaggggaaanagccaccctctcctgcagggccagtcagagtgtcggctaccttcttacgcctaggtaccaacagaacgcctggaccaggcctacccgaggtcctcctctaattttagaggaacgtccgtacggaaacgacgggggccaacgtcgggccaacgtccccgaggtccctaagggtttccaaggtcgcccgtagggttcggggtctaggggactacggtacctttcaaccgttctaccacctagtccgacgacctaggtacccttaaggacgtacccttaggtaaacgttacgttttttacgacctttaacttttaacgtttaaccgttacggttaccctaaacccggtacggttacccggtttaacggccgtaacggttccgtttaccgggtaccccgttaccgggttaaacccgggtttcccgggaacccgggtaaaaccgggggtaaccccgtaaagggggttaccggaaaccgtaacggtaaccggaaaccggtaaccggttaacgtacgggttacgggaccgtaccgggtacctaacccgtagttcccgttacgtttacccgtttacctaacccgtttccccgtttacccccgccgttacgttaccgg

SEQ ID NO: 271481 - DNA, 823 bp, Homo sapiens
  misc_feature: GYAE6OF01EVVND.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcacatggagtttggctgagctggtcttttctgtggctaattttaaaaggtgtccagtgtgaggtgctagttgttggagtcgtgggggagcttggcacaggccgtggggggtcccgagacctctccgtgtgccagcctcgtggtacttccgtcctttacaacgtaacctctcggaccctaagttcgacctaccggtcggggtccccgccacggtcccctaccggaaagggggaacggggccgttagggaacggttggggttaccctcggtagggttacggtttcggggggtataaggttcgggttactacggaacctaacgtaacgttaaaccgtacccgggcaaaggtacccgtccgtacgggaccgggtaaacggggtccccggtttaccaaccgttactaccgtacccgaagaacgtaactaacgtttaccaaaagtaaccctacgtactacgtactaccgtagaaacctaaagttacccgaaacctaacccgtacgacgggtaacggtccggaaaacggaacccggtaaccggtaaccttaaacgtttaaacgttaacccgtttagttaccgggtaacggtaaccgggttaaaagggtcgggttaaacgtaaaccgttacgtacggtaaacccccgagggttaccgggaacccggtaaccgggtaaccccttgggtaccccgttaccgtccccgtaacccg

SEQ ID NO: 271482 - DNA, 545 bp, Homo sapiens
  misc_feature: GYAE6OF01BR448.40.43.D10.1.454.CMB.1.raw
  modified_base (399)..(399): a, c, t, g, unknown or other
  misc_feature (399)..(399): n is a, c, g, or t
  modified_base (512)..(512): a, c, t, g, unknown or other
  misc_feature (512)..(512): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttctagcctggtaccaacagaagcctggccaggctcccaggcctcctcatttatgaagcgtacgaacaggggccacgtggccactcccagcccaggttcagtgccgagtgggtctgggacagtacttcactctcacatcagccagcctagacgcctagaagtnttttgctactttattactgtcaccgagtacgtagcagctcggcctcgaacgttcggaccgaacgggaccgtaaggtcggacagtacaagccgaactggtggcgtcgacacctntccgtgtccttcacttccttcccgtctagtccg

SEQ ID NO: 271483 - DNA, 582 bp, Homo sapiens
  misc_feature: GYAE6OF01BKS7A.40.43.D10.1.454.CMB.1.raw
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggcttaattttaaaaggtgtccagtgtgaggtgcagttgttggagtcgtgggggaggcttggcacaggccgtgggggggtcccgagactctcctgtgcagcctctggattcgcctttcagaactctgccatgcacgtgggtccnccagcctccgaggggagggctggagtgggtctgaggtagttcggggtnagtggtactgacanatactacgcagctctgcgaagggccgttacacctatcctacagacgtactactttaccaaagaaccacactctactctacacaaacgtcaacccaacctacgaagacggcgaacggaccgacggtaccattatattactgtggacgaaagggtggtacgacgtatacgaccgtacggcgggacccgtaacggggaccctcgggtacctacccgtcgtcccg

SEQ ID NO: 271484 - DNA, 667 bp, Homo sapiens
  misc_feature: GYAE6OF01D0FRC.40.43.D10.1.454.CMB.1.raw
  modified_base (145)..(145): a, c, t, g, unknown or other
  misc_feature (145)..(145): n is a, c, g, or t
  modified_base (200)..(200): a, c, t, g, unknown or other
  misc_feature (200)..(200): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccaagaaaacaccgganaaattctgttgacacagtctccaggccaccctgtctttgtctccgaaggggaaancgcccaccctctcctgcgagggccagtcagagtcgcggctaccttctagcctaggtaaccaacgaaggacgccgtggccaggcctcccgaggcctcctactatttagagaacgtcggtacgaacgacgggccacgtcggccacgtcccgagccgtacggttcacgtcgaccgtaggtcgggtcgtaggggacacggtacttcactcaccacatccagacacgtccgtagacgtccgtagtaacgtttacttttgactttactttacttacttacgtacctacgtagtacgtagtcgtaggtccgtacgggtcctaccggtaacggtaccgggtaccggaaacgggtaccggtaacgggtacgtaacgtacgtaacggaacgaccgtaacgtggtacggtacgtccgactacccgtacgttacgttgttcccgttacttaccctaccgtttcccctcctaggttaccg

SEQ ID NO: 271485 - DNA, 700 bp, Homo sapiens
  misc_feature: GYAE6OF01CXRLN.40.43.D10.1.454.CMB.1.raw
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaacaccgagaaattctgttgacacagtctccaggcaccctgtctttgtctccgaaggggaanagcccaccctctcctgcgagggccagtcagagtgtcggctaccttctagcctggtaaccaacgagaacgcctggccaggcctacccgaggctcctactatttanagaagcgtacgaacgagggccagtggctactcccagccaggttcagtgacccgtaggtcgggtctaggggacacggtacttcaaccttctaccaacctatccgacggacacggtacctaaggacgtcctaaggtaacgttagttttacgacttaacttttagttactagttaccaccgagtacgtaacgctaagtccgttacggcccttaacgggtaaccggtttaccgggaacccggtaaacggggtaacccggtaagggtaccgggtaaactaacgttaccgaaagggtaacccgtaaacgggttcggtacgggtacctacgggtaccctaaccgttaaccgttccgttacggttaccttaccgtaccgttcccgtttcccccggacttacgttaaccg

SEQ ID NO: 271486 - DNA, 645 bp, Homo sapiens
  misc_feature: GYAE6OF01BYVJB.40.43.D10.1.454.CMB.1.raw
  modified_base (263)..(263): a, c, t, g, unknown or other
  misc_feature (263)..(263): n is a, c, g, or t
  modified_base (320)..(320): a, c, t, g, unknown or other
  misc_feature (320)..(320): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (412)..(412): a, c, t, g, unknown or other
  misc_feature (412)..(412): n is a, c, g, or t
  modified_base (491)..(491): a, c, t, g, unknown or other
  misc_feature (491)..(491): n is a, c, g, or t
  modified_base (581)..(581): a, c, t, g, unknown or other
  misc_feature (581)..(581): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtgtcgttttctaggtggcttaagttttaaaggtgtccagtgtgaggtgctagttgttggagtcgtggggagtcgttggacacgaggcccgttggggggtacccgagccttctccgttggtnacgtcgcctgtaggtcttccgtctttcgagaacctctcgcctatgcctcgtcggccncacgccgtccgaggggacgtcgtggaggtggtcctgaaggttcggttgggntagtcggtacnggaacacgatacgtacgacaaggccttggngacgggaacggttcccgtacacctacgttcacgaagctaactacttaccgaaactaactactagttcccattaccgtanactaacaccgaacctacagacggacgacgagacccgaacgtacatttaacgtacctgtacgtaggtaacgaaaggtttgaaacgtacgtnacgaaccgtacggttccgggaaccgttaaaccggtcctaccggtacctacggtcccctaacccg

SEQ ID NO: 271487 - DNA, 681 bp, Homo sapiens
  misc_feature: GYAE6OF01AUU1J.40.43.D10.1.454.CMB.1.raw
  modified_base (198)..(198): a, c, t, g, unknown or other
  misc_feature (198)..(198): n is a, c, g, or t
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
  modified_base (411)..(411): a, c, t, g, unknown or other
  misc_feature (411)..(411): n is a, c, g, or t
tcagtctagcgactcacgaccggtgctcgatttagactagcagtaaggggggaggaactgctcagttaggacccagagggaaccatggaagccccagctcagcttctcttcctcctgctactctggctcccagaaaacaccggagaaattctgttgacacagtctccaggcaccctgtctttgtctccgaggggaaangcccaccctctcctgcagggccagtcagagtgtcggctaccttcttagcctggtaaccaanagaacgcctggccaggcctcccgaggcctcctctatttangaacgcgtacgaacgagggccacgtggcactcccagccaggttcagtcgccaggtgggtctggggacagacttcactctcacatcgagcacgcctagacgtccgtagaagtntttcgacttacgttttacttacgttgtacctaaccgtagtaccggtagaccgtacggtaccgtcggtacccgtacggtaaccggtttccggaacccgggtaacggggtaacccgtaaggggttacggaaccgtaacgtaccgaaacggtaccggtaaccggttacgggtacgggtaccgtacggacccgtaacccgtacgttaccggttacggtttacccttaccgttacccgtttaccccgtttcccccgtccgttaaccgttacccgg

SEQ ID NO: 271488 - DNA, 581 bp, Homo sapiens
  misc_feature: GYAE6OF01B38K7.40.43.D10.1.454.CMB.1.raw
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
  modified_base (292)..(292): a, c, t, g, unknown or other
  misc_feature (292)..(292): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgctccgaggggaaangcccacctctcctgcagggccagtcagagtgtcggctaccttcttagccttggtaccaanagagcctgaccaggcctccgaggctcctctatttangaagcgtacgaacgagggccacgtggcactcccgagccaggttcagtcgccgaggtcgggtctggggactagacttcactctaccacatcagcagcctagacgctagaagttatttcgacttactttattacgtgtaccacagtcgtagcagctcgctacggtacgtcgacgaacggaccgtaaggtcgactacgacaacggcgtaacgtggtacgacgtcgacccgactacgttccgttagttccctttacgtacctttcccgttcccccgtccgtaacgttacccgg

SEQ ID NO: 271489 - DNA, 691 bp, Homo sapiens
  misc_feature: GYAE6OF01CNICJ.40.43.D10.1.454.CMB.1.raw
  modified_base (618)..(618): a, c, t, g, unknown or other
  misc_feature (618)..(618): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttattttaaaaggtgtccagtgtgaggtgcagttgttggagtcgtgggggaggcttggcacaggccgtggggggtcccggagacctctcctgtcgcagcctcgtggattccgcctttcagaactcctgccatcgcacgtgggtcccgccacgccctccggaggggaacgggctgggaggtcgggtctcgtagggtagtttcggggtagagtgggtacctgaacacgtaataccgtacgcagtacctcgtggacggaacggggtcccggttacaaccctacgtcccttaccgaaggtacgtaacctaactttacccgaaaagtaaacccaactaccttactatcctagaactaaacgtcgaaaccctaacctacgaaggacggaccgaagggacccaccgggtaccaagttaacttacgttacgtgtacggtaacgtaaagggtggtaacgtacgttaanaccggtaaccgtacgggtacggggacccgtaaaccggggtaccctacgggtaccctacccgtcccgttacccg

SEQ ID NO: 271490 - DNA, 849 bp, Homo sapiens
  misc_feature: GYAE6OF01BYFDC.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggtcttaattttaaaaggtgtccagtgtgaggtgctagttgtggagtcgtgggggaggtcgttggcacgacggccgtcggggggtcccgagacctctccgtgtgcagtcctcgtggtatttccgtcctttcaacgtaactccgtacgcctatcgacctacgtcgggtccccgcccgacggtcccgtacccggaagggggaacggggtccgtaggggaggttcgggttccttacggtaagggttacggtttcggggggtagtacggttacgggttaacgtgaaccgtaactaacgttaaaccgtacggacgtaacgtaaccttccgtacggacgggtaaaccggggtcccggtttacaacccgtactaccgttaccgaacgaacgtaaccttaaccgtttaaccgaaacgaaacctacctaacttacgttaactaccgtaacgaaccttaaacgtaccgaaccctaaaccgtcgaacggaacgggaccggaacggtaacccggaacccgaacccgttaagttaaacgtttaacgttaaccgtagggtaccggtaaacgggttaaacggggttcggtaaacggtaaccttaaggtaccggtacccgaacccggggtttacgggggaaccccgtaaacccggggttaacccccggtacggttaaccccggtaccccggttccccgttaacccccgg

SEQ ID NO: 271491 - DNA, 602 bp, Homo sapiens
  misc_feature: GYAE6OF01E4ZZT.40.43.D10.1.454.CMB.1.raw
  modified_base (292)..(292): a, c, t, g, unknown or other
  misc_feature (292)..(292): n is a, c, g, or t
  modified_base (345)..(345): a, c, t, g, unknown or other
  misc_feature (345)..(345): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctattttaaaggtgtccagtgtgaggtgcagttgttggagtcgtgggggagcttggcacagccgtggggggtcccgagactctcctgtgcagcctctggattcgcctttcagaactctgccatgcactgggtcccnccagccctccgaggggaagggctgggagtggggtctcgaggttattcggggtnatggtactgacacatacacgcagactctggacgaagggtcccgttacacctatcctccagacgaactactttaccaaagaacactactctatctagacaaatcgaacccaacctacagacggcgaacggaccacggaccaattatacttactgtacgacgtaaagggtggtacgtaactataccggtaacccaccggttacggggaccccgtaacggggtaacccccgtgggtaccctaacccggtcccttaccccg

SEQ ID NO: 271492 - DNA, 661 bp, Homo sapiens
  misc_feature: GYAE6OF01CWDFP.40.43.D10.1.454.CMB.1.raw
  modified_base (138)..(138): a, c, t, g, unknown or other
  misc_feature (138)..(138): n is a, c, g, or t
  modified_base (192)..(192): a, c, t, g, unknown or other
  misc_feature (192)..(192): n is a, c, g, or t
  modified_base (233)..(233): a, c, t, g, unknown or other
  misc_feature (233)..(233): n is a, c, g, or t
  modified_base (284)..(284): a, c, t, g, unknown or other
  misc_feature (284)..(284): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacnccggagaaattctgttgacacagtctccaggcaccctgtctttgctcagggaangccacctctcctgcaggccagtcagagtgtcggctaccttntagcctggtaccacgagacgcctggccaggcctccgaggtctctctatttngaagtctacgaacagggccagtgcactcccgagtcgaggttcaggtcgaccgtaggtcgggtctacgggacacgtacttcgactcgtacacctagtccacgtcgacgtcctaagacgtcgtaggtaacgttacgttttgacttaacgtttacttacgttcgtaccaccgtacgtacgtacggacgtacgtccgtacggtccgttacgggtaaccgtttccgggaaccggttaaacgggtacccgtaagggttccggaacctacgttacggaaccgtaccggtaacgttcgggtaggtaccgtacggtaccgtacccgtagtttaccgtcgtttaccgttaccgacgtttacccgttccggaccttacggttacccgg

SEQ ID NO: 271493 - DNA, 588 bp, Homo sapiens
  misc_feature: GYAE6OF01D0TUG.40.43.D10.1.454.CMB.1.raw
  modified_base (361)..(361): a, c, t, g, unknown or other
  misc_feature (361)..(361): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
  modified_base (544)..(544): a, c, t, g, unknown or other
  misc_feature (544)..(544): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtgtcgtttttctaggtggctaattttaaaagggtgtccagtgtgaggtgcagttgtggagtcgtggggggagcttggcacagtccgtggggggtcccggagactctcctgtgcagcctgtggtattcgcctttcagaactctgaccatgcactggccgcagcctcgaggggaagggctgggagtcgggtctcgaggttattcgggggatatcgggtacngacactatactacgctagactcgtagcggaaagggtccggtanaccattccacganacgtaactatttaccaaanaaacacactctaactctagaactaaactgaaccctaaactacaaggaacggacggaacgaccgaacggtccaataacgttattactgcggagtaaaggtgtagactancgacgaccggtgggacctacggaaaccctggcctccgtctcccg

SEQ ID NO: 271494 - DNA, 692 bp, Homo sapiens
  misc_feature: GYAE6OF01E14KB.40.43.D10.1.454.CMB.1.raw
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggctattttaaaaggtgtccagtgtgaggtgcagttgttggagtcgtgggggagcttggcacaggccgtggggggtcccggagacctctcctgtgcacgcctcgtggtattccgcctttcagtaactctgccatgcacgtgggtcccnccacgccctcgaggggagggcgtggagtcgggtctcgaggttagttcggggtntagtgggtactgaccactataacgtacgcacgtactcgtggacggaacgggtcccgttacaccgtactcctaccgaagacgtaaccttacgtttaccaaacgtaaaccaacctaccgttactaacttccgtaacgtaacctaaaacgtccgaaacccctaaacccgtaccgaagggaacgggaccggaacgggaacccgaaccgggtacctaagttaacttacgttaaccgtggtacggaacggtaaagggtggtagtaacgttagaccggacccgacgggtacggggacccgtaaacggggtacccgttcgggtaccctcccggttcctacccg

SEQ ID NO: 271495 - DNA, 709 bp, Homo sapiens
  misc_feature: GYAE6OF01EBYRL.40.43.D10.1.454.CMB.1.raw
  modified_base (295)..(295): a, c, t, g, unknown or other
  misc_feature (295)..(295): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttggctgagctggtctttttcttgtgtctattttaaaaggtgtccagtgtgaggtgctagttgttggagtcgtgggggagtcttggcacagccgtgggggtcccgagactctctgtgcagcctgtgattcgcctttcagaactctcgccatgctacgtcggtccnccagccctaccggagggggaacgggtctggggaggttcgggttctcggtaagggtttacgttcgggggtagtacgttggtactgaccactagtactacgcagtactcgtggaccggtaacggggtcccgttaccaaccgtacttcccgtaccaaggtaacgtaacctaacgtttaacccgaaagtaaaccccaacgtaaccttacttaactcctagtaaaccgtaaactacgaaacccctaaccttacggaacggtaacgggacggaacggaaccaaccgggtacctaagtttattaacgttacgtaggtacggtaaaccggtaaaggggtgtaacgtacttacggtacgaacccgtagggtaccggggaacccgtaacgggtaccccgttaggtaccctaccgtccctacccg

SEQ ID NO: 271496 - DNA, 709 bp, Homo sapiens
  misc_feature: GYAE6OF01CKMLM.40.43.D10.1.454.CMB.1.raw
  modified_base (309)..(309): a, c, t, g, unknown or other
  misc_feature (309)..(309): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggctattttaaaaggtgtccagtgtgaggtgcagttgttgggagtcgtggggggaggcttgggcacgaggccgtggggggtcccggagactctcctgtcgcagcctctggattccgcctttcagaactctgaccatgccacgtcggggtcccnccacgccctccggaagggggaacggggcctggggaggtcggggtcctacggaggggtttagtttcgggggtagtacgtcgggtaacgtggaaccactaagtaaccgtacgacagtactcgtaggacggaacgggtcccggttacaccgtagtcctacgagacgactaacgtttaccaacgaaacctactaacctctactactacgaactaaactcgaaccctaaccgtcgaaggaacggacggacggaccgtaccgggacctaagtacttaacttacgtacggtacgtaacgggtaaacgggttgggtaacgtaacgttaggtaccgaacccggtaacgggtccgggggaacccgtaaacggggtaaccccgtgggtacccctcccggttccgttacccg

SEQ ID NO: 271497 - DNA, 682 bp, Homo sapiens
  misc_feature: GYAE6OF01BBF5N.40.43.D10.1.454.CMB.1.raw
  modified_base (173)..(173): a, c, t, g, unknown or other
  misc_feature (173)..(173): n is a, c, g, or t
  modified_base (537)..(537): a, c, t, g, unknown or other
  misc_feature (537)..(537): n is a, c, g, or t
  modified_base (616)..(616): a, c, t, g, unknown or other
  misc_feature (616)..(616): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttggctgagctggtctttttctgtggacttaattttaaaaggngttcagtgtgaggtgctagttgttggagttcgtggggagtcttggacacgagccggtcgggggtcccgagtacctcgtccgtgtgacacgtcctctaggacttccgtccttttcgaacgtaaccttctcgacctagtcgaccgacgttccgggtccgacccgacgtcccgtaccggaaggggaacgggtcctaggggacggtttcgggtcctacggtaggtttacgttcggggtacgagttacgggtactacggaacctaacgtacgttaaaccgtacggacgtacgtaccgttacgtaccggacggtaaacggggtcccgttacaaccgattccgtaccgagtactactaacttacccgaaanaacacctactacgtatcctaagacaaacgtccaacctactcgaagtacgacgaacgacgaacctctaatattacgttancgtagacgtaagtcgtaagctagacacggacggtacgacgtacgaccgtagtcctcggtctacccg

SEQ ID NO: 271498 - DNA, 617 bp, Homo sapiens
  misc_feature: GYAE6OF01DS00E.40.43.D10.1.454.CMB.1.raw
  modified_base (172)..(172): a, c, t, g, unknown or other
  misc_feature (172)..(172): n is a, c, g, or t
  modified_base (300)..(300): a, c, t, g, unknown or other
  misc_feature (300)..(300): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggcttttctaggtggctattttaaaaggngtcagtgtgaggtgcagttgttggagttctggggggaggcttggcacagccgtggggggtcccgagactctcctgtgcagcctctggattcgcctttcagaactctagccatgctacgtggtccgccncgcctccgaaggggaacggggcgtgggacggtgggtctcgaggttagttcggggtgatggtatgacacgtatactacgacagtactcgtggccggaaggggtcccggttacacctatcctcaaggacacgtaacttaccaaagaacactaactactactactacgactaaacgtcgaaccaaacctcaaggaggaccgaggaccgaccggactatactacttatcggtagacgtaaaggtggtacgaacgttatacggaaccgtacggtacggggcctaaccgggggaacccttgggaccctaccggtccgtacccg

SEQ ID NO: 271499 - DNA, 884 bp, Homo sapiens
  misc_feature: GYAE6OF01BV9WV.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagttgttggagtcgtgggggagcttggcacgagccgtggggggtcccggagactcctcctgtgcacgcctcgtggtacttccgccttttacaaggtaaccttctcgaccctagttcgaccgtaccgttccggggtccccgaccccacggtccccgtaccggaaggggggaaacgggggtccgttaggggagggttcggggtccttacggtaagggtttacggttcgggggtgtaacggttggttaacgtcgaacctaactaacgttaaccgtaacggactaacggtaccttcggtacgggaaccgggtaaacgggggtccccggtttaaccaacccgtacgttacccgttacccgaacggtaacgtaaaccgttaaccttttaaaccccgaaaacggtaaacccctaaaccttaccttaccttaacttccgttaaccggtaacctaaaacgtacccgtaaaccccgtaaccctacgaaagggaccggtaccgggaaacgggaacccgtaacccgggtaacccttaaagttaacgtttaacgtttaaccggtaggtaacggaacgggttaaaaggggtttcggttaaccggtaaacgttaccggtaacggtaacccgtaacggggttacccgggggaacccgtaaccggggtaaccccggttacgggttaccccgtacccggttcccttaccccg

SEQ ID NO: 271500 - DNA, 723 bp, Homo sapiens
  misc_feature: GYAE6OF01A8OIZ.40.43.D10.1.454.CMB.1.raw
  modified_base (168)..(168): a, c, t, g, unknown or other
  misc_feature (168)..(168): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtgcttttctgtggctattttaaaggngtccagtgtgaggtgcagttgttggagtcgtgggggaggcttgggcacgagccgtggggggtcccgagactctcctgtgcagcctcgtggattccgcctttcaagaacctcgtcgccatcgctacgtcggggtccgccacggccctccggaaggggacggggctgggaggtcgggtctcgaggtagttcggggtgattgggtactgaccacatacgtacgcagactcgtggaccggacgggtcccgttacaccgtatcctaccgaagtacgaccttacgtttacccgaaagtaaccaaccgtaaccttacctaagtaccgtacgaacctaaaacgtaccgaacccctaaacccgtacgaaacgggtacgggaaccggaaccggggaacccgaacccggggacccttaacgttaaacgttaactttaccggttaggtacggtaaccggggtaaaagggttgggtaacgtaaccgttagttaccggaacccgacgggttccgggggaaccctaacgggggaaccccttagggtacccctaaccggttcctaccccgg

SEQ ID NO: 271501 - DNA, 553 bp, Homo sapiens
  misc_feature: GYAE6OF01CZIRE.40.43.D10.1.454.CMB.1.raw
  modified_base (297)..(297): a, c, t, g, unknown or other
  misc_feature (297)..(297): n is a, c, g, or t
  modified_base (346)..(346): a, c, t, g, unknown or other
  misc_feature (346)..(346): n is a, c, g, or t
  modified_base (430)..(430): a, c, t, g, unknown or other
  misc_feature (430)..(430): n is a, c, g, or t
  modified_base (482)..(482): a, c, t, g, unknown or other
  misc_feature (482)..(482): n is a, c, g, or t
  modified_base (501)..(501): a, c, t, g, unknown or other
  misc_feature (501)..(501): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggcttaattttaaaaggtgtccagtgtgaggtgcagttgttggagtcgtgggggagcttggcacagccgtggggggtcccgagactctcctgtgcagcctctggattccgccttttcagaactctgccatgcacgtggtccnccagcctccgaagggagggctggagtgggtctcgaggttattcggggtnatggtactgaacacgatactacgcagactctggcgaagggccgttcacctatctcagagactattaccaaagaacacactctanctgacaaatcgaaccaactcagaggacgaaggacacgccatatatactgtanacgaaaggtgtagacctancgaaccacgttcggggacctaacggggaaccctggtaccaccggtctacccg

SEQ ID NO: 271502 - DNA, 741 bp, Homo sapiens
  misc_feature: GYAE6OF01CUHT4.40.43.D10.1.454.CMB.1.raw
  modified_base (307)..(307): a, c, t, g, unknown or other
  misc_feature (307)..(307): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagttgttggagtcgtgggggagcttggcacagccgtggggggtcccgagactctcctgtgcagcctcgtggacttccgcctttcagtaacctcgtgccatcgctacgtcgggtcccnccacgccctccggaaggggacgggctggaggttcgggtactcgagggtagttcggggtatagtacgggtactggaaccacgtaataaccgtacgctaagtacctcgtaggaccggtaaacggggtcccgttaccgaacctacgtaccctaccgaagtaacgtaaccttaactttaacccgaaaacgtaaacccaaccgtaaccttacctaacttaccgtacgaaacctaaactaccgaacccctaaaccgttaccgaaacgggtacgggaaccggaacggtaaccgaaccggtaccctaagttaacttaacgtttacgtaggtacggtaaaccggtaaagggttcggtacgtaaccgtaagtacggacccgtaaccgggtacggggacccgtaaccgggtaacccgtcggtaccctacccggtccttaccccgg

SEQ ID NO: 271503 - DNA, 553 bp, Homo sapiens
  misc_feature: GYAE6OF01B8FE6.40.43.D10.1.454.CMB.1.raw
  modified_base (294)..(294): a, c, t, g, unknown or other
  misc_feature (294)..(294): n is a, c, g, or t
  modified_base (341)..(341): a, c, t, g, unknown or other
  misc_feature (341)..(341): n is a, c, g, or t
  modified_base (393)..(393): a, c, t, g, unknown or other
  misc_feature (393)..(393): n is a, c, g, or t
  modified_base (474)..(474): a, c, t, g, unknown or other
  misc_feature (474)..(474): n is a, c, g, or t
  modified_base (496)..(496): a, c, t, g, unknown or other
  misc_feature (496)..(496): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtctgggggaggcttggcacagccgtggggggtcccgagactctcctgtgcagcctctggattcgcctttcagaactctgccatgcactgggtcccncagcctcgaggggagggctggagtgggtctcgaggtagttcggggtnagtgggtactggacacatactacgcagactctgacggagggccgttcacctntcctccagagactattaccaagaacactactctactctgacaaatcaccaactcgagagcgaggacacgctatatattacngtgacgaaggtggtacgactancggacccacggtcggggacccgtacgggaaccccgttggaccctaccggtcctcccg

SEQ ID NO: 271504 - DNA, 510 bp, Homo sapiens
  misc_feature: GYAE6OF01E4VLL.40.43.D10.1.454.CMB.1.raw
  modified_base (290)..(290): a, c, t, g, unknown or other
  misc_feature (290)..(290): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (507)..(507): a, c, t, g, unknown or other
  misc_feature (507)..(507): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttangaagcgtcgaacagggccactggcatcccagccaggttcagtgccagtgggtctgggacagacttcactctcaccatcagcagcctagagcctgaagtattttgctactttattactgcaccagcgtagcagctggcctcgaacgttcggaccgaagggaccaagggtgacgatcaaagcgactggnggctgnaccntctgtctcatcttcccgccntcc

SEQ ID NO: 271505 - DNA, 572 bp, Homo sapiens
  misc_feature: GYAE6OF01A5363.40.43.D10.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
  modified_base (395)..(395): a, c, t, g, unknown or other
  misc_feature (395)..(395): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaangccaccctctcctgcagggccagtcagagtgtcggcaccttctagcctggtaccaacagaagcctggccaggcctcccgaggcctcctctatttangaagcgtacgaacagggccagtggcactcccagcctaggttcaggtcgcctaggtcgggtctggggacagtacttcactctcaccatcagcacgcctaggacncctagagtatttgcttactttatactgtacacagtcgtacgcagctcggcctacgtacggttcggaccgaacgggaccgtaagggtacgacacgtacgaacggacgtaacgtcggtcggacgtcgaccacctgttccgtcgttaccttccacttccccttacccgccgtcgttaccg

SEQ ID NO: 271506 - DNA, 891 bp, Homo sapiens
  misc_feature: GYAE6OF01BD36H.40.43.D10.1.454.CMB.1.raw
  modified_base (174)..(174): a, c, t, g, unknown or other
  misc_feature (174)..(174): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggctttttctagtggactaattttaaaaggntccagtgtgaggtgctagttgtggagtcgtgggggagtcttggcaacaggcccgtggggggtcccgagactcgtccgtgtgcacgcctcgtggacttccggcctttcaaggaaccttcgtcgacctattggctaacgtcggggtcccaccgacggtcccctaccggaagggggaacgggtccgtaggggaacggtttcggggttaccctggtaacgggtttacgggttttccggggggtataaacggtttacggggtaaccgtttacgggaaacctaacctaaacgttaacccgttaaccgggacctaaaggtaccccggttaccgttaggacccggggtaaaaccgggggttccccggtttaacaaccccggttacttcccggttaaccgaacgtaccggtaaccttaacgtttaacccgaaacggtaaaccccaccgttaaccgtccttaacgttacctacggtaaccgtaaaagttccctaaacccgtaaaccgtacgaaacggggtaccggaacccgggtaacgggtaaccgaacccggggtaaccctaaaggtttaacttaacgtttaccggtaggtaaaccggtacgggttaaaacgggtcggttaaccggtaaaccttaggtaacccgggtaacctaccggggttaccggggaacccgaaaccggggttaaccccgttcggtaccccggtacccgttcccggtaaccccg

SEQ ID NO: 271507 - DNA, 678 bp, Homo sapiens
  misc_feature: GYAE6OF01ATQAF.40.43.D10.1.454.CMB.1.raw
  modified_base (305)..(305): a, c, t, g, unknown or other
  misc_feature (305)..(305): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttattttaaaaggtgtccagtgtgaggtgcagttgttggagtcgtgggggagcttggcacagccgtggggggtcccgagactctcctgtgcagcctcgtggacttcgcctttcagtaactctgcctatcgcctacgtcgggtcccnccacgcccgtcggaaggggacgggcgtgggacggtgggtctcgagggttagttcggggtatacgtggtactcgaacactacgtacgtacgacgtacgtactcgtcggacggaacgggtcccgttacaccgtatccgtacgagtactactacttaccgaaacgtaaccaactactactactacctagtaacctaaactaccgaaccctaacgtacgaacgggtacggaacgaacggaacccgacgtacctaagttaactacgttacgtggtacggtacggtaaaggtcggtaacgtacgttagaccggtacccgtacggggtaccgggacccgtaaccgggtacccgtacggtacccgtcccgttccgtacccg

SEQ ID NO: 271508 - DNA, 712 bp, Homo sapiens
  misc_feature: GYAE6OF01CFHHF.40.43.D10.1.454.CMB.1.raw
  modified_base (260)..(260): a, c, t, g, unknown or other
  misc_feature (260)..(260): n is a, c, g, or t
  modified_base (429)..(429): a, c, t, g, unknown or other
  misc_feature (429)..(429): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttctgtggcttattttaaaaggtgtccagtgtgaggtgcagttgttggagtcgtgggggagcttggcacgagccgtggggggtcccgagactctccgtgtgcacgcctcgnggtacttcgctttcagaactctgccagtcgacgtacgtgggtcccgaccacggccctaccggaggggaacggggctcgggaggttcgggtcgtacggagggttacgttcgggggtagtacgtggttaactggaacacgtaacttaaccgtacgacctaagaccttacgnggaacggtaacgggtcccggttacaacctagtcctaccaaggacgtaactactttaaccaagtaaaccaactacttactaactcgtacgactaaaacgtccgaaaccctaacctacgaaggacgggtaaccgaacgggaaccgaccgggtacctaaagttacttaagttacgttagtacggtaacggtaaagggttacggtataacgtttaagaccgtacccggacggtccggggaaccctaaccggggtaacccgtgggtacccctacccggttcctacccg

SEQ ID NO: 271509 - DNA, 519 bp, Homo sapiens
  misc_feature: GYAE6OF01AO383.40.43.D10.1.454.CMB.1.raw
  modified_base (196)..(196): a, c, t, g, unknown or other
  misc_feature (196)..(196): n is a, c, g, or t
  modified_base (493)..(493): a, c, t, g, unknown or other
  misc_feature (493)..(493): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaanagccaccctctcctgcagggccagtcagagtgtcggcaccttctagcctggtaccaacagaagcctggccaggctcccaggctcctcatttatgaagcgtcgaacagggccactggcatcccagccaggttcagtcgccagtgggtctgggacagacttcactctcaccatcagcagcctagcgcctagaagtatttgctactttattactcgtcaccgagtcgtagcagctggcctcgacgttcgaccgaaggaccgtaaggtcgacatacgaagcgaacgtggtgacgtgacacntctgtcttcactccttcccgctgtcg

SEQ ID NO: 271510 - DNA, 653 bp, Homo sapiens
  misc_feature: GYAE6OF01CG3W9.40.43.D10.1.454.CMB.1.raw
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
  modified_base (398)..(398): a, c, t, g, unknown or other
  misc_feature (398)..(398): n is a, c, g, or t
  modified_base (462)..(462): a, c, t, g, unknown or other
  misc_feature (462)..(462): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggctaattttaaaaggtgtccagtgtgaggtgcagttgttggagtcgtgggggagcttggcacgagccgtggggggtcccgagcctctcctgtcgcacgtcctcgtggacttccgcctttcaagtactctcgccatcgcacgtcgggtcccncacgccctaccggagggagggtctggaggtgggtctcgagggttcgttgggggtnagtggtactagacacataccgtacgcaagcctcgnggaccggtacgggtcccggttacacccgtagtcctaccgaagacgtaactacgttaaccgaaanaaccaactaccgtactatctagtacaaacgtccaaccacctagaacgcggacgacggacgaccggactagttacttaacgtacgtacggtagtacgggtaaagtgggtacgtacgttacgaccggtaacccgtacgggacggggtacccgaaccggggtaaccctcgggtacccaccccggttctaccccg

SEQ ID NO: 271511 - DNA, 700 bp, Homo sapiens
  misc_feature: GYAE6OF01B4G42.40.43.D10.1.454.CMB.1.raw
  modified_base (173)..(173): a, c, t, g, unknown or other
  misc_feature (173)..(173): n is a, c, g, or t
  modified_base (189)..(189): a, c, t, g, unknown or other
  misc_feature (189)..(189): n is a, c, g, or t
  modified_base (263)..(263): a, c, t, g, unknown or other
  misc_feature (263)..(263): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcggtgtgtttctaggtcggctaattttaaaggngtcagtgtgaggtgcngttgttggagtcgtgggggagcttggcacgagccgtggggggtcccggagacctctcctgtgcagcctgtggtnttcgcctttacagtaactctcgccattcgactacgtgggtccgccgtagcccgtaccggaagggggaacggggtccgtaggggtacggttggggtccttaaacggtgggtttaacggttcgggggtcgtaagttgggttaaacgtcggaacacctattaccgaacgtacgaacgccgtcgtaggtaccgaacgggggtcccgttacaaccgttactcctacgaagtacgtaacttaacgtttaccaaaacgtaccaaacgttccctataacgttctacgtaacaaacgttcgaaccctacgtacgacgtcggaacgacgacgacgtactagttacttagtcctggactcgggtaaagttgaaccgttataggttaccacggaccgtcgggggactaccggggttaaaccctggggttaccctccgttccgtaccccg

SEQ ID NO: 271512 - DNA, 862 bp, Homo sapiens
  misc_feature: GYAE6OF01EBLYF.40.43.D10.1.454.CMB.1.raw
tcagtctagcgactcacgaccggtgctcgatttagactagcagtaagggggagagaggagcccagccctgggatttttcaggttgttttcatttggtgatcaggactgaacagagagaactcaccatggagtttggctgagctggtctttttcttgtggtacttaagttttaaaaggtgtccagtgtgaggtgctagtttgttggagtcggtgggggagtcgtttgggcaacgacggcccgggttcggggggtcccgagtaccttccgtccgttggtcgcacgtcctcgtggtaccttccgtcctttacgaacgtaacctcgtcgacctagtcgaccgtacggtcgggtccccaccgacggtcccgtacgggaagggggtacgggtcgtaggggtacggtcgggttcctacggtagggtttacggttcggggtagtagttacggtactcggaactaacgtacttaacgtacgacctaacgtaccgtcggtaccggaaccgggtaccgggtcccgttacaacccgtactaccgtacgaacggtaacgtacccttaacttaacccgaaaacgtacctaaacctaccttactaacttacctaaacgaaccttaaaacgtacccgaaacccccttaaggtacgaacgggtaacggaacccggaaccgggtaaccctaaccgggtaacctttaagttaacggtttaaaccgttcggttaacggggaacgtaaacggggttaaagggttaggtaacccttaacggttaacgggaaccggtaaccccgggtaggggtaacccggggaacccccttaccggggttaaacccccttggggtaacccccttccccggtttcctaacccccgg

SEQ ID NO: 271513 - DNA, 794 bp, Homo sapiens
  misc_feature: GYAE6OF01D095V.40.43.D10.1.454.CMB.1.raw
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (366)..(366): a, c, t, g, unknown or other
  misc_feature (366)..(366): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggcttattttaaaaggtgtccagtgtgaggtgcagttgttggagtctgggggagcttggcacagccgtggggggtcccgagactctcctgtgcngcctctggtacttcgtcctttcagtaactctgcctatcgcacgtcgggtccnccacgccctccgaagggggacgggtctgggaggttcgggtcctcgtagggttacgttcgggggtnagttcgggtactggaacctactaacgttaccgtacgcgtaacggtaccttcggtcggaccgggtaacgggggtccccgttaccaacccgtacgttacccgtacccgaaggtaaccgtaacccttaaccgttttaacccgaaaaacggtaaaccctaaccctaacccgtttactaaaccctttccgtaacggtaaaccctaaaacgttaccggaaaccccctaaacccgttacgaaacgggacggaacccgggaacggacccgaacccgggtaccctaaagttaacttaagttaccgttggtaacggtaaccgggtaaaagggtggttaacgtaaaccgttaagttaccggaaaccccggtacgggttcggggaaccccggttaacgggaacccccgttgggtaccccctacccggttcccttaccccg

SEQ ID NO: 271514 - DNA, 820 bp, Homo sapiens
  misc_feature: GYAE6OF01DBACH.40.43.D10.1.454.CMB.1.raw
  modified_base (311)..(311): a, c, t, g, unknown or other
  misc_feature (311)..(311): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagttgtggagtcgtgggggaggcttggcacagccgtgggggtcccgagactctcctgtcgcagcctcgtggtacttccgcctttcagtaacctctgccctatcgcctacgtcggggtcccnccgtacgccccgttaccggaagggggaaacggggccttaggggacgggttcggggtccttacggaaggggtttacggttttcggggggagtagttacggggttaactcggaaccacgtaacgttaaccgtaccggcctaacggtaccttccggcgggtaaccgggacgggggtcccgtttaccaaccgtaccttaccgtacccgtaaggtaacgtaccttaacgtttaacccgaaaacgaaccctacctaaccttactaccgttcgtacgaaacccttaaagaccggtaaacccctaaccgtacgaaacgggacgggaacccggtaacgggaaccccgaaccgggttactaaacttacgtttaacgtttacggtacggttaacgggaaacgggttaaaggttcgggtaacgtaaacgttacgtaccggtaaccccggtacggggtaccggggtaacccgggtaaccgggttaaccccgtgggttaaccccgcccgttcccgtaacccgg

SEQ ID NO: 271515 - DNA, 784 bp, Homo sapiens
  misc_feature: GYAE6OF01AD1HI.40.43.D10.1.454.CMB.1.raw
tcagtctagcgactcacgaccggtgctcgatttagactagcagtaagggggaggaactgctccagttaggacccagagggaaccagtggtaacgcccctaggctcagcttctccttcctcctgctactctggcctccagaaaactccgggagtaaattcgtgtttgtactacgtagtctcctaaggctaccctgtctttgtcctaccgaggggaaacacgccgtacccgtctcccggtgggccgtagggcccaaggtccgaggacgttcgtcggacctacctttctacgccgtggtaccaacgagtacgtccgtggcccacggtcctacccgaggcctcctctatttacgtcggaacgccgtacgaactacgggccaacgtcggctacgtcccgaaggcccgtaggttcagttcgtaccagggttcggtacgtaggggaactagttaacctactaccgtactaccaaccgtataccgaggacccgagtaccctaggacccgtcgtagtaacgtagttttacgacttaaccttttaacgtacgttacgtacctaaccgtagttaccgtaacgtaccgtacgtaccgtacggtacccgttaccgggtaaccggttacgggtaaccggaaacgggtaacccggtaagggttaccggaacttaacggttaaccgtaaggtaccggtaaacggttacgggtacgggtaccgtacggaccgtacccgtgttacccgttaccgtccgttttaaccacgtttacccgttaccccgtcgtaccggttacccgg

SEQ ID NO: 271516 - DNA, 847 bp, Homo sapiens
  misc_feature: GYAE6OF01C9N1E.40.43.D10.1.454.CMB.1.raw
  modified_base (323)..(323): a, c, t, g, unknown or other
  misc_feature (323)..(323): n is a, c, g, or t
tcagtctagcgactcacgaccggtgctcgatttagactagcagtaagggggagagaggagcccagccctgggattttcaggttgttttcatttggtgatcaggactgaacagagagaactcaccagtggagttggctgagcgtgtctttttctggtggtacttaagtttaaaggtgtcctagtgtgaggtgcgtagttggttgggaggttcggtggggggaggtcgttcggcacgacggccgggtcggggggtcccgaggtcctcgtccgtgtcgccgacgtccgtcgtcgggtactttccgtcctttacgaacgtaacctcncggtaccatcgacctcggtccgggtccgccgacggtcccgtaccgggaaggggaccgggtcgtaggtcgggttcggtcgtacggtaagggttacgggttcggggtacgtaggttacggtacgtagtaaccgtacgtacgaaccgtaccgacgacggttaacctcggtaacgggtaccggggtaacccgggttacccggtttaccaacccgttacggttaccctaaccgggaacggtaacccgttaaacgtttaaccggttaacccaaaacgttaacccgaacccttacgtaaccttacgtaacccgaacgaaaccttaaacgtacccgaaccctaaccgaggtaaccggaggaaccgtaaccgggacctaccggtacctattaacgttagtcgtagggtaaccgtagggtaaacggttggtaacctcggttaaccgtacggtacccggtacggggttacccgggaacccgggtaccccggggttaacctacccgggttaccccgtccggttcccccttaccggg

SEQ ID NO: 271517 - DNA, 742 bp, Homo sapiens
  misc_feature: GYAE6OF01D6YXP.40.43.D10.1.454.CMB.1.raw
  modified_base (171)..(171): a, c, t, g, unknown or other
  misc_feature (171)..(171): n is a, c, g, or t
  modified_base (300)..(300): a, c, t, g, unknown or other
  misc_feature (300)..(300): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctattttaaaaggtntccagtgtgaggtgcagttgttggagtcgtgggggagcttggcacagccgtggggggtcccgagactctcctgtgcagcctctggattccgccttttcagtaacctctgcctatcgcacgtcgggtccnccacgccctcgaggggaacgggctgggaggtcgggtctcgaggttacgttcgggggtgtacgttcgggtacctggaacctacgtattaaccgtacgactaaggtaccttcgtcggaacgggtaaacggggtcccggtttacaacccgtacgttcccgtaccaaggtacgtaacctaacttttacccgaaaacgtaaaccgtaacctaaccgttcctaaactttcccgtaacggtaacctaaaaagtttcccggaaacccctaaacccgtacgtaaacgggaacggggtccggaaacgggtaccgaacccggggtacctaaacgttaacttaacgttaacgtcggtaggaaccggtaaagggttggtacggtaactagtacggacccgtacggtcgggggaccctaacggggaccccttagggccctaccgttcccgtacccg

SEQ ID NO: 271518 - DNA, 918 bp, Homo sapiens
  misc_feature: GYAE6OF01APOH7.40.43.D10.1.454.CMB.1.raw
  modified_base (257)..(257): a, c, t, g, unknown or other
  misc_feature (257)..(257): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagttgttggagtcgtgggggagcttggcacgagccgtgggggtcccggagactctctgtgcagcctntggacttcgcctttcagtaactctgccatgctacgtcgggtcccgaccacgtcccgtaccggaaggggaacggggtcgtagggaggttcggggtccttcggtaacgggttagttcgggggtagtacgttcgggtaactacggaaccaacgtaacgttaaccgtacgaaccgtaagtacccttcgtacggtaccggggaaaccggggtcccggtttaaccaacccgtacgtttacccgtaccgaaacggtaacgtaaaccttaccgttttaacccgaaaacgtaaaaccccgtaacctaaccgtttaccttaaccgttaccgtaacgtaaacctaaaaccgttacccgaaaccccgtaaacccttaaccggaaccgggtaacgggacccgggtaaaccggaacccggaaaccccgggtaacccgtaaacgtttaaacggttaaacgttttaaccggtacggggtttaaacggtaaacccggggttaaaaacgggggttccgggttaaacggttaaaacccgtttaaccggttaaacccgggtaaaaccccggttacccggggttaaccggggggaaccccccgggttaaaacccggggtaaacccccgggtttacccggggtaacccccgtttaaccccgggttcccccgtttacccccggg

SEQ ID NO: 271519 - DNA, 727 bp, Homo sapiens
  misc_feature: GYAE6OF01DUM3L.40.43.D10.1.454.CMB.1.raw
  modified_base (194)..(194): a, c, t, g, unknown or other
  misc_feature (194)..(194): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcacctgtctttgctcgaggggaaancgccacctctcctgcagggccagtcagagtcgtcggctacctttcttagcctacggtaaccaacgaggaacgcctgggccacggcctacccgaggtcctccgttctaattttacgaggtaaacggtccggtaacgaaacggtacggggccctaacggtcggaccacgttaccccgaggtacccgtaggtttccaggttcgccgtaggggtcgggttacgcggggaactaggtaccttcgaaccttctacaacctatcaacggccgaaacgtccctaaggacgttccgtaggtaaacgttattttacgactttaacttttaagttaccgttacgtaccgaaccgtaggtaccgtagtaccgtacgtccgttccgggtaccttaccgggtaaccggttccggaaccggtaaccgggacggtaaacggtcggaaaccgaacgtacgaacggaccgtaacgtcggtacggtcgtacgtacgtaacctgttccgttcgttacgttccttaccttcccgttaccccgtctcgttaccgg

SEQ ID NO: 271520 - DNA, 969 bp, Homo sapiens
  misc_feature: GYAE6OF01DKMZR.40.43.D10.1.454.CMB.1.raw
tcagtctagcgactcacgaccggtgctcgatttagactagcagtaagggggagagaggagcccagccctgggtattttcgggtgttttcatttggtgatcaggactgaacagagagaactcacagtggtagttgggctgagtcgttggttcttttttcgttggtggtactttaaagtttttaaaaggtcgtaccgtaggtggtggaggtgtcgtaggtttggttgggacggttcgggtggggggacggtcgttcggcacgacggtccgggtcgggggggtacccggaggtaccttccgtccgtcggtcggcgacgtccgttcgtggtacgtttccgttccttttacgaacgtaaccgttcgtacgtcctagttcggaccgtaccggttccggggtaccccgacccggaccggtaccccggttaccggggaagggggggtaaacggggtccgggttaaggggtaccggggtttccggggttaccgttacggggtaacgggtttaggggttttaccgggggttaggtaacggtttacgggttaacgttaccggtaacctaaccgttaacgttaacccgtaaacggacgttaaccggtaacccgttcggttacgggaaccggggtaaccgggttacccgttaaccctaaccgtaccgttacccgtaaccgaacggtaactaaccgtttaaccgttaaccgaaacgtaaccctaactaccgttaacttacgtacgtaacgaactaaaccgtaccgtaaaccctaaccgtcggaaaggaccggaacgggtaaccgaaaccggtccggaacttaagttaacttacgttacggtagaacgggttaacggtaagggttaccgtaaggttaaccgtaacggtaccggtaacccggtaccgggggtacccggggaacccgtaaacccgggttccccggttacgaaccccggttacccggttaccctcccggtaaccccg

SEQ ID NO: 271521 - DNA, 576 bp, Homo sapiens
  misc_feature: GYAE6OF01AQE97.40.43.D10.1.454.CMB.1.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
  modified_base (549)..(549): a, c, t, g, unknown or other
  misc_feature (549)..(549): n is a, c, g, or t
  modified_base (554)..(554): a, c, t, g, unknown or other
  misc_feature (554)..(554): n is a, c, g, or t
  modified_base (573)..(573): a, c, t, g, unknown or other
  misc_feature (573)..(573): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaangccaccctctcctgcagggccagtcagagtgtcggctaccttctagcctggtaccaacagaacgcctggccaggcctcccgaggcctcctctattttanggaagcgtaccgaacgacggggccacgtggcactcccagcctaggttcagtcgccgaggtcgggtctgggacagtacttcactctcactatcacgcacgcctagaccgtctagtaacgttattttcgacttacttttaattacgtacgtaccaccgtagtacgtacgcgtagccgtcggccttacggaacgttcggaccgaacgggaccgtagggtacgactagtacgaacgcgaacgtgtaggcgtcgcactntcgtntacttcactcctcccgctntcg

SEQ ID NO: 271522 - DNA, 883 bp, Homo sapiens
  misc_feature: GYAE6OF01D9EIN.40.43.D10.1.454.CMB.1.raw
  modified_base (353)..(353): a, c, t, g, unknown or other
  misc_feature (353)..(353): n is a, c, g, or t
tcagtctagcgactcacgaccggtgctcgatttagactagcagtaagggggagagaggagcccagccctgggattttcaggttgttttcatttggtgatcaggactgaacagagagaactcaccatggagttggctgagcttggtctttttcgttgtggactttaagttttaaaaggtcgtacctagtgtggaggtgcgtagttgtggagtcggtggggagtcgttggcacgcggtccggtcgggggtcccgagtacctcgtccgtggtcgccacggtccttacgtggtacttccggtcctttacgaacgtaacctccgtacgacctagtcgaccgtacggtccgggtccccnccgaccggtccccgtacgggaagggggaacgggtccgtagggtacgggttcgggtaccgttacgggtagggttttacggttcgggggtagtaaggttcgggtaacgtacgaaccgtaacgtaacgttaccgtacgaccgtaaggtaccgttacggtacggtacggggtaaccgggtcccgttaccaaccgtacgtacccgtaccggaaagtaccgtaaccttaacgtttaaccggaaaacgtaacccctactaaccgtttacaaccgttcgtaaaccgtaaacgttaaaccgtcccaaaacccccgtaagtacgggaaacggtacgggaaccggttaaccggaaaccgtacccgggtaacctttaaagtaaccgtttaacgttaacggtcgggtaaaacgaccggggttaaaaggttggtaaaaccgtaccgttaagtccccggaaacccgggtacgggtaacccggggaaccccggtaaaccgggttaccgtaccccggttaacccgttccggtacccccttaacccgg

SEQ ID NO: 271523 - DNA, 764 bp, Homo sapiens
  misc_feature: GYAE6OF01C9OVT.40.43.D10.1.454.CMB.1.raw
  modified_base (195)..(195): a, c, t, g, unknown or other
  misc_feature (195)..(195): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
tcagtctagcgactcacgaccggtgctcgatttagactagcagtaagggggaggaactgctcagttaggacccagagggaaccatggaagcccagctcagcttctcttcctcctgctactctggctcccagaaacaccggagaaattctgttgacacagtctccgaggcaccctgtctttgtctccgaggggaanagccaccctctcctgcagggccagtcagagtgtcggcaccttntagcctggtaccaanagaagccgtggccaggcctccgaggcctcctntatttanagaacgcgtacgaacgacggggcctaacgtcggcacgtcccgagcccgtagggttaccaggttcgcccgtaagggttcgggtacgtagggggaacaacggtacctttaccaccgttcctaccaaccctaagttccgaacggtcccgtaacggtaccccttaagggaaccggtcccgttaaggtaaacgttacgttttttacggacctttaacgttttaacttttaccgttacgttacctaaccgtacggtacggttaacgcgtacggtccgttacggtacccgttaccgggtaacgggtttccggaaccggtaaaccggggtaaccggtaacgggtaccggtaacgtaacgtacggaaacggtaccggtaacgttacgggtcggtaccgttacgggaccctaaccgttacgttaccgttacgtttaccgtttacctaccgtttcccgtttccccgaccgttacgttaaccgg

SEQ ID NO: 271524 - DNA, 782 bp, Homo sapiens
  misc_feature: GYAE6OF01C5GGB.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttctgtggcttatttaaaaggtgtccagtgtgaggtgctagttgttggagtcgtgggggagcttgggacacgaggccgtggggggtcccgagacctctccgtgtgcagtcctcgtaggtattccggtcctttacgaacggtaaccttcaggaccctaagttcgaccgtacgtcggggtccccaccgtacgtccccgtacggagggggtaacggggtcctggggtacggtgggtcctacgagggtttagttcggggtgtagttacgggtactggaaccaacgtaacgttaccgacggacgtacgtaaccgttcgcggggtaaccgggtaaacggggtccccggtttaccgaaaacctcgttaccgtaccgaagtaacgtaccttaacgtttaaccgaaacgtaaactaacctaactacttaacgtcctacgtaactaaacgtccgaaaccctaaaccgacgaaacggtacgggaaccgtaacggacccgtaaccggtacctaaacgttagttaacttacgtaaggttacggtaacggtaaagggttaggtaacgtaacgttaacgaccggaaccgtacggtacccggggaaccgtaccggggtaaaccctcgggtaccctcgttcccgtacccg

SEQ ID NO: 271525 - DNA, 811 bp, Homo sapiens
  misc_feature: GYAE6OF01EG8O0.40.43.D10.1.454.CMB.1.raw
  modified_base (215)..(215): a, c, t, g, unknown or other
  misc_feature (215)..(215): n is a, c, g, or t
  modified_base (757)..(757): a, c, t, g, unknown or other
  misc_feature (757)..(757): n is a, c, g, or t
tcagtctagcgactcacgaccggtgctcgatttagactagcagtaagggggagagaggagcccagccctgggattttcaggttgttttcattttggtgatcaggactgaacagagagaactcaccatggtagtttgggctgagcgtggtcttttctggtgtcttaagtttaaaggtgtccagtgtgaggtgcgtagttgtggagtcggtgggggngtcgttggcacgacggtccgggtcggggggtcccggagtaccttccgtccgtgtcgccgcgtccttcgtggtacttccgttacctttacaacgtaaccttcgtccgtacctagtcgaccgtaccggtccgggtccccacccgtaccggtccccggtaccggggaacgggggggtaaccggggtccggtagggggtacgggtttccgggttaccgttacgggttaacggggttttacgggtttccgggggtagttacgggtttacggtacgtacggtaaccaacgtaaccgttaaccgacgtactacgttaccgtcggtacggacgggtaacccgggtcccgtaccaacccgtactacccggtaacgaacgtaacgttaccttaacggtaacccaaacgaaccctacccttagttacctaactcacgaaactaaacgcccgaaaccaacgtgaacgggaacgtcggaacgtacaccgtacttataacgttacgtacgaggacgtaacgggttagcggttaactcggttacgacgtacccgggngggtacccgggaacccgtacgggttaccccgtggtacccctccgtcccgtacgg

SEQ ID NO: 271526 - DNA, 687 bp, Homo sapiens
  misc_feature: GYAE6OF01CGHLO.40.43.D10.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (292)..(292): a, c, t, g, unknown or other
  misc_feature (292)..(292): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccgaggggaaangcccaccctctcctgcaggccagtcagagtgtcgcaccttntagcctggtaccaacagagcctggcccaggcctcccgaggcctcctcattttangaagcgtacgaacgagggccacgtggccactcccgagcccgtaggttcaggtcgccgtagggttcgggtctggggaacctaggtaccttcacttcctcaaccatcagcagccctagaccgtaccgtagtaagttacttttgaccttaacttttacttaacgttcggttacctaaccgtacgtacgttacggacctaacggtccgttacggtcccgttaaccgggtaaccggtttccgggaacccgtaacggggaacccgtaaggggttacggaacctaacgtaccgaaacggtaccggtaaacgttggtacgggtcgttacggacctaaccgtacgttacgttcggttacctttaccgtaccgttacccgtttccccggtaccttacgttacccg

SEQ ID NO: 271527 - DNA, 577 bp, Homo sapiens
  misc_feature: GYAE6OF01EYTUE.40.43.D10.1.454.CMB.1.raw
  modified_base (199)..(199): a, c, t, g, unknown or other
  misc_feature (199)..(199): n is a, c, g, or t
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
  modified_base (544)..(544): a, c, t, g, unknown or other
  misc_feature (544)..(544): n is a, c, g, or t
  modified_base (549)..(549): a, c, t, g, unknown or other
  misc_feature (549)..(549): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtcttttgtctccgaggggaaagngcccaccctctcctgcgaggggccagtcagagtgtcggcaccttctagcctggtaccaanagaagcctggccaggcctcccgaggcctcctcatttangaagcgtacgaacgcgggccacgtggccactccccgaggccctagggttcaggtcgaccgaggtcgggtctggggaacaggtacttcactctcaaccatcacgcacggtcctaggacgtcctagaacgttatttcgacttactttattacgtgtaccacaggctagcagtctcggcctacgtacgtcgaccgaaggaccgtaagggtgaacacgtacgacgacgtaactcggtaggctcgacacctntcgtnttccttctacttcccgttcccgctatcg

SEQ ID NO: 271528 - DNA, 747 bp, Homo sapiens
  misc_feature: GYAE6OF01C3E0G.40.43.D10.1.454.CMB.1.raw
  modified_base (363)..(363): a, c, t, g, unknown or other
  misc_feature (363)..(363): n is a, c, g, or t
tcagtctagcgactcacgaccggtgctcgatttagactagcagtaagggggagagaggagcccagccctgggattttcaggtgtttcattgtgatcaggactgaacagagagaactcaccatggagtttggctgagctggtctttttctgtggctattttaaaaggtgtccagtgtgaggtgcagttgttggagtcgtgggggagcttggcacgacggccgtggggggtcccggagacttctcctgtgcagtcctcgtggattccgctttcagaactctgccagtgcacgtcgggtcccgccacgcctaccggaagggggaacgggtcgtgggacgtgggtcctcgtagggttagtttggggnagttcggtactgacgactatacgtacgctagtaccgtctcggacggacggggtcccgttacacctacgtcctaccgaagtacgtacctaacgtttaaccgaaaacgtaacctaacctaacttaccgtaacgttaccagtaaaccaaacgttccgaaacccctaaacgtcgaaggacggacgaacggaacccgtaccgggactaaattaacgtttaacttaccgggtagtaacgggtaaccgggtaaaacgggtttcgggtaaacgtaacgtttaaggtaccgggtaaacccccggtacggggttacccggggggaaaccccggtaaccgggggtaaacccccgtttggggtaaccccccgtacccggttccccgttaacccccg

SEQ ID NO: 271529 - DNA, 613 bp, Homo sapiens
  misc_feature: GYAE6OF01DMY88.40.43.D10.1.454.CMB.1.raw
  modified_base (171)..(171): a, c, t, g, unknown or other
  misc_feature (171)..(171): n is a, c, g, or t
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (183)..(184): a, c, t, g, unknown or other
  misc_feature (183)..(184): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (341)..(341): a, c, t, g, unknown or other
  misc_feature (341)..(341): n is a, c, g, or t
  modified_base (409)..(409): a, c, t, g, unknown or other
  misc_feature (409)..(409): n is a, c, g, or t
  modified_base (483)..(483): a, c, t, g, unknown or other
  misc_feature (483)..(483): n is a, c, g, or t
tcagtctagcgactcacgaccggtgctcgatttagactagcagtaagggggagagaggagcccagccctgggattttcaggtgttttcatttggtgatcaaggactgaacagagagaactcaccatggagtttgggctgagcgtgtcgtttctaggtgctaatttaaaggntcngtgngagtnntgtgtgngtgngggngctgcangcgtggggcccgagtctcnctgtgcacgctgtgcttccgcttanagtactcgncctatcncagttcggccgcncggtacnccggaagggtaggntcgggngtcggtactggagttaggttggagtagtcggtacncgaactactataccgtacgactagtacctcggcggaacgggtaacggtccggttacaacgttcgtacncgtaacgtaacggtacttaaccttacgaaacgtacactaactactagtcttacaactaacgtacaccgtaaacnccgaagacgacggtacgaacgcgtacaagttcttagtactggaccgtaggacgttgacggtaactagtacgaccggtaacggcggtaacccgacgggttaacccgtcgtaaccgtcccggttctaacccg

SEQ ID NO: 271530 - DNA, 658 bp, Homo sapiens
  misc_feature: GYAE6OF01B5I2P.40.43.D10.1.454.CMB.1.raw
  modified_base (138)..(138): a, c, t, g, unknown or other
  misc_feature (138)..(138): n is a, c, g, or t
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacnccggagaattctgttgacacagtctccaggcaccctgtctttgtcctcgaggggaangcccacctctcctgcacgggcagtcagagttgtccggctacctttcgtagcccttaggtaccaacgagacgcctggccacggcctccaggcctctcatttncggagtcgacgacgaggcctacgtcggcacgccgacgccgtagttcacggtcgaccgtagggtcgggtacgtgggactagtaccttcacgttctaccaccntcganctacgacctacggtcgtaccgtagtaacgttntttacgtntttaacgtttactaccgtctaccgacgtacgacgtacgccgagtccgacgttccgtacggtaaccggtccggaaccggaacgggaccgtagggtaccgacgtaacgtacgaacggtaccgtaacgtcgggcttaccggtactacccgtacccgttgttccgttaccctttacgttacccttacccgtcccgtttaccccgtacctgttaacccggg

SEQ ID NO: 271531 - DNA, 710 bp, Homo sapiens
  misc_feature: GYAE6OF01BZ2LA.40.43.D10.1.454.CMB.1.raw
  modified_base (198)..(198): a, c, t, g, unknown or other
  misc_feature (198)..(198): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccgaggggaaacngcccaccctctcctgcagggccagtcagagtgtcgctaccttctacgcctggtaccaacgagaacgcctggccaggcctcccgaggcctcctcgtatttatgaacgtcgtcgaaacgcggggcctaacgtcggaccaccgtcccgaaggccctaagggttccaaggtcgaccgtaggttcggggtctagggggactacggtacctttcgaccgtctaccgaacccatccgagtcaacgtccctaaggacgtcctaagtaacgttagttttacgcctttaacgttttacttacgttcgttacaacccgtaggtccgtacgcgtacgtcgtcggtacccgtacggtaaccggttccgggacccggtaaacggggtaccctaaggggtaccggaaccaacgttacgaaacggtaccggtaacgttacgggtggtaccgtacggaccccgaacgtcgtttacccgttcgttcccgtttaccctacttccccgtttcccccgacttacggttacccg

SEQ ID NO: 271532 - DNA, 1085 bp, Homo sapiens
  misc_feature: GYAE6OF01ELJPW.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcacagtggtaggttggctgagtcgtggttctttttcgttggtcggtactttaaagtttttaaaagggtcgtaccgtaggttaggtaggtagggtcgacgttaggttttggttagggtaggttcgggtagggggggtacggttcggtttcggaccgacggacggtcccggggttccgggggggtacccggacgtacccttccgttcccgttggtcgaccgaccggtcccttcgtaggttacgttcccgttccttttacgaacgtaaccttcgttcgacctagtcgccgtacggttccgggtcccaccgtaccggtccccgtacggggaacggggggtaacgggtcggtaggggtacgggttcgggttccgtacggttagggtttacgggtttcggggtagtacggttacggtaacgtacggtaaccgtaacgttaacgtaaccgtaaccgaacgtaacgttacccgtacggtaccggtaaccggggtaacccggggtcccgtttaacccgaacccgtttaaccgttacccgtaaccggtaaacggaacgttaaaccgtttaaccctttaaacccggaaaaacgtaaaccccctaaaccgtttaaccctttaacgtttaacccgttaccgtaaccgtaaaaccgttaaaaccgtacccggtaaaacccccttaaacccggtaccggaaacggggtaaccggggaaaccgggtaaacccgggtaaaccccggaacccgggttaaacctaaacggttttaaacgtttaaccgggttttaaccggttaacggggtaaccgggtaaaaaccggggtttaaaggggttaccggtttaaacggtaaaccctttaacgggtaacccggaaacccgggttaacccgggggtccggggaaaacccccgggttaaacccgggggtacccccgtttaccgggtaaccccgttacccccggtttcccgtaaaccccccgg

SEQ ID NO: 271533 - DNA, 717 bp, Homo sapiens
  misc_feature: GYAE6OF01DXNTL.40.43.D10.1.454.CMB.1.raw
  modified_base (196)..(196): a, c, t, g, unknown or other
  misc_feature (196)..(196): n is a, c, g, or t
  modified_base (257)..(257): a, c, t, g, unknown or other
  misc_feature (257)..(257): n is a, c, g, or t
  modified_base (298)..(298): a, c, t, g, unknown or other
  misc_feature (298)..(298): n is a, c, g, or t
  modified_base (314)..(314): a, c, t, g, unknown or other
  misc_feature (314)..(314): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcacctgtctttgtctccgaggggaaancgccaccctctcctgcgagggccagtcagagtgtcggctaccttctacgcctggtaccaanagagcctggaccaggcctcccgaggccttcctactatttancgaagcgtacgaacgngggccctagtcggaccacgtccccgagtcccgtagggtttcaggttcgaccgtagggttcgggtccgtaggggaacctagtaccgtttacaccgttctaccaacctatccgacgcctaacggtacccttaaggaccgttcccgttaaaaaggtacgtttaacgtttttcgaacctttaacgttttttaacgttaccgtacgttacccaacgtacggtaccgttacgaccgtacgtccgttcggtacccgttaccggtaacggttccggaaccggtaacgggaaccgtaagggtacggaactacggtacgaacggtacgtaacgtggtacggtcgtacggaccctaaccgttgtccgttacgttccctttactaccgtttccccttaccccgcttaccgttacg

SEQ ID NO: 271534 - DNA, 653 bp, Homo sapiens
  misc_feature: GYAE6OF01ELW45.40.43.D10.1.454.CMB.1.raw
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggctattttaaaaggtgtccagtgtgaggtgcagttgttggagtcgtgggggagcttggcacagccgtgggggtcccgagactctcctgtncagcctctggattcgcctttnagacctctgccatgcacgtcgggtcccnccacgccctccgagggggacgggcgtgggaggtgggtctcgagggttagttcgggggtnagttggtactgaaccactaataccgtacgacagtactcgtggaccggaacggggtcccggtttacaacccgtacttaccctaccgagtacgtaacctactttaccgaaacgtaacacctacttactactctacgaactaaacgtacgaacccacctacgaggacggacggaacggaccgaccggtacctaataacttacttacgtaggtacgtacggtaaaggtcggtacgtactagtacgaccgtacggtacggggaccgtaacgggtaacccgtggtacccgtccgtccctacccg

SEQ ID NO: 271535 - DNA, 740 bp, Homo sapiens
  misc_feature: GYAE6OF01A7N7N.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagttgtggagttcgtgggggagcttggcacgagccgtggggggtcccgagactctcctgtgcagcctgtggacttccgtcctttcaagaactctcgcctagtcgctacgtcgggtcccgccaggccctaccggaagggggacggggccgtagggaggttcgggtacctcggtagggttaggttcggggtgacgttggtaactgaccaacgtactaacgtacgccaagtacgtcgtacggacggaaccggggtccggttaccaaacccgtgttaccctaccggaagtacgtaacttaactttaacccgaaacgtaaccctaaccgtactttaccgtaactccgtaacgtaaccctaaaagttcccgaaacccaaacccgttacgaaggtaaccgggaccgaaacgggacccgaacccgggtacctaaagttaacttaagttaccgtaggaacggtaaccggtaaaggttcggtaacgtagtacgtaccgaaccggtacgggccgggaaacccgtaccgggtaaccctaggtcccacccggttcctaccccg

SEQ ID NO: 271536 - DNA, 807 bp, Homo sapiens
  misc_feature: GYAE6OF01BW8QO.40.43.D10.1.454.CMB.1.raw
  modified_base (319)..(319): a, c, t, g, unknown or other
  misc_feature (319)..(319): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttattttaaaaggtgtccagtgtgaggtgcagttgttggagtcgtgggggagtcttggcacagcccgtggggggtccccgagactcctccgtgtgcacgcctctggtattccgtccttttcaagtaaccttctcgccctatcgctaccgtcggggtcccnccgagcccctaccggaagggggtaacggggcttggggaggggttcgggttccggttcgggggttaacgtttcgggggtgtaggtttacgggtacttacggaactaccgtaacgttaaccgtacgacaacgtacttaccgtagggaccgggtaaacggggtccccggtttaccaaccgtacgtttcccgacccgtaacggaacggtaaccctaacttttaccccgaaaaggtaaacccctaacctacccgtttactaacttacccgtaacgtaacctaaaacgttacccgaaacccctaaacccgttacgaagggaccgggtaccggaacgggtaacccaacgggtacccttaagttacgtttaacgttacgttacggtacggtaacgggtaaacgggttggtaacgtaacttaggaccgtacccggtacgggtccggggtacccaacggggtacccgacggttaccccgaccggttccctcgtacccg

SEQ ID NO: 271537 - DNA, 574 bp, Homo sapiens
  misc_feature: GYAE6OF01EWYRR.40.43.D10.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgctccgaggggaaangccaccctctcctgcagggccagtcagagtgtcggcacctttctagcctggtaccaacagaacgcctggccaggcctcccgaggcctcctctatttangaagcgtacgaacgagggccagtggcatccccagccaggttcagtgccaggtggtctgggacagtacttcactctcaccatcagcagcctagacgtcctagaagttatttgactaacttttatactgtaccaccagcgtagcagcgtggccctcgaacgttcggaccgaagggaccgaagggtcggaacacgtacgaaagcgtaacgtgtacggcgttacgacaacccgattaccgttgttacctttactacttccccgtttccccgaccgtacgttccg

SEQ ID NO: 271538 - DNA, 762 bp, Homo sapiens
  misc_feature: GYAE6OF01CTSJ8.40.43.D10.1.454.CMB.1.raw
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
tcagtctagcgactcacgaccggtgctcgatttagactagcagtaagggggagagaggagcccagcccctgggtatttttcaggttgttttcatttggtgatcaggactgaacagagagaactcaccatggagtttggctgagcgtgtcgttttcgtaggtcgcttaagttttaaaaggtgtccgagtgtgaggtgagtgttgtggagtcgtggggagcgttggcacgngccggtcgggggtcccgagtcctctcgtgtgctcgcctgtaggcgttccgtccttcgacgtaacctcgncctancgctaccgtcggtcccacgngtcccgacggagggtacgggtcgtacgggtaggttcggtccgtaggttacggttacggtttgggagtagttacggaccgtagaccgataacgtaaccgtacgcgtactaacgtcgtacggaaccgggtacgtaccgtactacctaacgtcgtaccgtaagtacggtaacctttaacctttaaacgaaacccaaaacgttccctaacttaaccttacgtaccgttaacgaaacttaaacgtacccaaacccgttaacccagggaaccgaacgggaccgaaaccggacccgtaaaccgtcgtaacttaacggttacgttacgtaggtaccgtaaacgggttaggtacgtacgtaaccgttaagtacccggtaaggtaccccgggtacgggtaaccccggtaaccgggttacccgaccggttcccaccgtttcccgaacccg

SEQ ID NO: 271539 - DNA, 847 bp, Homo sapiens
  misc_feature: GYAE6OF01E46FF.40.43.D10.1.454.CMB.1.raw
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
  modified_base (321)..(321): a, c, t, g, unknown or other
  misc_feature (321)..(321): n is a, c, g, or t
  modified_base (760)..(760): a, c, t, g, unknown or other
  misc_feature (760)..(760): n is a, c, g, or t
  modified_base (837)..(837): a, c, t, g, unknown or other
  misc_feature (837)..(837): n is a, c, g, or t
tcagtctagcgactcacgaccggtgctcgatttagactagcagtaagggggagagaggagcccagccctgggtattttcaggttgttttcatttggtgatcaggactgaacagagagaactcaccagtggtagtttgggctgagtctggttctttttctgtgtacttaagttttaaaggtcgtccagtgtgaggtnctagttgtggagtcggtggggngtcgtcggctacgacggccggtcgggggtaccgagtacctcctccgtgtcgcgacgtcgttcgtggtacttccgtcctttacgaagtacctcgtcggacctancgtccgtacggtcgggtccccgaccgtaccgtccccggtacgggaagggggtacgggtcggttaggggtacgggttcgggtacgtacggttagggtttacggggtttacggggtacgtaacggttacggtaacgtacgtaaacccggtaacttaaacctacccggttaaccgaaccgtaacggtttacccgtacgggtaccgggaccggggttaacccgggtacccggtaaccctacctacgttacccgtaacgggtaccgaaccgttaaccctttaaacgttaaccaaaaccgtaaccttaacccccgtaacttaccgtaacgtttaccgaacgtaaaccctaaaaccgtaccgtaaacccccgtaacgttaccggggaagtaacccggggaccgtaaacggaccgtaacgtaacctaagtttacgtaacgttacggngtacggtaagggttagcgttacgacgtagtacggccgtagggacccggtaccgtaaccgtccggtattcccgttccncccgtacccg

SEQ ID NO: 271540 - DNA, 565 bp, Homo sapiens
  misc_feature: GYAE6OF01A620A.40.43.D10.1.454.CMB.1.raw
  modified_base (170)..(170): a, c, t, g, unknown or other
  misc_feature (170)..(170): n is a, c, g, or t
  modified_base (291)..(291): a, c, t, g, unknown or other
  misc_feature (291)..(291): n is a, c, g, or t
  modified_base (340)..(340): a, c, t, g, unknown or other
  misc_feature (340)..(340): n is a, c, g, or t
  modified_base (465)..(465): a, c, t, g, unknown or other
  misc_feature (465)..(465): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctattttaaaaggngtccagtgtgaggtgcagttgtggagtctgggggagcttggcacagcctggggggtcccgagactctcctgtgcagcctcgtggattcgcctttcagaactctgccatgcacgtgggtccncagccctccaggggaacgggctggagtgggtctcgaggtagttcggggnatggtactgacactatactacgcaaggactcgtggaccgtaaggggcccgttacacccgattcctccgagacgtactactttacccaagtaacacactctatctagacaaatcgaccaactcagnggacgagacacggacatatatacgtgtagacggaaggtgtagactagcgacccgagtacggggacctaacgggacccgtaggtaccgtcccgtctacccg

SEQ ID NO: 271541 - DNA, 809 bp, Homo sapiens
  misc_feature: GYAE6OF01BJV50.40.43.D10.1.454.CMB.1.raw
  modified_base (198)..(198): a, c, t, g, unknown or other
  misc_feature (198)..(198): n is a, c, g, or t
tcagtctagcgactcacgaccggtgctcgatttagactagcagtaagggggagagaggagcccagccctgggattttcaggttgtttttcattttggtgatcaggactgaacaggagagaactcaccatgggtaggtttgggctgagcgtggtcgttttctggtggtcttaagttttaaaggtgtcagtgtgaggtgntagttggttggtgtcggtgggggagtcgttggcacgcggccgggtcggggggtcccgagtaccttccgtccgtgtcgcgacggtccttcgtggtacttccgtcctttacgacgtaacctcgtacgacctagtcgaccgtaccggttccggggtacccgacccgtaccggccccgtaccgggaggggggaacggggtcgtaggggtacgggttcgggtaccgtcggtaggggtttagggttcggggtagtacggttcggtactacgaaccgtacgtaacgtaccgtaccgactacgtacgtcgtacggacgggtaaccgggtcccgttacctaccgtactccgtacgtaacgaacgtaccttaacgttaaccaaacgtaaaccacgtaccttactacgttactacggtaaacctaaacgtacccgtaaccctacggtaacgaacgggacggaccggtaacggaacccgtaccgtaactagttaacgttacgttaccgtaggtacgggtaacggttaagggtcgttaacacggttacgaccggtacccgaggggtaccccgggaaccggtaaccgggttccccgtaggtacccctacccggtacctaccccgg

SEQ ID NO: 271542 - DNA, 879 bp, Homo sapiens
  misc_feature: GYAE6OF01A6QJ3.40.43.D10.1.454.CMB.1.raw
  modified_base (195)..(195): a, c, t, g, unknown or other
  misc_feature (195)..(195): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcacctgtctttgtctcgaggggaaancgccacctctcctgcgagggccagtcagtacgtggtccggctacctttcgttacgcccttaggtaacccaaacgacggaacgtccgtagggaccctaagggtccccttaccccggaagggtcccttcccgttacttaaacgtttttagacggtaaacggtccggtaaccggaaaaccggaccgggggtaccctaaccggttcgggtaccctaccgttacccccgaaggtcccgttagggtttaccgaaggttaccggaccgtaggggtttccggggtccgtacgggggtaaacctacggttaacccgtttcaaccctttcctaccgaaccctaacgtccgaaacgtccgaacggtcccgttaaagggcccgtaccgttaagtaacggtttacgtttttacgaccttttaacgtttttaacttacgttaccggtacctaaccggtacggtacggtaacgtaccgtacggtccgttacgggttacccggttaccggtaaccgggttaccgggaacccggtaaacggggtaaccggtaacggtaaccggtaacaacggtaacgtaaacggtaccggtaacggttcgggtacggtacgtccggtaacccgacgtttaccgttccgttacgtttaccgtttacccgttacccgttttaccccttccccggaaccgtttacggttaccgg

SEQ ID NO: 271543 - DNA, 758 bp, Homo sapiens
  misc_feature: GYAE6OF01CPRSZ.40.43.D10.1.454.CMB.1.raw
  modified_base (138)..(138): a, c, t, g, unknown or other
  misc_feature (138)..(138): n is a, c, g, or t
  modified_base (197)..(197): a, c, t, g, unknown or other
  misc_feature (197)..(197): n is a, c, g, or t
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacnccggagaaattctgttgacacagtctccaggcaccctgtctttgtctccgaggggaaancgcccaccctctcctgcacgggccagtcagagtcgtcggctaccttctagccttggtaaccaanagacgcctggaccaggctacccgaggtcctcctcgtatttacgngtaacgccggtacgaacgacggggaccaacgtcgggacctacgtccccgacggtccgtacggttctaacggtcgacccggtaggttcggggtctacgggggaacctaggtaaccttccgaacgttcctacccgtaaccctacttacccgacgtaccgaacggtacccgttaaggaaccggttccgtaaggtaaacgttcgtttttacgaccgttttaaccgttttaacgtttaacgtcggtttaacccgaaccgttagggtacggttaacgtaccgtacgtaccgttaccgggtacccggttaccgggttaaccggttcccggaaccggtaaacgggtacccgtaagggttacgaacgtacgtacgtaacggaccgtaacgtagtccggacttcggacctaaccgtgttaccttcgttaccttccgaactttcccgtaccgtcctgttaccgg

SEQ ID NO: 271544 - DNA, 665 bp, Homo sapiens
  misc_feature: GYAE6OF01BQU30.40.43.D10.1.454.CMB.1.raw
  modified_base (258)..(258): a, c, t, g, unknown or other
  misc_feature (258)..(258): n is a, c, g, or t
  modified_base (338)..(338): a, c, t, g, unknown or other
  misc_feature (338)..(338): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttattttaaaaggtgtccagtgtgaggtgcagttgttggagtcgtgggggagcttggcacgagccgtggggggtcccgagactcgtcctgtgcagcctntggattccgcctttcagaactctgccatgcacgtgggtcccgccacgccctccgaaggggagggcgtggacggtgggtcngaggttaggttcggggtagtaggtggtacgtacggacacgtagtacctaacgaacgtactcgtaggacggaacggggtcccgttacacctatacctacgagacgtactacttaccaacgaacactaacgtactatctacgaactaactacgaccctaaccgtcacggtaaggaccgaaggaaccgaccggactaattaacgttacttacgtagtacggacgggtaaaggttagggtacgtacgtacgtaacggtacccgaccgggtcgggaaccccggaaccgggttacccgttcgggacccgttccccgtcccttcccgtacccgg

SEQ ID NO: 271545 - DNA, 889 bp, Homo sapiens
  misc_feature: GYAE6OF01C1XA6.40.43.D10.1.454.CMB.1.raw
  modified_base (177)..(177): a, c, t, g, unknown or other
  misc_feature (177)..(177): n is a, c, g, or t
tcagtctagcgactcacgaccggtgctcgatttagactagcagtaagggggagagaggagcccagccctgggatttttcaggttgtttttcatttggtgatcaggactgaacagagagaactcaccatggagtttggctgagctggtctttttcgtgtgtctttaattttaaaggtntccagtgtgaggtgcgtagtttggtggagttcggtgggggagtcttggccacgacggtccgggtcggggggtacccgagtaccttcctcgtgtcgcacgtcctcgtcggtacttccgtccttttacgaacgtaaccttcgtcgtaccagttcgccgtaccggttccggggtaccccgtacccgaccgtcccgtaccggggaaggggggacggggtccgttaggggtacggttcggggttaccgtacgggtagggttacggttttcgggggtataggtttaccggtactacggaacctaacgtaacgttaccgtacgcctaacgtacgttcggtacgggtaaccgggaccggggttacccgtttaaccaaccgtaccgttccgtaaccgtaaggtaacctaacccttaaccgtttaacccgaaaccgtaaacctaccgtaccttacctacgttacgaacgtaactaaccgtacccgtaaccgaacccgtaggaacgggaccggtaaccggaacgggacccgtacccggtacttaaacgtttaacgtttaacggttacgttacgggtaacgtaacgggttaaaacgggttcggtaaaccgttaacgttaacggtaacccggtaacccggtaccggggtacccggggttaaaccccggtaaccccggggttaacccgttaccggtaccccgttaccccggttcgttaaccccccg

SEQ ID NO: 271546 - DNA, 701 bp, Homo sapiens
  misc_feature: GYAE6OF01ANXRB.40.43.D10.1.454.CMB.1.raw
  modified_base (138)..(138): a, c, t, g, unknown or other
  misc_feature (138)..(138): n is a, c, g, or t
  modified_base (194)..(194): a, c, t, g, unknown or other
  misc_feature (194)..(194): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacnccggagaaattctgttgacacagtctcaggcacctgtctttgtctccgaggggaanacgcccacctctcctgcgagggccagtcagagtggtcgctaccttcttacgccgtaggaccaagacgaacgccgtggccacggcctccgaggtccttcctactatttacgtacggaacgtccggtacgaacgacggggcctacgtcggaccacgtcccgagccgtaaggttcaggttcgaccgtagggttcgggtcgtacgggggacctacggtaccttcgaccttcctaccaacctagtaccgacgcgtacgtacccgtaaggaccgtaccgtaaggtaacgtttagttttacggtacctttaacgtttttacttaaccgttcgtaacccgtaacgtacggtcgttacgcgtacgtcgtacggtaccgtacgggtaacggttccggaacgtaacgggaccgtaaggtacgacacgacgaacggacgtaagtcggtacggtcgtcggactaaccgtgttaccgttcgttacgttaccttaccgttccctacccgtacgtcgttacgg

SEQ ID NO: 271547 - DNA, 670 bp, Homo sapiens
  misc_feature: GYAE6OF01AUN7L.40.43.D10.1.454.CMB.1.raw
  modified_base (237)..(237): a, c, t, g, unknown or other
  misc_feature (237)..(237): n is a, c, g, or t
  modified_base (343)..(343): a, c, t, g, unknown or other
  misc_feature (343)..(343): n is a, c, g, or t
  modified_base (660)..(660): a, c, t, g, unknown or other
  misc_feature (660)..(660): n is a, c, g, or t
tcagtctagcgactcacgaccggtgctcgatttagactagcagtaagggggagagaggagcccagccctgggatttttcaggtgtttttcatttggtgatcaggactgaacagagagaactcaccatggagttggctgagcgttggtctttttcttgtggtcttaagttttaaaaggtgtccagttgtgtaggtgcgtaggtttggttggagttcggtgggggagtcgttggcacgnggtccggtgggggtcccgagacctcgtccgtgtcgcacgtcctgtggtacttcggtcctttacgaagtaaccttcgtcgacctagtgccgtacgttcgggtccccnccgacggtcccgtacggagggggaacggggtcgtaggggacggttcgggtcgttacggtaggttgggttcgggtgtagttcggttacgagtacaactactacgtacgcgacgtctcgtacggacggacgggtccgttcaaccgtcgtccgtaccaagtacgaacttacttacgaaacacctaactctactagtctagtaactaacgtacaccgtaacagagcgaacgagaccgacggaactattatacgttactggtagaggtaaggtggtacgtacgtagacgtcggtacggacgaccgtacggacgtcgttaccncgttcctccg

SEQ ID NO: 271548 - DNA, 780 bp, Homo sapiens
  misc_feature: GYAE6OF01AMKTN.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggcttaattttaaaaggtgtccagtgtgaggtgctaggttgttggagtcgtgggggagtcgttggcacgacggccggtcggggggtccccggagacctctccgtgtcgccacggtccctcgtggtacttccgtccttttacgaacgtaacctctcgcccatcgctacgtcggtcccgcacgccctacggaggggagggctagggtaggtcgggtctcggtagggttacgttcgggggtgtaggttgggtactcggaaccgtacgtaacgttaacctacggactaacgtaccttcggtacggaacccgggtaacggggttccccggttaccaaccgtacgttacccgtaccgaacggtacgtaaccgttaactttaacccgaaacggtaaaccctaacgtaccttacttactccgttacgaacctaaacgttaccgaaaccctaccgtaacgaacgggaaccggacggtaacccggaaccgaaccggtacctaagttaacgttaacttacggtacggaacggtaacgggtaaacgggttcgtaacgtaacgtagttacccggaacgtaccgggtacggggaccctaaaccggggttaccctcgggtaccctcccgttctacccgg

SEQ ID NO: 271549 - DNA, 688 bp, Homo sapiens
  misc_feature: GYAE6OF01DQTKN.40.43.D10.1.454.CMB.1.raw
  modified_base (677)..(677): a, c, t, g, unknown or other
  misc_feature (677)..(677): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggccaccctgttctttgtctccgaaggggaaagacgcccaccctctcctgcagggccagtcagagtgtccgctacctttctacgcctcggtaaccaacgagaacgccgtggccacggcctcccgaggcctcctctatttagagaacgccggtacgaacgacgggccacgtcggcactcccgagcctaggttcacgtgccgtaggttcgggtcgtagggactaacggtacttaccacttccgtacaaccgtacttacgacggccaacggtacccgtaagtaccgtacccttaaggtaaacgtttacgtttttacgactttaactttttacgttacttcgtaccaccgtagtaccgtacgactacgtccgtcggtacctaccgggtaacggtttcccggaacggtaaccgggtacgtaacgggtgaaccgtagtacgaacggtaccgtaagtcgggtacgcgtacgaccgtactacgttcgttaccgttcttcgtacccttcccgttacccncgtcttaccgg

SEQ ID NO: 271550 - DNA, 611 bp, Homo sapiens
  misc_feature: GYAE6OF01DJCOF.40.43.D10.1.454.CMB.1.raw
  modified_base (137)..(137): a, c, t, g, unknown or other
  misc_feature (137)..(137): n is a, c, g, or t
  modified_base (174)..(174): a, c, t, g, unknown or other
  misc_feature (174)..(174): n is a, c, g, or t
  modified_base (220)..(220): a, c, t, g, unknown or other
  misc_feature (220)..(220): n is a, c, g, or t
  modified_base (266)..(266): a, c, t, g, unknown or other
  misc_feature (266)..(266): n is a, c, g, or t
  modified_base (313)..(313): a, c, t, g, unknown or other
  misc_feature (313)..(313): n is a, c, g, or t
  modified_base (344)..(344): a, c, t, g, unknown or other
  misc_feature (344)..(344): n is a, c, g, or t
  modified_base (370)..(370): a, c, t, g, unknown or other
  misc_feature (370)..(370): n is a, c, g, or t
  modified_base (426)..(426): a, c, t, g, unknown or other
  misc_feature (426)..(426): n is a, c, g, or t
  modified_base (509)..(509): a, c, t, g, unknown or other
  misc_feature (509)..(509): n is a, c, g, or t
  modified_base (552)..(552): a, c, t, g, unknown or other
  misc_feature (552)..(552): n is a, c, g, or t
tcagtctagcgactcacgaccggtgctcgatttagactagcagtaagggggagagaggagcccagcccgtgggattttcaggttgttttcatttggtgatcaggactgaacagagagaactcaccatggagtttggntgagcgtgtcttttctggtgacttaagtttaaaggtntcagtgtgaggtgctagttgttggagtcgtggggagtcttggcacncggccgtgggggtcccgagctccgtcgtgtgcacgcctacgtggtnttccgtctttacgacgtaacctctcgccatcgactcggtcggtcccnctacgcccgtcggaaggggagggtcgtaggnggtcggtctcgagggttcgttggggntaggtgtactcgactacacttacacgcaagcgtacgtggacgggacgtccgtaacncctatccacaagacgtacttacgttaacgaacactactaccgttatactacagtaacaaacgtcgaacccagtcaaggacggngaaccgcgtaccgtactagtacttatacgtgtacgagtaggtntacgtataagcgaacgccgtacgggacccgttaacggacccgtgacctccgtcttcccg

SEQ ID NO: 271551 - DNA, 951 bp, Homo sapiens
  misc_feature: GYAE6OF01AOVBA.40.43.D10.1.454.CMB.1.raw
  modified_base (202)..(202): a, c, t, g, unknown or other
  misc_feature (202)..(202): n is a, c, g, or t
  modified_base (449)..(449): a, c, t, g, unknown or other
  misc_feature (449)..(449): n is a, c, g, or t
tcagtctagcgactcacgaccggtgctcgatttagactagcagtaaggggggaggaactgctcagttaggacccagagggaaccatggaagccccagctcagcttctcttcctcctgctactctgctccagaaacaccggagaattctgtgacacagtcctccgaggccacccttgttctttgtcctaccggaggggaaacncgccctaccctcctcccgtggcgacggcctagtcgaggagtcggtccggtacctacctttcgttaccgccgttaccggtaaacccaactaacgggtaaccgtccgtaccggcccgtaacggttccttccgaccggtcccttacccttaccgttagttttacgtacgaaacgggtcccggtacgaaaaccggccgggtccgtacggtcggtcccaaccgtccccgacggaccgttacgggtttaaccngggtaccgggtcccgtaggggtttacggggtacccggttacgggggaacctaaccgggtttacccgttactaaccccccggttttcaaacccccgaaccccgttttaaggtaccgtaaaccccgacgtttaacccggtaacccggtaaaccggtcccggtttaacgttaaacgggttaaccggttttaccgtttttaacgggtaaccccttttttaccggttttaaacctttacgttaacccgttcccccgtaaacgtacccgggttacgttaaccgtccggtaaccgtttaccggttaccccgtccggttaacccggtaaccggggtttacccgacccgggtaaacgggttacccgggtaaagggtacccggtaacgaaccgtccggaaacggtaccgggtaaccttgggaccgttaccggtccgtacccgttacgtcccgttagtcccgtttaccttaccgggaccctttaccgtaccccttcccgtagtttaacccggg

SEQ ID NO: 271552 - DNA, 824 bp, Homo sapiens
  misc_feature: GYAE6OF01B3JIM.40.43.D10.1.454.CMB.1.raw
  modified_base (668)..(668): a, c, t, g, unknown or other
  misc_feature (668)..(668): n is a, c, g, or t
tcagtctagcgactcacgaccggtgctcgatttagactagcagtaagggggagagaggagcccagccctgggattttcaggtgttttcatttggtgatcaggactgaacagagagaactcaccatggtagtttaggctgagcgtggtcttttctgtggcttaatttaaaaggtgtccagtgtgaggtgctagttgttggagtcgtgggggacgcgttggcctacgacggtccggtcggggggtcccggaagtccgtcttccgtgtcgacctacgccttcgtgggtacttccggtccgttttaccgaaggtaaccttcgttccggaccctaagttccggaacgtacccggttacggggtcccccgcccgaaccggttccccgtaccgggaaacggggggtaacgggtccgtaggggtacgggttcggggttcctaacgggtaacgggttacgggtttaccgggggtagttaggtaaccgggttacgtccggaaccgtacgtaacgtaaccgtacgacgtacgacgttacgtcggacgggtaaccgggtcccggttaccaaccgtactaccgttccgaaacgtaaccggtactaaaccggtttaccaaaacgtaccctaaaccgaccttactacttcgtacgtaactaacgtacccgaccttaaacccgngtaacgacggacgacggtaccgaccggtactaaatcgttaaccttagtacggtagaaaccgttaaggtcgtaacgacgttaacgccggttaaacgccgggtaacgggccgtaaaccccgggttacttaccggacccgttaacccgtctaaccccgg

SEQ ID NO: 271553 - DNA, 898 bp, Homo sapiens
  misc_feature: GYAE6OF01BDIHA.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttggtggtcttaagttttaaaaggtgtcctagtgtgaggtgctaggtttggttggaggttcggtaggggggaggtcgttgggctacgacggtccggtcggggggtacccggagtaccgtcctccgtgtcgccacgtcctcgtcggtacgttccgtcctttcgagtaacctctcgaccagtcgactacgtcgggtcccaccgtacgcccgtacggaggggtacgggtcgtaggtacggttcgggtctacggtaggttacggttcggggtagtacggttacggttacgtacgtactaacgtaacgttaaccgacgtaccgtacggtaccgttacggtacggaccggggtaaaccggggtccccgtttaaccgaaccgttacccgtaccgtaaccggtaaggtaacccgtaactttaaaccggttaccaaaacggtaacccctaacttaaccgttacgttaaccgttcggtaaaccgtaaccgtaaacgtaacccaacccgtttaaacccgacgaacggggtaaacgtccgggtaaacgggaaccccggtaacggttaccctaaaggtttaaattacccgttaaggtaggttaacccgggtaaaagggttaaacgggtcgggttaaacgtaaacccggttgaaaaccccggggtaccccgttaacgggggccccgggttaaaaccgggtaaccccgggttaacccggttaccgggtaaccccgttaccccggtttccccggtaaacccc

SEQ ID NO: 271554 - DNA, 768 bp, Homo sapiens
  misc_feature: GYAE6OF01DS1LD.40.43.D10.1.454.CMB.1.raw
  modified_base (207)..(207): a, c, t, g, unknown or other
  misc_feature (207)..(207): n is a, c, g, or t
  modified_base (283)..(283): a, c, t, g, unknown or other
  misc_feature (283)..(283): n is a, c, g, or t
  modified_base (330)..(330): a, c, t, g, unknown or other
  misc_feature (330)..(330): n is a, c, g, or t
  modified_base (587)..(587): a, c, t, g, unknown or other
  misc_feature (587)..(587): n is a, c, g, or t
tcagtctagcgactcacgaccggtgctcgatttagactagcagtaagggggagagaggagcccagccctggggattttcgaggttgttttcatttggtgatcaggactgacagagagactcacatggagttggctgagtcgtggtctttttcgtggtcggcttaattttaaaaggtgtccagtggtgaggtgcgtaggtttgttggnggtcggtgggggtggtcgttgggccaccgaggccgggttcggggggtacccggaagtccttcgtcctggtcggacncgtccttcgtcggtacttccgtaccgtttcgaacgtaccttcgtacncccgtgtactcgtaacggtccggtaccgaccgaccgttcccgtaacgggtacggggaaggggttccggaggggtcggttacggtccgtaggtaggtttaacggtcgggtagtcggtacgtacttaggacttaacgtacgtaacgtcgacgtaccgtcggtacgtacgggtacgggtaccgggtcccgttaccacgtacttaccgacgaacgtaaccggtacttaaccgttaccgaaatacccactaacgttctacgntaacgaactaacgactaaccgtacgtacggagtaacgggaaccgacgaccggtaacgtactaccggtaactttcgtacgtacggaacggtggtaaacggtcgtaagtaacggttacggacggtaccggacgggttacccggaacgcccggtttaaccggcgttacccggccttcgaacccg

SEQ ID NO: 271555 - DNA, 847 bp, Homo sapiens
  misc_feature: GYAE6OF01EDRNY.40.43.D10.1.454.CMB.1.raw
  modified_base (749)..(749): a, c, t, g, unknown or other
  misc_feature (749)..(749): n is a, c, g, or t
tcagtctagcgactcacgaccggtgctcgattttagactagcagtaaagggggagagaggagcccagcccctgggatttttcaggttgttttcatttggtgatcaggactgaacagagagaactcaccatggagtttgggctgagctggtcttttttcttgtggtcttatttttaaaaggtgtaccagttgtgaggtgctaggttggttggacgttcgtgggggggacgtcgtttgggcaccgacggtccggttcgggggggttaccccgaaggtacctccgttccgtggttagccgacgtcccgttcgttaggtaccgttttccgtccctttttacgaaacggtaaacctttccgtcggtaaccctagttcgaccgaccgtttacgggggttcccccgaccccggaagtccccgttacccggaggggggaaacgggggttcgcgggttaagggttcgggtccgtacgttaagggttacgggttttccgggggttgaacgttttcggggaactttacggaaccgaaacttaaggtaaacccgttacgacgtaaaggttaaccccttgtaagggaccggtaaaaccggggtcccggtttaaccaaccgttaacgttccctaccgaacggtacaaccttacttttaacgaaactaacaaccgtactcctaagtcctaacgactaaaccggttcaaacccaacgttcgaagtacggaacggaacggacgacggtaccaagttatacgttacnggtacggtacgtaacggttaggacgtactagtacggtaccggtacgtacggggtacccgaaggggttaacccctggtacccgtaccgtcccgttaccg

SEQ ID NO: 271556 - DNA, 1133 bp, Homo sapiens
  misc_feature: GYAE6OF01A1D8B.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggtcttagttttaaaaggtgtccagttgtgaggtgcagttgttggagtcgtgggggagcgttggctacgaggtccggtcggggggtccccggtaaggtaccttccgttcccgtggttcggaccgtacgccccgttacgttcgggtaactttcccggttcccgtttttaccgaacgtaaacccgttcgtacggtaccccgaattccgggtacaacccggtttcgggggtcccccgtacccgtaaccggtacccctttaccgggaaaggggggtaaacgggggtccgttagggggtaacggggtttcgggggtttaccgtcggttaacccccggggtttaagggtttttaccggggggggtacgtaagggttttacggggttaaacccgtttacgggaaacccgtaaacgttaaacgttaaacccgttaacccgggtaccgtaacggttaacccgttcgttaccgggaaacgggggtaaaccggggtttcccccggggtttaaccctaaaccgtacgtttaccccgtacccgtaaggaaccggtaaacccgtttaaccgtttaaccccgaaaaaccggtaaaacccttaaaccctaaccgtttaaccctttaaacgtacccggtttaaacgaaacccggtaaaacttaccccgggtaaacccctaaaaaccccggtttcggaaaaaccgggaaccgggggtaccggaaacccggggtaaacccgggtaaacccgggtaacccgtttaacgtttaaacgttttaacggttttacccggttaggggttaacccgggttaaaccggggtaaacggggttttacggggaaaccggtttaaacccggttaagggttaacccccggtaaaacccgtaaaccgggggttaccccgggggtaaacccccgggtaaaacgggggttaacccccccgggttttcggtaaaccccggttaaacccccggtttcccgtaaacccccccggg

SEQ ID NO: 271557 - DNA, 785 bp, Homo sapiens
  misc_feature: GYAE6OF01AYIF7.40.43.D10.1.454.CMB.1.raw
  modified_base (140)..(140): a, c, t, g, unknown or other
  misc_feature (140)..(140): n is a, c, g, or t
  modified_base (157)..(157): a, c, t, g, unknown or other
  misc_feature (157)..(157): n is a, c, g, or t
  modified_base (207)..(207): a, c, t, g, unknown or other
  misc_feature (207)..(207): n is a, c, g, or t
  modified_base (270)..(270): a, c, t, g, unknown or other
  misc_feature (270)..(270): n is a, c, g, or t
tcagtctagcgactcacgaccggtgctcgatttagactagcagtaagggggaggaactgctcagttaggacccagagggaaccatggaagccccagctcagcttctcttcctcctgctactctggcctcccaagaaaacnccggagaaattctgttnacacagtcctacgaggcctaccctgtactttgtctaccgaagggggaaancgaccaccctctcctgcgacgggccagtcagacgtgtcgctaccttctagcctcgtaccaacngaacgccgagccacggcctccgaggcctcctcgtaatttacgtagaacgtaccggtaccgaaagacgggaccacgtcggaactaccacccgacgccgtacggtccgtaagtccggaccgtaggtcggggtaccgtggaacgtagacccttcaacgtccctacacctaacgtcaacgccaacggtaccgtaacgacgtacgtagtaacgtttactttacggtaccttttaacttttaacttaacgttcgttaaacccgaaccgtaaccgtacggtaacctacgggtaaccgttcccggtaccggtaacccgttaacccgggttaaacccgggttaccgggtaaacccgggtaaacgggaaccgggtaaacggtaacgggaaactaccggtaacctaacggaaccggttaacgttacggtacggtccgtggtaaacccctaccgttacttaaccggttaagtttacccttaccgttacccgtaaccccctttccccgttaaaccgtcgttaacccgg

SEQ ID NO: 271558 - DNA, 657 bp, Homo sapiens
  misc_feature: GYAE6OF01ACMUB.40.43.D10.1.454.CMB.1.raw
  modified_base (224)..(224): a, c, t, g, unknown or other
  misc_feature (224)..(224): n is a, c, g, or t
  modified_base (266)..(266): a, c, t, g, unknown or other
  misc_feature (266)..(266): n is a, c, g, or t
  modified_base (301)..(301): a, c, t, g, unknown or other
  misc_feature (301)..(301): n is a, c, g, or t
  modified_base (413)..(413): a, c, t, g, unknown or other
  misc_feature (413)..(413): n is a, c, g, or t
  modified_base (431)..(431): a, c, t, g, unknown or other
  misc_feature (431)..(431): n is a, c, g, or t
  modified_base (546)..(546): a, c, t, g, unknown or other
  misc_feature (546)..(546): n is a, c, g, or t
  modified_base (614)..(614): a, c, t, g, unknown or other
  misc_feature (614)..(614): n is a, c, g, or t
  modified_base (648)..(648): a, c, t, g, unknown or other
  misc_feature (648)..(648): n is a, c, g, or t
tcagtctagcgactcacgaccggtgctcgatttagactagcagtaaggggagagaggagcccagccctgggattttcaggttgttttcgatttggtgatcaggactgaacagagagaactcaccatggagtttggctgagcgtgtcgtttttactggtcgtacttaagttttaaaaggtcgtcagtgtagagtgctagtgttcgagtcgtgggagtcgtacggnacgcgtccggtaggggtcccgagtacctcgtccgtgtcgacncgtcctgtgtcttcgtcctttacacgaccttcgcncgtatcgcgtacggttccgccgtacccgcgacccgtaggaacggggacggtcggtacggtcggtcggttacgtacggtaggttaccggtgggtagtagtcggtaataccganaccgtaacgacgtcgacncgtagttcgacggtaccgtacggtccgtacgccctattaccgacgacgtaactacgttaccttaaacaacgaacctacgtcttaactaccgtgtaaccagaaacctcgacacgtnaggccgacgtaacgcaccgtactagtaacttcgtagcgtacgagtacggtgtaacgtgaacgtaccgnggaccgtaccggcgtaccgtacgcccgttaccgntcgtacccg

SEQ ID NO: 271559 - DNA, 870 bp, Homo sapiens
  misc_feature: GYAE6OF01CJKLM.40.43.D10.1.454.CMB.1.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
tcagtctagcgactcacgaccggtgctcgatttagactagcagtaagggggaggaactgctcagttacggaccagagggaaccatggaagccccagctcagcttctcttcctctagcctactctcggctcccgaaagaaaacgccggaagaaacttctagttcgacactacgttctccgacggacctacctgttcttttagtcctaccggaaggggaaacncgacccctacccttacgttccncggaccggagggacctacgacgaggtacggtcggtaccggtaccttccctttacgtacggaccgttcgtaaccgaacgaacgcgtccgacggtccgaaccggtccgtaccgtaggtacccttccttaccttacggtttaacgtacggtaacgaccggttaacggacggtacccggacgtcctacggacctaccgtccgacggtccttaaggtcgaccgtcggtaacgtcgggtcggtcgtaggaactacgttctacccgacgtcctaaccaccgtcgaactccccgtaagcgttacccggaaacgtccgggtaacttaacggttaacttcgttttaaccgttacctttaacggtttaacttacggttaccgtaacctcggtacgttaaccgttcggtacccggtaaacgttccggttaccgtacccggttaaccggttacccgggaaccggtaacggtaacggggtaacgtaaccggtaacgtaaccgtaacggtacggtaccggtaaggttacgttacccggtcgaaacgttcccgacccgttacggttaccgttacccgttcgtttaaccccgttacggtttccccttaccccgttaaacggttcccggtaccggttttaccggg

SEQ ID NO: 271560 - DNA, 205 bp, Homo sapiens
  misc_feature: GYAE6OF02FZTH8.40.43.D10.1.454.CMB.1.raw
  modified_base (163)..(205): a, c, t, g, unknown or other
  misc_feature (163)..(205): n is a, c, g, or t
tcagtctagcgactcacgaccggtgctcgatttagactagcagtaagggggaggagagggagcccagccctgggatttcaggtgttttcatttggtgatcaggactgaacagagagaactcaccatggagtttgggctgaggcggctggtcaaggcgcatagnnnnnnnnnnnnnnnnnnnnnnnnnnnnnnnnnnnnnnnnnnn

SEQ ID NO: 271561 - DNA, 573 bp, Homo sapiens
  misc_feature: GYAE6OF02HMZ0I.40.43.D10.1.454.CMB.1.raw
  modified_base (169)..(169): a, c, t, g, unknown or other
  misc_feature (169)..(169): n is a, c, g, or t
  modified_base (245)..(245): a, c, t, g, unknown or other
  misc_feature (245)..(245): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (327)..(327): a, c, t, g, unknown or other
  misc_feature (327)..(327): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcggtgtgttctaggtggctatttaaaggntcagtgtgagtgcagttgttggagtctgggggagcttggcacagcctgggggtccgagctctcctgtgcagtcctntggattcgctttcagaactctgccatgcatggggccncagccncgagggacggtctggngtggtctgaggttagtcggggtnagtcggtactcgacacgtactacgacgacacgtctcgcgacggaacggtaccggtacgactactactcgacgacgactacttacaacgaacaactaactactactactacaactaactactaacctaacctacgacgacgacgacgacgacgacactatactacgtagtagtagagtaggtagtacgtactacgtacgtacggtacgggacggaccggtaccgtacggtaccgtaccgtacctccg

SEQ ID NO: 271562 - DNA, 702 bp, Homo sapiens
  misc_feature: GYAE6OF02IPOA0.40.43.D10.1.454.CMB.1.raw
  modified_base (144)..(144): a, c, t, g, unknown or other
  misc_feature (144)..(144): n is a, c, g, or t
  modified_base (173)..(173): a, c, t, g, unknown or other
  misc_feature (173)..(173): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcggngtgtttctaggtcggctaatttaaaaggngtccagtgtgaggtgcagttgttggagtcgtgggggaggcttggcacagccgtggggggtcccggagactctcctgtgcagcctntggnttcgcctttcagaactctgccatgcactggggtcccnccacgcctaccggagggggaacggggtcgtgggaggttcgggtctacgtagggttacggttcgggggtgtacgttcggtacgtcgactaacaacttacgtacgacacgtactcgtcggacggaacgggtcccggttaccaaccgtattcctaccgaaggtacgaacctactttaacccgaaagtaaacctacctacgttactaacttccgtagaactaaactaacgtaaacccaaccctaccgaacggacggacggaacggaccgaccgaaccgtaacgtaacttaacgttacgttacgtacggtacggtaacgggtaggtacggtaacgtacgtacggtaaccgtaccggtacgggaccggaccgggtacccggtaccggtaccggtacccgtaccgtcccg

SEQ ID NO: 271563 - DNA, 670 bp, Homo sapiens
  misc_feature: GYAE6OF02IE80K.40.43.D10.1.454.CMB.1.raw
  modified_base (174)..(174): a, c, t, g, unknown or other
  misc_feature (174)..(174): n is a, c, g, or t
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (301)..(301): a, c, t, g, unknown or other
  misc_feature (301)..(301): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggcgtgagcgtggcttttcgtaggtggctattttaaaaggngtccagtgtgaggtgcagttgtggagtctgggggagcttggcanagccttgggggcccgaagctctccngtgccagtccctntggattcgctttcagaactcctgacctatgcacttggggcccccncacgtcctaccggaggggacgggctggaggtcggtcgtcgtacggtaggtcgggtggtaggtggtacgtacgtacgacgactacgtacgacgacgtacgtcgtcggtacggaacgggtaccgggtaccgaccgtacgtacgtaccgtacgtacgtaactaacttaaccgtaaacgaactaactactactactactacgtacgtaacgtacgaaccaacctacgaacgacggacggaacggacgaaccgacgtaactaactaacgttacgtacgtacgtacggtacggtaggtacggtaacgtagtacgtaccgtaccggtacgggaccggaccgggtaaccggtaccggtaccgtaccggtccgtcccg

SEQ ID NO: 271564 - DNA, 552 bp, Homo sapiens
  misc_feature: GYAE6OF02GH0C6.40.43.D10.1.454.CMB.1.raw
  modified_base (171)..(171): a, c, t, g, unknown or other
  misc_feature (171)..(171): n is a, c, g, or t
  modified_base (291)..(291): a, c, t, g, unknown or other
  misc_feature (291)..(291): n is a, c, g, or t
  modified_base (343)..(343): a, c, t, g, unknown or other
  misc_feature (343)..(343): n is a, c, g, or t
  modified_base (390)..(390): a, c, t, g, unknown or other
  misc_feature (390)..(390): n is a, c, g, or t
  modified_base (495)..(495): a, c, t, g, unknown or other
  misc_feature (495)..(495): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggcgttttctgtggctattttaaaaggngtccagtgtgaggtgcagttgttggagtctgggggagcttggcacagcctggggggtcccgagactctcctgtgcagcctctggattcgcctttcagaactctgccatgcactgggtccnccagccctcgagggaacggggctgggagtgggtctcgaggtattcgggggtnatgggtactgacacatactcgcagactctgcgaagggccgttcaccntctcagacacattcaagaacacactctatctgacaatcaccaacctcagacggcgaggacacggccagtactattactgtgacggtaaggtggtacgaacgttanacggaacccagtcggggaccacgggaaccccgttgggtaccctaccggttctacccg

SEQ ID NO: 271565 - DNA, 569 bp, Homo sapiens
  misc_feature: GYAE6OF02JB564.40.43.D10.1.454.CMB.1.raw
  modified_base (138)..(138): a, c, t, g, unknown or other
  misc_feature (138)..(138): n is a, c, g, or t
  modified_base (194)..(194): a, c, t, g, unknown or other
  misc_feature (194)..(194): n is a, c, g, or t
  modified_base (250)..(250): a, c, t, g, unknown or other
  misc_feature (250)..(250): n is a, c, g, or t
  modified_base (285)..(285): a, c, t, g, unknown or other
  misc_feature (285)..(285): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacnccggagaaattctgttgacacagtctccaggcacctgtctttgctccaggggaaangccacctctcctgcagggccagtcagagtgtcggcaccttctagcctggtaccaanagaagcctggccaggctccgaggctcctcatttangaagcgtacgaaacagggccacgtggcactcccagccaggttcagtcgccaggtgggtctgggactagacttcactctcacatcagcagcctagacgtcctagaagtatttgacttacttttacttactgttaccaacctagtacgttagcagtcgtacggtccttacggaacgttccggaccgaacgggacctaagggtcggacagtacgaacgtacgaaccgtgtacgcgtcggaccactacgtcttacgtaccttccattcccgttcccgacctacgttcg

SEQ ID NO: 271566 - DNA, 542 bp, Homo sapiens
  misc_feature: GYAE6OF02IVIBC.40.43.D10.1.454.CMB.1.raw
  modified_base (196)..(196): a, c, t, g, unknown or other
  misc_feature (196)..(196): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaanagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacngacttcactcncacatcagcagcctagngcctagaagtattttgctactttattactgtcaccagtcgtagcagctggccctacgtaaccgttcggaccgaacgggaccgaaggtcggacacgtacaacgacgaactgtcgacgtcgccacctattccgtgttaccttctacttccttcccgtcctacttcg

SEQ ID NO: 271567 - DNA, 576 bp, Homo sapiens
  misc_feature: GYAE6OF02GDKGZ.40.43.D10.1.454.CMB.1.raw
  modified_base (292)..(292): a, c, t, g, unknown or other
  misc_feature (292)..(292): n is a, c, g, or t
  modified_base (393)..(393): a, c, t, g, unknown or other
  misc_feature (393)..(393): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtctgggggaggcttggcacagcctgggggtcccggagactctcctgtgcagcctctggattcgcctttcagaactctgccatgcactgggtccnccagccctccgaggggaaggggctgggagtgggtcctcgaggtagttcgggggtgaagtggtactgacacatactacgcagactctgcgaagggcccgttnacctatctccagacgactattccaaagaacacactcatctgacaaatcgaaccaacctcaagacggcgaggacacggccagtatacttacgtgtacgacggtaaggtggagtaactaatcggaaccctaacggtcggggacccaacggggtaaccctcgggtacccacccggttcgtaccccg

SEQ ID NO: 271568 - DNA, 587 bp, Homo sapiens
  misc_feature: GYAE6OF02ILP4K.40.43.D10.1.454.CMB.1.raw
  modified_base (196)..(196): a, c, t, g, unknown or other
  misc_feature (196)..(196): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaanagccaccctctcctgcagggccagtcagagtgtcggcaccttcttagcctggtaccaacagaagcctggccaggcctcccaggcctcctcatttatgaagcgtacgaaacgacggggccacgtgggccagtccccgagcccgtaaggttccaggtcgccaggtgggtctgggacagtacttcactctcacatcancagcctagcncctagaagtatttgactactttattactgtacaccgagtcgtacgcagctcggcctacgtaacgttcggaccgaacgggaccgtaagggtcgacgtaatacgaaagacgaacgtggtacggcgtcgaccgaactacgttcgttcggttacctttacgtaccgttcccgttcccgtaccctataccg

SEQ ID NO: 271569 - DNA, 582 bp, Homo sapiens
  misc_feature: GYAE6OF02G99J3.40.43.D10.1.454.CMB.1.raw
  modified_base (441)..(441): a, c, t, g, unknown or other
  misc_feature (441)..(441): n is a, c, g, or t
  modified_base (482)..(482): a, c, t, g, unknown or other
  misc_feature (482)..(482): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctattttaaaaggtgtccagtgtgaggtgcagttgttggagtcgtgggggaggcttggcacagccgtggggggtcccgagactctcctgtgcagcctctggattcgcctttcagaactctgccatgcacgtgggtccgccagccctccgaggggaagggctgggagtgggtctcgaggttagttcgggggtgagtggtactgacacatactacgcagactcgtgacgaagggtcccgttacacctatcctaccagacgactattaccaaagaacacactctatcnacaatcgaccaactcagagcgacgacgacgccatatatacngtacgacggtaaggtggtacgaacgttagacggaacccgtacggtaggggacccgtaacggggtaaccccctggggtaccctacccggttcccgtacccg

SEQ ID NO: 271570 - DNA, 586 bp, Homo sapiens
  misc_feature: GYAE6OF02G5GNT.40.43.D10.1.454.CMB.1.raw
  modified_base (289)..(289): a, c, t, g, unknown or other
  misc_feature (289)..(289): n is a, c, g, or t
  modified_base (337)..(337): a, c, t, g, unknown or other
  misc_feature (337)..(337): n is a, c, g, or t
  modified_base (531)..(531): a, c, t, g, unknown or other
  misc_feature (531)..(531): n is a, c, g, or t
tcagtctagcgactcacgaccggtgctcgatttagactagcagtaagggggagagaggagcccagccctgggatttcaggtgttttcatttggtgatcaggactgaacagagagaactcaccatggagtttgggctgagcgtggcttttctgtggctattttaaaaggtgtccagtgtgaggtgcagttgttggagtctgggggagcttggcacagcctggggggtcccgagactctcctgtgcagcctctggattcgcctttcagaactctgccatgcactgggtccnccagccctcgaggggaagggctggagtgggtctcgaggtattcggggnagtggtactgacacatactacgcagactcgtgcggtaacggggtcccgttacacctagtcctaccaagacgactacgtttaccaaagtaaccacgtacctctaactctagacaaatcgaaccaacctcaacgacggacgacggaccgaccggccaatactaacttacgtgtacgacggtaagtggtagacttanacggacctacggtcggggaccgaacgggtacccgtggtacctaccggtctacccg

SEQ ID NO: 271571 - DNA, 538 bp, Homo sapiens
  misc_feature: GYAE6OF02GK3KZ.40.43.D10.1.454.CMB.1.raw
  modified_base (288)..(288): a, c, t, g, unknown or other
  misc_feature (288)..(288): n is a, c, g, or t
  modified_base (339)..(339): a, c, t, g, unknown or other
  misc_feature (339)..(339): n is a, c, g, or t
  modified_base (469)..(469): a, c, t, g, unknown or other
  misc_feature (469)..(469): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtgcttttctgtggctatttaaaggtgtccagtgtgaggtgcagttgttggagtctgggggaggcttggcacagcctggggggtcccgagactctcctgtgcagcctctggattcgcctttcagaactctgccatgcactgggtccnccagcctccgaggggaggggctgggagtggggtctcgaggtatcgggggtnagtggtactgacacatactacgcagactctgcgaagggccgttcaccatcctccagagactatttccaaagaacacactctatctgcaaatcgaccaacctcagacggcgaggacacggccatatatacngtgacgtaaggtggtacaacgtatacggacctacgtggggccacgggaccctgggtccacccgtctccc

SEQ ID NO: 271572 - DNA, 533 bp, Homo sapiens
  misc_feature: GYAE6OF02GYYUK.40.43.D10.1.454.CMB.1.raw
  modified_base (195)..(195): a, c, t, g, unknown or other
  misc_feature (195)..(195): n is a, c, g, or t
  modified_base (258)..(258): a, c, t, g, unknown or other
  misc_feature (258)..(258): n is a, c, g, or t
  modified_base (288)..(288): a, c, t, g, unknown or other
  misc_feature (288)..(288): n is a, c, g, or t
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgctccaggggaaanagccacctctcctgcagggccagtcagagtgtcggcaccttcttagcctggtaccaacagaancctggccaggctcccaggctcctcatttangaagcgtacgaacagggccactggcatcccagcctaggttcagtgccagtggtctgggacagacttnactctcacatcagcagcctagagcctgaagtntttgctacttttattactgtacaccgagcgtagcagcgtcgcctcgacgttcggaccaagggaccaaggtcgacagtacgaacgtcgaacgtgtcggctggaccaccgtatcgtcgtcttcgtacttccgttcccgcctactaccg

SEQ ID NO: 271573 - DNA, 592 bp, Homo sapiens
  misc_feature: GYAE6OF02IXD5G.40.43.D10.1.454.CMB.1.raw
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (346)..(346): a, c, t, g, unknown or other
  misc_feature (346)..(346): n is a, c, g, or t
  modified_base (409)..(409): a, c, t, g, unknown or other
  misc_feature (409)..(409): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctaattttaaaaggtgtccagtgtgaggtgcagttgttggagtctgggggagcttggcacaggcctggggggtcccgagactctcctgtgcagccctctggattcgcctttnagaactctgccatgcacgtgggtccnccagccctcgaggggagggctgggaggtgggtctcgaggtagttcgggggtnagtggtactggacacgatactacgcaagactcgtggacggtaagggcccgttcaccacttccncgagacactattaccaagaaccacactactatctgaacaaatcgaacccaacctcgaagacggacgacggaccacggaccaatacttaattacgtagtcgacgaaagggtggtaagacttagtacggaaccgtacggtggggacccaacggggtaaccctgggtacccgtacccgtactcccg

SEQ ID NO: 271574 - DNA, 578 bp, Homo sapiens
  misc_feature: GYAE6OF02HBXIX.40.43.D10.1.454.CMB.1.raw
  modified_base (291)..(291): a, c, t, g, unknown or other
  misc_feature (291)..(291): n is a, c, g, or t
  modified_base (343)..(343): a, c, t, g, unknown or other
  misc_feature (343)..(343): n is a, c, g, or t
  modified_base (402)..(402): a, c, t, g, unknown or other
  misc_feature (402)..(402): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctattttaaaaggtgtccagtgtgaggtgcagttgttggagtctgggggagcttggcacagccgtggggggtcccgagactctcctgtgcagcctctggattcgcctttcagaactctgccatgcactgggtccnccagcctccgaggggaagggctgggagtgggtctcgaggtagttcgggggtnagtggtactggacacatactacgcagactctggacgaagggccgttcaccatctccagnactatttccaaagaaccacactactactctagacaatcgaacccaactcaagacgcgaacggaccacggccaatattactacgtgtagacggtaaggtggtacgaactagtacggaaccctacggtcggggacccgaaccggggtacccttacgggtaccctacccggtctacccg

SEQ ID NO: 271575 - DNA, 567 bp, Homo sapiens
  misc_feature: GYAE6OF02IT4V3.40.43.D10.1.454.CMB.1.raw
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (469)..(469): a, c, t, g, unknown or other
  misc_feature (469)..(469): n is a, c, g, or t
  modified_base (499)..(499): a, c, t, g, unknown or other
  misc_feature (499)..(499): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggcttaattttaaaaggtgtccagtgtgaggtgcagttgttggagtcgtgggggagcttggcacagccgtggggggtcccgagactctcctgtgcagcctctggattcgcctttcagaactctgccatgcacgtgggtccnccagccctaccgaggggaacggggctgggaggtgggtctcgaggttagttcgggggtnagtggtactgacacatactacgcagactcgtgacggaagggtcccgttacacctactcctaccagacgactattaccaaagaacacactctatctagacaaatcgaaccaacctnaggagcgagacagtcgactataatattacngtagacgtaaggtggtagaactagtacgaactaggtcgggaccaacgggacccgtggtaccaccgtcc

SEQ ID NO: 271576 - DNA, 601 bp, Homo sapiens
  misc_feature: GYAE6OF02HVR62.40.43.D10.1.454.CMB.1.raw
  modified_base (294)..(294): a, c, t, g, unknown or other
  misc_feature (294)..(294): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (408)..(408): a, c, t, g, unknown or other
  misc_feature (408)..(408): n is a, c, g, or t
  modified_base (461)..(461): a, c, t, g, unknown or other
  misc_feature (461)..(461): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggtcttttctgtggctaattttaaaaggtgtcagtgtgaggtgcagttgttggagtcgtgggggagcttggcacgagccgtggggggtcccgagactctctgtgcagcctctggattcgctttcagactctgccatgcacgtggggtcccnccaggccctccgaggggtaggggctggagtgggtctcgaggtgttcggggtnagtggtactgacacntacagcaagactcgtggacgaagggtccgttacaccatcctaccganacgacctatttaccaaagaaccactaactctatcagacaaatcaaccaacctnaacggaggacgaacggaccaacggcctaagtaattacgttacgtggtagaccggtaaggtggtacgaacttagtccgaaccgtagggtcgggaccctaacggggaaccccttgggtaaccctacccggttcttaaccccg

SEQ ID NO: 271577 - DNA, 648 bp, Homo sapiens
  misc_feature: GYAE6OF02IPIRP.40.43.D10.1.454.CMB.1.raw
  modified_base (298)..(298): a, c, t, g, unknown or other
  misc_feature (298)..(298): n is a, c, g, or t
  modified_base (382)..(382): a, c, t, g, unknown or other
  misc_feature (382)..(382): n is a, c, g, or t
  modified_base (543)..(543): a, c, t, g, unknown or other
  misc_feature (543)..(543): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggcttttctgtggctaattttaaaaggtgtccagtgtgaggtgcagttgttggagtcgtgggggagcttggcacgaggccgtggggggtcccgagctctcctgtgcagcctcgtggattcggcctttcagaactctgccatgcacgtggggtccncaggccctccgaaggggaacgggctggacggtgggtcctcgaagggtgttcggggtgaagtgggtactggaccacgattaaccncggcaaggtactccgtggaccggaaagggggtccccgttcaacccgtatccgtccgaagacgaactatttaccaaacgaacactactactaatcgtagacaaaatcgaaaccctaacgtcgaagacggcggaacgacgaccggccaattataacgttacgngtacgtaacggaagggttggtaacgtaacttagaccggaaccctacgggtacgggggccctaaaccggggaaccccttgggtaccccgtaacccgtcctaacccg

SEQ ID NO: 271578 - DNA, 583 bp, Homo sapiens
  misc_feature: GYAE6OF02H699H.40.43.D10.1.454.CMB.1.raw
  modified_base (196)..(196): a, c, t, g, unknown or other
  misc_feature (196)..(196): n is a, c, g, or t
  modified_base (238)..(238): a, c, t, g, unknown or other
  misc_feature (238)..(238): n is a, c, g, or t
  modified_base (292)..(292): a, c, t, g, unknown or other
  misc_feature (292)..(292): n is a, c, g, or t
  modified_base (397)..(397): a, c, t, g, unknown or other
  misc_feature (397)..(397): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgctccaggggaaagngccaccctctcctgcagggccagtcagagtgtcggcaccttntagcctggtaccaacagaacgcctggccaggcctcccaggcctcctcattttangaagcgtacgaacgcgggccacgtggcactcccagcctaggttcagtcgccgaggtgggtctggggaacaggtactttcacttcacaccatcagcacgcctagcncctagaagtattttgactactttattactcgtaccacgtacgcgtagcagcgtcggacctacggtaacgttcggaccgtaacgggaaccgaagggtacggaacacgtacgaacgacgtaacgtggtcggcgtgaccaccgacttcgtcgttccttactaccttcccgttcccgtacctacttaccg

SEQ ID NO: 271579 - DNA, 559 bp, Homo sapiens
  misc_feature: GYAE6OF02GCA9V.40.43.D10.1.454.CMB.1.raw
  modified_base (195)..(195): a, c, t, g, unknown or other
  misc_feature (195)..(195): n is a, c, g, or t
  modified_base (289)..(289): a, c, t, g, unknown or other
  misc_feature (289)..(289): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgctccaggggaaanagccaccctctcctgcagggccagtcagagtgtcggcaccttcttagcctggtaccaacagaagcctggccaggcctccaggctcctcatttangaagccgtacgaacgagggccacgtggcactcccagcctaggttcagtcgccaggtgggtctgggacagtacttcactctcacatcagcacgcctagactcctagaagtattttcgcttaactttacttactcgtaccactagtcgtagcagcgtcgtcctacgtaacgttcggaccgtaacgggaccgtaaggtcggaactagtacgaaggacgtacgtggtcgacgtcgacacctattctgttcttctacgttcctacccgcctatcg

SEQ ID NO: 271580 - DNA, 571 bp, Homo sapiens
  misc_feature: GYAE6OF02HDJ61.40.43.D10.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaanagccacctctcctgcagggccagtcagagtgtcggcaccttcttagcctggtaccaacagaagcctggccaggcctcccaggcctcctcatttangaagcgtacgaaacagggccacgtggcactcccgagccaagggtttccaaggtcgccaggtgggtctgggacagtacttcactctcacntcagcagcctagacncctagaagtnttttgctactttattactgtacaccagtcgtagcagtctggtcctacggtacgttcggaccgaacgggacgaagggtcgacaacgtacgaagcgaacttcggtcggtaccgtgaccaaccgtacttcgttacgttcctttacaccttccttaccccgcctactccg

SEQ ID NO: 271581 - DNA, 595 bp, Homo sapiens
  misc_feature: GYAE6OF02IWRDV.40.43.D10.1.454.CMB.1.raw
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtgtcgttttctaggtggctaatttaaaaggtgtccagtgtgaggtgcagttgttggagtcgtgggggagcttggcacagccgtggggggtcccgagacctctcctgtgccagcctctaggnttcgcctttcagaactctgccatgcacgtgggtcccnccagcctccgaagggggaacgggctgggagttggggtctcgaggttagttcggggganagtggtactgaactacataccacgcagacttcgtggacgaagggcccggttacacccgtatcctccagacgtactattccaaagaaccacaacctntaatcngaacaaatcgaacccactacaggacgcgacggacaacggcataacgttactacgtgtagacggaaaggttggtagacttaagtcgaacctacggtggacccgagggaacccttggtacccaccggttcctacccg

SEQ ID NO: 271582 - DNA, 620 bp, Homo sapiens
  misc_feature: GYAE6OF02GUWLO.40.43.D10.1.454.CMB.1.raw
  modified_base (217)..(217): a, c, t, g, unknown or other
  misc_feature (217)..(217): n is a, c, g, or t
  modified_base (291)..(291): a, c, t, g, unknown or other
  misc_feature (291)..(291): n is a, c, g, or t
  modified_base (380)..(380): a, c, t, g, unknown or other
  misc_feature (380)..(380): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtctgggggagcttggcacngcctgggggtcccgagactctcctgtgcagcctctggattcgcctttcagaactctgccatgcacgtgggtccnccagcctccgagggggaacgggctgggaggtcgggtctcgagggttagtcgggggtatagtgggtactgacactatactacgcagctcnggacgaagggtcccgttacaccatcctaccagacgactactttacaacgtaaccacactctaatctagacctaaatcaacctaacctgaacggacggacgacggaccgacggacctaattacgtaacttacgtgtacgacggtaagggttggtacgaacgtagttacggaacccgtacgggtaccggggacccggacggggtaaccccgttgggtacccgtacccggttcccgtaccccg

SEQ ID NO: 271583 - DNA, 566 bp, Homo sapiens
  misc_feature: GYAE6OF02HLCT1.40.43.D10.1.454.CMB.1.raw
  modified_base (350)..(350): a, c, t, g, unknown or other
  misc_feature (350)..(350): n is a, c, g, or t
  modified_base (556)..(556): a, c, t, g, unknown or other
  misc_feature (556)..(556): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtctgggggaggcttgggcacagcctggggggtcccggagactctcctgtgcagcctctggattcgcctttcagaactctgccatgcactgggtcccgccagcctccgaggggaacggggctgggaggtgggtctcgagggtattcgggggtnagtggtactgacacatactacgcagactctggcgaaggggtccgttcaccatcctaccagacactatttaccaagaaccacactctactctagacaatcaaccaacctcacgagacgaggaccacggacctaatactattactgtcgacggtaaggtggtagaactagtacgaaccacggtcgggaccgacgggaccctggtaccnccgtctcccg

SEQ ID NO: 271584 - DNA, 694 bp, Homo sapiens
  misc_feature: GYAE6OF02GUNBE.40.43.D10.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
tcagtctagcgactcacgaccggtgctcgatttagactagcagtaagggggtagggaactgctcagttaggacccagagggaaccatggaagccccagctcagcttctcttcctcctgctactctggctcccagaaaacaccggagaaattctgttgacacagtctccaggcaccctgtctttgtctccgagggaaangccacctctcctgcgagggccagtcagagtgtcggctaccttcgtacgcctggtaccaanagaacncctgccaggctcccgaggctcctnatttangaacgcgtacgaacgagggccacgtcgcactcccgagaccgaggttcacggttcgaccgtaggtcgggtctagggaacacgtaccttacgaccttctccgaacctatccgaacgtcacgtacccgtagtaacgtaccgttaggtaaacgtttacgttttacgacctttaacgttttattaccggtacgtacctaaccgtggtaaccgttacgacgtacggtcgtacggtccctaacgggtaaccgttccggaacggtaacgggaaccgtaacgggtacgaactaccggtacgaaacggtcgtaaccgttggtaccggtcgtacccgtacctaacccgtacgttaccgttccgttaccgttacctacccgttccccgttacccggtaacctacgttaccgg

SEQ ID NO: 271585 - DNA, 598 bp, Homo sapiens
  misc_feature: GYAE6OF02GGR06.40.43.D10.1.454.CMB.1.raw
  modified_base (195)..(195): a, c, t, g, unknown or other
  misc_feature (195)..(195): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgctccaggggaaangccacctctcctgcagggccagtcagagtgtcggcaccttcttagcctggtaccaacagaagcctggccaggctcccaggctcctnatttangaagcgtacgaacagggccacgtggcactcccagcctaggttcagtcgcctaggtcggtcgtgggacagtacttcactctacacctatcagcacgcctagacgtcctagaacgtatttcgacttactttattacgtgtaccaccgagtcgtagcacgcgtcgcctacgtaccgttccgaccgtaacgggaccgtaaggtcggaacagtacgaaagtaccgaacgttgggtcggtaccgtggaccctaaccgtaacgttccgtacgtttccttaccgtaacctttcccgtttaccccgaccttacgttaccg

SEQ ID NO: 271586 - DNA, 581 bp, Homo sapiens
  misc_feature: GYAE6OF02INWHC.40.43.D10.1.454.CMB.1.raw
  modified_base (290)..(290): a, c, t, g, unknown or other
  misc_feature (290)..(290): n is a, c, g, or t
  modified_base (461)..(461): a, c, t, g, unknown or other
  misc_feature (461)..(461): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggcttatttaaaaggtgtccagtgtgaggtgcagttgttggagtcgtgggggagcttggcacagcctgggggtcccgagactctcctgtgcagcctctggattcgcctttcagaactctgccatgcactgggtccnccagccctccgaggggaacggggctgggaggttggggtctcgagggttagttcgggggtgtagttggtactgacacatactacgcagactctagcgaagggccgttacacctatcctaccgaagacgactattaccaagaactacactctatctgacaaatcgaaccactnacgagcgaggacacgactaatactatactagtcgacggtaaggtggtacgtaactagtacgaccgtacggtcggggacccgaacggggtaccccttgggaccctacccggtacctacccg

SEQ ID NO: 271587 - DNA, 603 bp, Homo sapiens
  misc_feature: GYAE6OF02IITOH.40.43.D10.1.454.CMB.1.raw
  modified_base (169)..(169): a, c, t, g, unknown or other
  misc_feature (169)..(169): n is a, c, g, or t
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
  modified_base (447)..(447): a, c, t, g, unknown or other
  misc_feature (447)..(447): n is a, c, g, or t
  modified_base (466)..(466): a, c, t, g, unknown or other
  misc_feature (466)..(466): n is a, c, g, or t
  modified_base (508)..(508): a, c, t, g, unknown or other
  misc_feature (508)..(508): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctatttaaaggtntccagtgtgaggtgcagttgttggagttcgtgggggaggcttgggcacagccgtcggggggtcccgagactctcctgtgcagcctcgtggacttcgcctttcagtaactctgccatgcacgtggtccnccagcctcgaggggagggctggagtgggtctgtaggtagttcggggngagtcggtactcgacacagtaactacgcagactcgaggacggaacggggtccgttcaccgtatccctacagtacactattaccaaagacacactactatctanactaaatcgaacctacctnaagggacggccgaacggccaacggctaattacttaattacgngtacgacggtaaggtcggtagaacttacgaggaacccgtacggtacggggaccctaacggggtaccccgtggtacccgtacccggtctacccccg

SEQ ID NO: 271588 - DNA, 786 bp, Homo sapiens
  misc_feature: GYAE6OF02G7CV0.40.43.D10.1.454.CMB.1.raw
  modified_base (266)..(266): a, c, t, g, unknown or other
  misc_feature (266)..(266): n is a, c, g, or t
  modified_base (309)..(309): a, c, t, g, unknown or other
  misc_feature (309)..(309): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggctattttaaaaggtgtccagtgtgaggtgctagttgttggagtcgtggggggagtcgttgggcacgaggccgtggggggtcccgaggacctctccgtgtgcagcctcgnggattcgcctttcgagaactctgccatgcacgtcggggtcccnccaggtccctccgagggggaacggggccttggggacggttggggtcctacgtagggttaacgtttcggggggtagtaggtgggtaaccgtggaacctaacgtagttaaccgaaacggcctaagggtaacccttccgtgggaacccggggtaacgggggtccccggttttaccaaaccccagtttacccgtacccgaagaaccggtacctaaacggttttaccccaaaacggaaacctaccaacttaccctaagttcctaacgaacgtaaaacttcggaaaccccctaaaaccgtcaaacgggaacggaccggttaaacgggacccgtaaccggcctaaacgttataaaccgttaccgtggtacgaacggtaaaggggcggttacgaaagttaccgtacggtaaacccgtaccggtagggggacccctaacggggtaaacccccggttggaacccttacccgggtacccttaccccgg

SEQ ID NO: 271589 - DNA, 610 bp, Homo sapiens
  misc_feature: GYAE6OF02GKZTH.40.43.D10.1.454.CMB.1.raw
  modified_base (255)..(255): a, c, t, g, unknown or other
  misc_feature (255)..(255): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaanagaagcctggccaggcctcccaggctcctcatttatgaagcgtacgaacagggccacgtggcactcccagccaggttcagtcgccaggtcgggtcgtgggacaggacttcactctcacctatcagcagcctagacgccgtagaagtattttgcttaactttacttactacgtccaccgagacgttacgctagctcgggccctacggtaaccggttaccggaccgtaacgggacccgtaaggtacgggaaccaagtaccgaagtaccgaacgttcgtacgggtacgtaggacctacccgtaagttaccgttagttacgtttaccgtacttccctttacccgtacccttagttaccg

SEQ ID NO: 271590 - DNA, 642 bp, Homo sapiens
  misc_feature: GYAE6OF02I3HGX.40.43.D10.1.454.CMB.1.raw
  modified_base (376)..(376): a, c, t, g, unknown or other
  misc_feature (376)..(376): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttctgtggcttaattttaaaaggtgtccagtgtgaggtgctagttgtggagtcgtgggggagtcttggcacagccggtgggggtcccgagactctcctgtcgcacgcctcgtggacttcgcctttcagtaacctctcgcctatcggctacgttcggggtcccaccacggccctaccggaaggggacgggtctagggacggtcgggtctacgaggttacgtcggggtntagtcggtactgacactagtaccgtagcaagtctcgtcggacgtacggtccgtcaccgtatccgacagacgactacttaccaagacacactactactctacgaactaatcaaccctactcaacggacgtacgacgaccgacggacctaagttactacgtacgtagtcgtaacggaagggttcggtaagtacgtaacacggtaaccctcgggtaaccgggacccgtaacgggtaacccgtacggtacctacccggtccttaaccccg

SEQ ID NO: 271591 - DNA, 587 bp, Homo sapiens
  misc_feature: GYAE6OF02IVBWF.40.43.D10.1.454.CMB.1.raw
  modified_base (169)..(169): a, c, t, g, unknown or other
  misc_feature (169)..(169): n is a, c, g, or t
  modified_base (249)..(249): a, c, t, g, unknown or other
  misc_feature (249)..(249): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggcttttctgtggctattttaaaggngtccagtgtgaggtgcagttgtggagtctgggggagcttggcacagcctgggggtcccgagactctcctgtgcagcctcnggattcgcctttcagaactctcgccatgcacgtcgggtcccgaccacgccctccgaggggacggggctggagtgggtctcgtaggtagttcggggtgagtggtactggacacatactacgcagactctgacgaacggcccggttcacctactccgtccaggacgtactactttaccgaacgtaacactaacttctaactctagactaaatcgaacctaacctcacggagacgacggaccgacgaccagtactataccgtagtgacgaaggtggtagtaactagcggaaccctaggtccgggacgaccggaacccgtggtacccgtaccgtcctacccg

SEQ ID NO: 271592 - DNA, 681 bp, Homo sapiens
  misc_feature: GYAE6OF02HOSQM.40.43.D10.1.454.CMB.1.raw
  modified_base (306)..(306): a, c, t, g, unknown or other
  misc_feature (306)..(306): n is a, c, g, or t
  modified_base (363)..(363): a, c, t, g, unknown or other
  misc_feature (363)..(363): n is a, c, g, or t
  modified_base (485)..(485): a, c, t, g, unknown or other
  misc_feature (485)..(485): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggtctttttcttggtggctaattttaaaaggtgtccagtgtgaggtgcagttgttggagtcgtgggggagcttgggcacgagccgtggggggtcccgagactctcctgtgcagcctcgtggattccgcctttcagtaacctctgccatcgcacgtcgggtccnccagccctaccgaaggggacgggctgggaggtcgggtctacgaggttgttcggggtnagtggtactgaacacaataccgtacggcaacggtactcgacggcggaacggggtcccgtaccaccgtatcctccgaagtacgcctaacgtttaccaaagaacccactacttctaactccganaacaaactcgaaacccaccgtacgaaggtacggacgtaacggaccgaccggtacctaatttaaccttaagttaaccgtggttaacgggacggttaaagggttggtaacgtaacgttacgtaccggaacccacgggttaccgggggacctaaaccgggggtacccttcggggtaaccctacccggtccttaccccgg

SEQ ID NO: 271593 - DNA, 631 bp, Homo sapiens
  misc_feature: GYAE6OF02GUTUF.40.43.D10.1.454.CMB.1.raw
  modified_base (296)..(296): a, c, t, g, unknown or other
  misc_feature (296)..(296): n is a, c, g, or t
  modified_base (352)..(352): a, c, t, g, unknown or other
  misc_feature (352)..(352): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtctgggggagcttgggcacagccgtggggggtcccggagactctcctgtgcagcctctggattccgcctttcagaactctgccatgcacgtgggtccnccagccctccgaaggggagggctgggaggtgggtctcgagggttagttcgggggtnagtgggtacctggaccacatactacgcaagactcgtgacggaacggggtcccgttacaacccgtatcctaccgaagacgactactttaccaaacgaacacactctactctagacaaatcgaaccaacctcaacggacggacgaacggaccgaaccggaccaattaataacgttaactgtacgacggtaagggttcggtacggaacttacgtacggaacccgtaacggtccggggacccgaacggggtaccccttgggtaccctacccggttctaccccg

SEQ ID NO: 271594 - DNA, 735 bp, Homo sapiens
  misc_feature: GYAE6OF02H1M7I.40.43.D10.1.454.CMB.1.raw
  modified_base (192)..(192): a, c, t, g, unknown or other
  misc_feature (192)..(192): n is a, c, g, or t
  modified_base (236)..(236): a, c, t, g, unknown or other
  misc_feature (236)..(236): n is a, c, g, or t
tcagtctagcgactcacgaccggtgctcgatttagactagcagtaagggggaggaactgctcagttaggacccagagggaaccatggaacgcccagctcagcttctcttcctcctgctactctggctccagaaaacacggtagaaattctgtgacacagtctcaggcacctgtctttgctccgaggggaaancgccacctctcctgcacgggccagtcagacgtgtcggctacttntagcctaggtaccaatgaacgctgccaggctcccaggcctccatactttagcgaacgtcgtacgaaacgcgggtccagtcggacacgttcccaggccgtaggttcaacggtcgaccgaggttcgggtctacggggaactacggtacctttacgacgttccttaccgaaaacgtcttaccaacgggtcctaaaccgggtacccgttaagggaacccggttccgttaaaggaaacggtttacgtttttccgactttaaacggttttaaccttacggttacggtaccaacgttagggacccgtttaagacgtaacgtcggttaaccggtcctaaccggaaggtttcccggtaaccggaaccggggtttaaccaacggggtttacggaaccgtaacgtacggtaaacgtaccgggtacgtaaccgtgggtccctaaggaccctacgaaacgttcgtacggtttcttaacgtcctttaccggtttcccgacccttacgtaccgg

SEQ ID NO: 271595 - DNA, 828 bp, Homo sapiens
  misc_feature: GYAE6OF02GLB9R.40.43.D10.1.454.CMB.1.raw
  modified_base (196)..(196): a, c, t, g, unknown or other
  misc_feature (196)..(196): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaangccaccctctcctgcagggccagtcagagtgtcggcaccttntagcctggtaccaanagaagcctggccaggcctccaggtctcctcatttatgaagcgtacgaacgacgggaccacgttcggaccaacgtccccgagtaccgaggtttaccaggtcgaccgtagggttcggggtctagggggacctaggtacctttcgaaccttcgtaccaaccgtaattaccgaacggccgaacgtcccgttaagggaccgtaccgttaacgggaaacgttttacgtttttacggacctttaaaccgtttttttaacgtttaaccgttggtaccctaaacccggtaacgggttaccggttaacggacctaacgggttccggtttacccggggtaccccgtttaaccggggtaaacccgggtttcccggaaaccgggtaaaccggggtaaacccggtaaaggggtacgtaaaaccgaacgttacccgaaaagggttacccggtaaacgttaccggggttacggttacccggtacggttaaccccgtaaacccgttgttaaccccggtttttagttaacccggtttacccgttaaccgtttacccccggttttccccccgggacctttacggttaaccccgg

SEQ ID NO: 271596 - DNA, 539 bp, Homo sapiens
  misc_feature: GYAE6OF02HM4L7.40.43.D10.1.454.CMB.1.raw
  modified_base (196)..(196): a, c, t, g, unknown or other
  misc_feature (196)..(196): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
  modified_base (534)..(534): a, c, t, g, unknown or other
  misc_feature (534)..(534): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaanagccaccctctcctgcagggccagtcagagtgtcggcaccttcttagcctggtaccaacagaagcctggccaggctcccaggctcctcatttatgaagcgtcgaacaggggccactggcatcccagccaggttcagtgccagtggtctggacagactttcactctcaccatcagcagcctagactcctgaatattttgctactttattactgtcaccgagtcgtacgcgagtccgtgcctacgaacgttcggaccgtaacgggaccgaaggtcggaacacgttcaaacgtacgacgtgtcggcgtgcaccgntcgtnttcttacntccgtcccgcctntaccg

SEQ ID NO: 271597 - DNA, 660 bp, Homo sapiens
  misc_feature: GYAE6OF02HA10Z.40.43.D10.1.454.CMB.1.raw
  modified_base (305)..(305): a, c, t, g, unknown or other
  misc_feature (305)..(305): n is a, c, g, or t
  modified_base (427)..(427): a, c, t, g, unknown or other
  misc_feature (427)..(427): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggtctttttctgtggcttaattttaaaaggtgtccagtgtgaggtgcagttgttggagtcgtggggggagcttggcacaggccgtggggggtcccgagactcctcgtgtgcagcctcgtggacttccgcctttcagaactctcgccatgcacgtcgggtccnccagccctaccgaggggacggcgtagggaggtcgggtctcgagggttacgtcggggtagtagtggtactggaacctacgactacgacgcaaggactcgtaggacgaacgggtcctacacctntccgtacagactactacttaccaagaaccacactctaatcagaacaatcgaaccctaatcgaagaggacgaacggaccgaccgacctaatacttaacgtacgtagtacgggaaccggtaagggttcggtaacggtacctttaaggaacccggtaacccgtaaccgggttacggggaccccggtaaaccggggttccccggtacggttacccggtaccccggtccttaacccgg

SEQ ID NO: 271598 - DNA, 742 bp, Homo sapiens
  misc_feature: GYAE6OF02GHSAV.40.43.D10.1.454.CMB.1.raw
  modified_base (175)..(175): a, c, t, g, unknown or other
  misc_feature (175)..(175): n is a, c, g, or t
  modified_base (340)..(340): a, c, t, g, unknown or other
  misc_feature (340)..(340): n is a, c, g, or t
tcagtctagcgactcacgaccggtgctcgatttagactagcagtaaggggggagagaggagaccagccctgggattttcaggtgttttcatttggtgatcaggactgaacagagagaactcaccatggagtttgggctgagcgtggtcgttttctaggtggctaattttaaaggngtccagtgtgaggtgcagttgttggagtcgtgggggagcttggcacagccgtgggggtcccgagctctcctgtgccagccctctggacttccgcctttcaagaacctctcgcccagttcgcacgtcgggtcccgccagccctccggagggggaagggcttagggngttggggtcctcgaagggttacggttcgggggtagacgttggtaactggtaaccactaacgtaccgtaacgctagacctcgtcgggacgggtaacggggtccccggtttacaaccctagtacccgtaccgaacgtacgaacttaacttttaacccgaaacggtaaaccaacctaccttactaacctcttacgaactaaactacgaacccaaccgtaccgaaggacggcggtaacgacgtaaccggacctaagttaacttaacttacgtacggtacgtaccgggtaagggttgggtaccgtaaacgttaaggtccggtaacccggtaacggttaccgggggaacccggtaaccggggtaaccccgggttccgggtacccggttaccccggttacccgtacccg

SEQ ID NO: 271599 - DNA, 580 bp, Homo sapiens
  misc_feature: GYAE6OF02I3YMF.40.43.D10.1.454.CMB.1.raw
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
  modified_base (374)..(374): a, c, t, g, unknown or other
  misc_feature (374)..(374): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctattttaaaggtgtccagtgtgaggtgcagttgttggagtcgtgggggagcttggcacagccgtggggggtcccgagactctcctgtgcagcctctggattccgcctttcagaactcngccatgcacgtgggtccnccagccctcgaggggacgggctgggaggtggtctcgaggttagttcgggggnagtggtactgacacatactacgcagactntgcgaagggcccgttacacatcctacagagactattaccaagaaccacactctatctagacaatcgaacctaacctcacggacggacgacggaccgacggaccaagtacttaattacgttagtacgaccggtaaggtcggtagtaacttagacgaccgacggtacgggccgtaacgggtacccgtaggacctaccgtccgtacccg

SEQ ID NO: 271600 - DNA, 645 bp, Homo sapiens
  misc_feature: GYAE6OF02I2X8J.40.43.D10.1.454.CMB.1.raw
  modified_base (137)..(137): a, c, t, g, unknown or other
  misc_feature (137)..(137): n is a, c, g, or t
  modified_base (194)..(194): a, c, t, g, unknown or other
  misc_feature (194)..(194): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (389)..(389): a, c, t, g, unknown or other
  misc_feature (389)..(389): n is a, c, g, or t
  modified_base (591)..(591): a, c, t, g, unknown or other
  misc_feature (591)..(591): n is a, c, g, or t
tcagtctagcgactcacgaccggtgctcgatttagactagcagtaagggggaggaactgctcagttaggacccagagggaaccatggaagccccagctcagcttctcttcctcctgctactctggctccagaaaacnccggagaaattctgttgacacagtctccaggcacctgtcttgtctccgaggggaaangccaccctctcctgcagggccagtcagagtgtcggctaccttcttagcctcggtaaccaacagaagcctggccaggcctccgaggctcctgtactttagacaagtcgtacgaacagggccactggcactccagcctaggtcagtcgacctaggnggttcnggacagtacctcgactacctgaacctagtccgaanccgaacgtccaaggtacgccgtagaacgttactttcggactttaacgttttacttacggtgttaccaaccgtaggttaccggtagaccgtagtaccggtgtacccttacgggaaaccggtttccgaccgggaaacgggtaacccgtaaacggttcgggaaaccacggttaaacgacgaacgaacgttcggtagtccgtaacncggacctaatccgttacggtacctccgtacgttccgtccctaccgtataaccgg

SEQ ID NO: 271601 - DNA, 604 bp, Homo sapiens
  misc_feature: GYAE6OF02ILYDE.40.43.D10.1.454.CMB.1.raw
  modified_base (304)..(304): a, c, t, g, unknown or other
  misc_feature (304)..(304): n is a, c, g, or t
  modified_base (358)..(358): a, c, t, g, unknown or other
  misc_feature (358)..(358): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggctattttaaaaggtgtccagtgtgaggtgcagtttgttggagtcgtggggggaggcgtttgggcacaggccgtggggggtcccggagacctctcctgtgcagcctctggattcgcctttcagaactctgcccatgcacgtgggtccnccagccctccgaggggaaggggctgggagtgggtctcagggttattcgggggtntagtgggtactgacacatactacgcagactcgtggacggaacggggtcccggttacaaccctagtcctaccaagagaacctatttaccaaagaacacactctatctagactaaatcgaaccaacctcaagaggcgaaggaccaacggcaatattaacttactgtagacggtaaggtggtacgaacttagcgaaccgtacgtcggggaccgaacggggaacccctgggtacccgtacccgtctcccg

SEQ ID NO: 271602 - DNA, 617 bp, Homo sapiens
  misc_feature: GYAE6OF02FXK78.40.43.D10.1.454.CMB.1.raw
  modified_base (287)..(287): a, c, t, g, unknown or other
  misc_feature (287)..(287): n is a, c, g, or t
  modified_base (338)..(338): a, c, t, g, unknown or other
  misc_feature (338)..(338): n is a, c, g, or t
  modified_base (466)..(466): a, c, t, g, unknown or other
  misc_feature (466)..(466): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtgcttttctgtggctatttaaaaggtgtcagtgtgaggtgcagttgttggagtcgtgggggagcttggcagagccgtgggggtcccgagctctcctgtgcagcctcgtggattcgcctttcagactctgccatgcactgggtccncacgcctcgagggacgggctggagtgggtactcgaggttagttcggggtanagtggtactgacacgtatacgacgcagactcgtggaccggaaggggcccgtttacaaccgtacgtcctacccgagtaacgacctaactttacccgaaagtaaacccacctaacctcttatcctagaanaaacttcgaacccaacctagacgaggacgaacggaccgtaacggaccagtaacttactacgttcgtaggacgtaagggtcgtacggaacttagaacgaccgtcgggacgggaccgaacgggtaaccctggtaccctaccggtcctaacccg

SEQ ID NO: 271603 - DNA, 713 bp, Homo sapiens
  misc_feature: GYAE6OF02JLN2Y.40.43.D10.1.454.CMB.1.raw
  modified_base (194)..(194): a, c, t, g, unknown or other
  misc_feature (194)..(194): n is a, c, g, or t
  modified_base (289)..(289): a, c, t, g, unknown or other
  misc_feature (289)..(289): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgctccgagggaanagccacctctcctgcaggccagtcagagtgtcggcaccttctagcctggtaccaacagacgcctggccaggcctcccgaggctcctacattttanggaacgtccgtacgaaacgtacgggccctaacgtcggactaacgtccccaaggcccgtaaggtttccaaggttcgaccctagggttcggggtaccttgggggaaccacgggttaaccttttccgaaccgtttcgtacccgaacctattccgaaggtcccaaggttaccccgtaaggacggtacccgttagaaacgtttacgttttacggaccttaacggttttacttaaccgtgttacccaaccgtacgtcgttacgaccgtacgccgttacggtcccgtacggttaaccggtccggaccgtaacgggaacccgtaagggtacgacgtaacgtacgtaacgacgtaacgtcggtagccggttcgaccaccgtactccgttagtccgtttaccgaactttcccgttacccgtccttagttacccg

SEQ ID NO: 271604 - DNA, 604 bp, Homo sapiens
  misc_feature: GYAE6OF02HCU2I.40.43.D10.1.454.CMB.1.raw
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggcttaattttaaaaggtgtccagtgtgaggtgcagttgttggagtcgtggggggagcttggcacacggccgtggggggtccccggagacctcctccgtgtgccagcctcgtggattccgcctttcagaactctgccatgcacgtgggtccnccagccctcgaggggagggctggagtgggtctcgaggtgttcggggntagtcggtactggactacatactacgcagtactcgtgacggaacgggtcccggttacaccgtatcctaccgagacgactacttaccaaagaacacactctaatcagactaaatcgaaccctaactcgaagacgccggaaaggaccgaccggcctaatacgttaacttacgtgtagacgaaggttggtagaactagtacgaccgtagtcgggaccgaacgggtacccgttggcccgtaccgtccgtacccg

SEQ ID NO: 271605 - DNA, 764 bp, Homo sapiens
  misc_feature: GYAE6OF02I05WC.40.43.D10.1.454.CMB.1.raw
  modified_base (301)..(301): a, c, t, g, unknown or other
  misc_feature (301)..(301): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttctgtggcttaattttaaaaggtgtccagtgtgaggtgcagttgttggagtcgtgggggagtcttggcacagccgtgggggtcccgagacctctcctgtgcagtcctctggattcgcctttcagaactctgccatgcacgtggtcccgcanccctccgaggggtaagggctgggaggtcgggtctcgagggttagtccggggtagacgttgggtactggaaccactaagtaaccgttaccggacaacggaaccttcgtggaaccgtaacggggggtacccgttacgaaccccgtaacgttacccgtaccgtaacgtaaacggtaacctaaccttttaacccgtaaaggaaaccctaacgacccttacttacctaccgttaaccggacaaaacgttaagaaccccgtaacccctacgaggtaacgaaccgggtaccgaaaccgacccgggtacgtaactaaagtttaacttaaccgttagttacgggaaccgttaaaggggtcggttagtaaaccggttaccttgggtaaacccgaccggttaccgggggaacctaaccggggggttaaacccccttgggtaacccccgttaccgggtaacccccttttcccggg

SEQ ID NO: 271606 - DNA, 645 bp, Homo sapiens
  misc_feature: GYAE6OF02F75AI.40.43.D10.1.454.CMB.1.raw
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
  modified_base (348)..(348): a, c, t, g, unknown or other
  misc_feature (348)..(348): n is a, c, g, or t
  modified_base (401)..(401): a, c, t, g, unknown or other
  misc_feature (401)..(401): n is a, c, g, or t
  modified_base (573)..(573): a, c, t, g, unknown or other
  misc_feature (573)..(573): n is a, c, g, or t
tcagtctagcgactcacgaccggtgctcgatttagactagcagtaaggggaggagaggagccagccctgggatttcaggtgttttcatttggtgatcaggactgaacagagagaactcaccatggagtttgggctgagctggctttttctgtggactattttaaaacggtgtccagtgtgaggttcgcagttgttggagtccgtgggggagcttgggcacgagccgtggggggtcccgagactctccgtgtgacngcctcgtggattcgcctttnagaactcgtgctatcgcatggtccgccaggcctccaggggacggctgggatcgggtctgacgtagtcggggtnagtgactcgacacgataccgtgcgtaagactccgtgacggaagggtccccgtntaacccggattaccgtccgaagtacgaactacgtttcccgaaagtaacccgactacgtactaacgtcctaggacccaaattaccggaacctaaccgttacaaccgtagggacccgaaggtaccacggggaccctataagtaccgttacagttagacccgtaaaggttcggtntaaccgtaagtaccggaccgaagttacgggacccgacgggaacccttgggtacccacccggtttcaacccgg

SEQ ID NO: 271607 - DNA, 617 bp, Homo sapiens
  misc_feature: GYAE6OF02FS3NT.40.43.D10.1.454.CMB.1.raw
  modified_base (195)..(195): a, c, t, g, unknown or other
  misc_feature (195)..(195): n is a, c, g, or t
  modified_base (251)..(251): a, c, t, g, unknown or other
  misc_feature (251)..(251): n is a, c, g, or t
  modified_base (380)..(380): a, c, t, g, unknown or other
  misc_feature (380)..(380): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctcaggggaaangccacctctcctgcagggccagtcagagtgtcggcaccttctagcctggtaccaanagagcctggccaggctccaggctcctcatttatgaagcgtacgaacagggccactggcatcccagccaggttcagtcgcctaggtggtctggggacaggactttcactctcaccatcagcagcctaganccgtgaagtattttcgctaacttttattacctgttaccaccgacgtcggttagccagtccgtcggccttacggaacgtttccggaccgaacggggtacccgtaagggtcggaactaacgtaccgaacggaccggtaacttcggtacgggtccgttcggaccctaacccgtacgttaccgttaggtttaccctttccgttaaccgttccctttaccccgggacccttacgttacccgg

SEQ ID NO: 271608 - DNA, 566 bp, Homo sapiens
  misc_feature: GYAE6OF02GY83E.40.43.D10.1.454.CMB.1.raw
  modified_base (293)..(293): a, c, t, g, unknown or other
  misc_feature (293)..(293): n is a, c, g, or t
  modified_base (346)..(346): a, c, t, g, unknown or other
  misc_feature (346)..(346): n is a, c, g, or t
  modified_base (406)..(406): a, c, t, g, unknown or other
  misc_feature (406)..(406): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttgtggagtcgtgggggagcttggcacagccgtggggggtcccgagactctcctgtgcagcctctggattcgccttttcagaactctgccatgcactgggtccnccagccctccgaggggaaggggctgggagtgggtctcagggtattcgggggtnagtggtactgacacatacctacgcagactctgcgaacggggcccggttcacccgtatccnccagagactactttaccaagaaccacactctactctgacaaatcgaaccaacctacagacggacgacggaccacggaccagtatacttactgtgacgaaggtggtagactatcgaccgacgtcgggaccgacgggaacccgtggtaccgaccgtctcccg

SEQ ID NO: 271609 - DNA, 590 bp, Homo sapiens
  misc_feature: GYAE6OF02FN5JQ.40.43.D10.1.454.CMB.1.raw
  modified_base (144)..(144): a, c, t, g, unknown or other
  misc_feature (144)..(144): n is a, c, g, or t
  modified_base (166)..(166): a, c, t, g, unknown or other
  misc_feature (166)..(166): n is a, c, g, or t
  modified_base (170)..(171): a, c, t, g, unknown or other
  misc_feature (170)..(171): n is a, c, g, or t
  modified_base (173)..(173): a, c, t, g, unknown or other
  misc_feature (173)..(173): n is a, c, g, or t
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
  modified_base (395)..(395): a, c, t, g, unknown or other
  misc_feature (395)..(395): n is a, c, g, or t
  modified_base (449)..(449): a, c, t, g, unknown or other
  misc_feature (449)..(449): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcggngtgttctaggtgcattaaaggntcanngngtgcagtntgatntgggagctgcangcctggggtccgagctctcctgngcagcctnggattcgcctttcanaactctgcctatgcactgggtccncagtcctccggaggggaaggggctgggngtcgggtctcgagggtagttcggggtgagttgggtaactgacactagtacctacgccaagtcgtctcggacggaacggggtcccggttacaacccggtntcctccgaacgactactacgtttaccaaaaggaccaactacctacgtatcgtanacaactcgacccaaactcaggagcgacgacgacgacctagtaactattacgtgtcgaggtaaggtcggtacgactacgtacgaacccgcggtacggggacccgtaacggggaccccttaggtacccgtaccgtccctaccg

SEQ ID NO: 271610 - DNA, 724 bp, Homo sapiens
  misc_feature: GYAE6OF02FU664.40.43.D10.1.454.CMB.1.raw
  modified_base (332)..(332): a, c, t, g, unknown or other
  misc_feature (332)..(332): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggcttattttaaaggtgtccagtgtgaggtgctagttgttggagtcgtggggggagtcttgggcacgagcccgttgggggggtccccgaagtaccttcgtcccgtggtcgccagtccctgtgggactttccgccttttacagtaacctctcgccagtgcctacgttcggggtccccncccgtaacgccccttacccggaaggggggtaacgggggcctagggtacggttcgggggtccttacggaggggttagtttcgggggggtagaggttgggtacgtcgactaccgtataccgtacgcctaaggaccttcgtacggaccggtaacgggggtccccggttcaacccgtcttcgtcccgaagacgacttacgtttaccaaagtaaccacgtactactactcgtacgtaactaatacgaaccctactcaagggacgtacgacggacctaccggacctagtacgttacttacggtgtacgtacggtagtggtactacggtaactaccggacccgtacggtaccgggacccgtacggggtacccgttcggtaccgtacccggtctaccccg

SEQ ID NO: 271611 - DNA, 604 bp, Homo sapiens
  misc_feature: GYAE6OF02HKF75.40.43.D10.1.454.CMB.1.raw
  modified_base (199)..(199): a, c, t, g, unknown or other
  misc_feature (199)..(199): n is a, c, g, or t
tcagtctagcgactcacgaccggtgctcgatttagactagcagtaaggggggaggaactgctcagttaggacccagagggaaccatggaagccccagctcagcttctcttcctcctgctactctggctcccagaaaacaccggagaaattctgttgacacagtctccaggcaccctgtctttgtctccgaaggggaaancgcccaccctctcctgcgagggccagtcagagtgtcggctaccttctacgcctggtaacccaacagaacgccgtggccaggctcccgaggcctcctctatttagtagaagtcgtacgaacgacgggccacgtggacactcccagccaggttcagtcgcctaggtgggtctgggacagtactcactctcacatcagcacgaccctaggaccgtcgaagtaacgttattttacggacttaacgttttaacttacgttcgttaccaacgacggtacgtacgcagtcgtcggaccctacggacggttccgaccgtaacgggacgtaacggtggacatacgaagacgtacgtggtcggctagacctacgattcgtcgttacgttactacttccgttcccgacctataccg

SEQ ID NO: 271612 - DNA, 641 bp, Homo sapiens
  misc_feature: GYAE6OF02IF31Q.40.43.D10.1.454.CMB.1.raw
  modified_base (300)..(300): a, c, t, g, unknown or other
  misc_feature (300)..(300): n is a, c, g, or t
  modified_base (392)..(392): a, c, t, g, unknown or other
  misc_feature (392)..(392): n is a, c, g, or t
  modified_base (418)..(418): a, c, t, g, unknown or other
  misc_feature (418)..(418): n is a, c, g, or t
tcagtctagcgactcacgaccggtgctcgatttagactagcagtaaagggggagagaggagcccagccctgggattttcaggtgttttcatttggtgatcaggactgaacagagagaactcaccatggagtttgggctgagctggctttttcttgtggctattttaaaaggtgtccagtgtgagtgcagttgttggagtcgtgggggaggcttggcacagccgtgggggtcccggagactctcctgtgcagcctcgtggacttccgcctttcaacgaactctgccatgcacgtgggtccnccacgcctccgaggggaaggggctgggaggtgggtctcgaggttgttcgggggtgagttcggtactgacacgtatactaacgcacgactcgngacggaagggcccgttacaccatccnccgaagacgaactacgtttaaccaaagaaccatacctactactctagactaaacgtacgaaccctaaccgtacgacggaggacgaacggacacgacctagtaaccttagttactagtacggtaacggtaggttacgggtagtaaacttacggaccgtaaccgtacggtaccggggacccggaacgggtaaccccgtacgggttcccacccggttccgtacccg

SEQ ID NO: 271613 - DNA, 666 bp, Homo sapiens
  misc_feature: GYAE6OF02GCDSE.40.43.D10.1.454.CMB.1.raw
  modified_base (168)..(168): a, c, t, g, unknown or other
  misc_feature (168)..(168): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctatttaaaggngtccagtgtgaggtgcagttgttggagtctgggggagcttggcacagccgtggggggtcccgagacctctcctgtcgcagcctntggattccgcctttnagaactctgccatgcacgtgggtccncagcctcgaggggacgggctgggagtgggtctacgaggttagttcgggggtnagtgggtactggaccacgtacttacacgcagactcgtcgacgggaacgggtcccgttaccaaccgtactcctaccgaaggtacgtaactacgtttaacccgaaagaaaccctaacgaccttacttactccgtagtaacctaaactaccggaaacccaaccctcgaacggacggacggaacggaccaccggacctaagtacttacgttacgtaggtcggtaacggtaagggttggtaacgtaactagtacggaacccgtagggtccggggtaaccgaaccgggggtacccgttacggtacccgtacccggttcctaacccgg

SEQ ID NO: 271614 - DNA, 734 bp, Homo sapiens
  misc_feature: GYAE6OF02F9DYE.40.43.D10.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgttctttgtctccgaggggaaanacgcccaccctctcctgcacgggccagtcagagtgtcggctaccttctagccttggtaccaacgagacgccgtggccaggccctccgaggcctcctactattttacngaacgtcgtacgaacgcgggcccagtcggacctaccgtcccaaggccgtagggtttccaacggttcgaccgtaggggttcgggtaccgtaggggaacctaggtacctttcgaaccttccgtacaacctagtcacgtcaaccgtcctaaggactccgtagtaaacgtttacgttttacgacgtttaaccttttacgttacgttacggttacccaaccggtacggtaccggttaagacccgtacggtaccgttcgggacccgttaaccgggtaacgttcccgggtaaccggaaccgggtaaccgtaacgggtaccggaacgtacgtaacgtaaccggtacgtaaccgttggaccggtcgaccgtaccgtaccgtacgtttccgtacgtttccttaccgtaccgttcccgttaccccgtactacggttaccg

SEQ ID NO: 271615 - DNA, 706 bp, Homo sapiens
  misc_feature: GYAE6OF02IHIM7.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaaactcaccatggagtttgggctgagcgtgtcgttttctaggtggctaatttaaaaggtgtcagtgtgagtgcagttgttggagtctgggggagtcttggcacaggccgtgggggggtcccgagaccgttcctccgtggtcgcacgcctgtggattcgctttcagaactctgccatcgcacgtcggtccgccacgccctcccggaggggaacggggtcgtagggaggttcgggccttcgagggttacgttcgggggtagtaggttgggtactggaaccaccgtaaagtacgtacgacagtacctcgtggacggtaacgggtcccggttacaccgtactccgtcgtaacgggactaaccgttactttaaccgaaacgtaaacctactacgttactacgtcctagtaacaaacgttcgaaaccctaacctcgaacggaggccgaacggaccgaacccgaacctaagttaacttaacgttcgtaacgggtaacgacgggtaagggtttcggaacgtagttaacacggtacccgacgggttaccgggacccggtaacgggtacccggttaccggtcccacccggtttcgaccccg

SEQ ID NO: 271616 - DNA, 770 bp, Homo sapiens
  misc_feature: GYAE6OF02I7DQF.40.43.D10.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaacaccggagaaattctgttgacacagtctccaggccaccctgtctttgtctccgaggggaaangccaccctctcctgcagggccagtcagagtgtcggcctaccttctagcctaggtaccaacagaacgcctggccaggcctcccgaggcctcctctatttanagaacgtccgtacgaacgacgggcccacgtggacactccccgagcccgtaggttacacgtcgcccgtagggtcggggtcgtcggggaccaacggtacctttacaccgttcctaccaaccctacttaccgaacgtaccgaacggtccccgtaagggtaccgtaccgtttaaggtaaacggtttacgtttttacggtaacctttaaacgtttttaaccgtttaccgtttaccggttacccttaacccgtacggttaccggttaaacgtcgtaacgtccgttaccgggcccgtttaaccggtaacccggtttacccgggaacccgtaaccgggggtaaaccgtaacggggtacgtaaccgtaagtaacccgaacggaccgttaacgtacggttacggaccgtcggacctacctaacgttccgttccggtttacttaccgttaccgtttacccgtcccccgttacctacgttaccgg

SEQ ID NO: 271617 - DNA, 755 bp, Homo sapiens
  misc_feature: GYAE6OF02IRN8E.40.43.D10.1.454.CMB.1.raw
  modified_base (259)..(259): a, c, t, g, unknown or other
  misc_feature (259)..(259): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggcttattttaaaaggtgtccagtgtgaggtgcagttgttggagtcgtgggggaggcttgggcacaggccgtggggggtcccggagactctcctgtgcagcctntggattcgcctttcagtaacttctcgcccatcgccacgtcggggtcccgccacgccctccggaagggggaacggggccgtggggacggttcgggggttctcggtaagggttagttcgggggtagtagttggtactgacactatactacgcagactcgtacgacggaacgggtcccggttaccaccgtactcctaccgaagacgtaacctaatttacccgaaaagtaaccctaacctaaccttaccttaactccgttaacggaacctaaaacgttaccgaaacccctaaaacccgtccggaaaggtacggggaaccgggtaacggaaaccgaacccgggtacctaaagtttaaacttaacgtttaaccgtacgggttacggaacgggtaaagggttcgggttacgtaacgttaacgtacggtacccgtaaccggttcgggggaacccgtaacggggtaaccccgttacgggtaacccttacccggtaccttaccccg

SEQ ID NO: 271618 - DNA, 799 bp, Homo sapiens
  misc_feature: GYAE6OF02GFQNN.40.43.D10.1.454.CMB.1.raw
  modified_base (172)..(172): a, c, t, g, unknown or other
  misc_feature (172)..(172): n is a, c, g, or t
  modified_base (204)..(204): a, c, t, g, unknown or other
  misc_feature (204)..(204): n is a, c, g, or t
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcggcgtggttctaggtcggctaatttaaaggngtcagtgtgagtgcagttgtggagtgtggggngngtgcacncgcggtggggtccggacgtacgtctcgtgtcgacgcgtccgtcgtcgtacgttccgttccttactaacgtaaccttcgtcgtacacgtcgtacctaccggtccggtccggtaccgtaccgtacccggtaccgggaacgggggtaacggggtacggtagggtacgggttacgggtcggttacggtaacgggtttacgggtttcggggttagggttacggttacggttacgtacggtaaccgtaacgtaaccgtaacgtacgtacgtacgtaacgtacgtacggtacgggtaacgggtaccggtaccgtaacctacgtaccgtaccgtacgtaacgtaccgtaacgttaactaacgaactaaccgtaccttactactacgtacgtaacgtaacgtaaccgtaaccgtaaccgtaacgacggtacggaacggaaccggaaccgtaaccgtaacgtaacgtaacgttacgttacgtacgtacgtaacgggttagggtacggttacgtaaccgtacgtacggtaaccggtaccggtaccgggtaccggtaccgggttacccggtaccggtacccgtacccgtaccgtaccg

SEQ ID NO: 271619 - DNA, 879 bp, Homo sapiens
  misc_feature: GYAE6OF02HT4E8.40.43.D10.1.454.CMB.1.raw
  modified_base (172)..(172): a, c, t, g, unknown or other
  misc_feature (172)..(172): n is a, c, g, or t
  modified_base (749)..(749): a, c, t, g, unknown or other
  misc_feature (749)..(749): n is a, c, g, or t
tcagtctagcgactcacgaccggtgctcgatttagactagcagtaagggggagagaggagcccagccctgggatttcaggtgttttcatttggtgatcaggactgaacagagagaactcaccatggagtttgggctgagctggtctttttcgtgtggctaattttaaaggtntccagtgtgaggtgcagttgtggagtcgtgggggagtcttgggcacgagccggtaggggggtcccgaggtacctcgtccgtggtacgcacgtccttcgtaggactttcgcccttttacgaacgtaaccttcgtagccctaagttcgtcctaaccggttcggggtacccccgaccgaaccggtcccccgttacccgggaaagggggggaacgggggtcccgttaggggggtaacggggttcgggtttccctacgggtaagggggtttacggttttccggggggtaattaacggttgggttaaaccgtcggtaaaccaaacgttcttaaaccgtaccggacttaacggtaaccttcgtacgggaaccggtaaacggggttccccgttaacacccgtaagtttcccgaaccgaaggtaacctaaacgtttacctttaaccgaaaaacgacctaactaaccgttacttaagacccttacggaacctaaaactccgttaaaccccaacgtacgaacgggtaaccgaaccggtaaccggtaaccggacccggtaaccttaagttaaacgtttaccggtttacnggggttaacgtaacggggtaaacggtttgggtaacctaacgttaacggtaaccggaccgttaacgggtaccggggaacccgtacgggttaaaccccctggggttaacccccttccgggtaccttccccgg

SEQ ID NO: 271620 - DNA, 679 bp, Homo sapiens
  misc_feature: GYAE6OF02HDYFN.40.43.D10.1.454.CMB.1.raw
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
  modified_base (364)..(364): a, c, t, g, unknown or other
  misc_feature (364)..(364): n is a, c, g, or t
  modified_base (402)..(402): a, c, t, g, unknown or other
  misc_feature (402)..(402): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggcttaattttaaaaggtgtccagtgtgaggtgcagttgttggagtcgtgggggagcttgggcacgaggccgtggggggtcccgagtactctcctgtgcagcctcgtggattcgcctttnagaactctcgccatcgcacgtgggtccnccaggccctaccggaggggaacgggctgggagtcgggtcctcgaggttagttcgggggtanagtggtactgaaccacattaacgtacgcaacgactcgnggaccgaaggggtcccgttacaaccctattcctaccgagacgactacgtttaaccaaagaacactaactactatctagaactaaacgtcgaaccctaactcgaacgacggaccgaaggaccgaaccggacctaattaacttaacgttaacgtggtaacggtaccggtaaagggttcggtaacgtaaccttaagttaccggaacccctaacgggttccgggggaaccctaaaccggggtaacccccttggggtaacccctacccggttcctaaccccg

SEQ ID NO: 271621 - DNA, 671 bp, Homo sapiens
  misc_feature: GYAE6OF02HQI1Q.40.43.D10.1.454.CMB.1.raw
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (295)..(295): a, c, t, g, unknown or other
  misc_feature (295)..(295): n is a, c, g, or t
  modified_base (369)..(369): a, c, t, g, unknown or other
  misc_feature (369)..(369): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttggctgagctggcttttcttgtggctattttaaaaggtgtccagtgtgaggtgcagttgttggagtcgtgggggagcgttggcacagccgtgggggtcccgagactctcctgtncagcctctggnttcgcctttnagaactctgccatcgcacgtcgggtcccnccaacgccctacccggaagggggaacggggtcctaggggagttcggggtcctacgagggtttagttcgggggtnaaggttagggtacgtacggaaccacgtaactaaccgtacgccgaagtactcgtaggaccggaacgggtcccgtaccacctacgtctaccgagaacgtacctacgtttaccaaagaaccacaacttctaactcgacgaacctaaagtaccaaccctaactcgtaagacggaccgaacgaaccgaccggacctaatacttaacgtacgagtaaggaccggaaaggttcggtagaacgtagaacgtaccgtaccggtcggggaccgtaaccgggaacccgtcggtacccgtaccgtcctaacccg

SEQ ID NO: 271622 - DNA, 642 bp, Homo sapiens
  misc_feature: GYAE6OF02JUQ17.40.43.D10.1.454.CMB.1.raw
  modified_base (195)..(195): a, c, t, g, unknown or other
  misc_feature (195)..(195): n is a, c, g, or t
  modified_base (239)..(239): a, c, t, g, unknown or other
  misc_feature (239)..(239): n is a, c, g, or t
  modified_base (294)..(294): a, c, t, g, unknown or other
  misc_feature (294)..(294): n is a, c, g, or t
  modified_base (612)..(612): a, c, t, g, unknown or other
  misc_feature (612)..(612): n is a, c, g, or t
  modified_base (619)..(619): a, c, t, g, unknown or other
  misc_feature (619)..(619): n is a, c, g, or t
  modified_base (638)..(638): a, c, t, g, unknown or other
  misc_feature (638)..(638): n is a, c, g, or t
tcagtctagcgactcacgaccggtgctcgatttagactagcagtaaggggaggaacgtgctcagttaggacccagagggaaccatggaagccccagctcagcttctcttcctcctgctactctggctccagaaaacaccggagaaattctgttgacacagtctccaggcacctgtctttgtctccgaggggaaanacgccacctctcctgcagggccagtcagagtgtcggctaccttntagcctggtaccaacagacgcctgccaggcctcccgagcctcctcgtatttacgngaacgccgtacaacgagggcccaagtcggactacgtcccaaggccaaggtttcaagtcgacccagggtcgggtacgtggggaacctggtaccctttcaaccgtccttaccgaaccgattaccggagtaccctaagggtcccctttaagggaaccgttccgttacggaaaacgtttcgtttttacgacgtttaacccttttaagttaccgttcgaaccctaacgtacggtacgttacgactaggtcgtcggtacctcggtaacgtcgccgtaaggacgtacggtggacactacgacgcgtataggtcgcgtcgtacacngtacgtntctacgactccgtccactntacg

SEQ ID NO: 271623 - DNA, 928 bp, Homo sapiens
  misc_feature: GYAE6OF02FUZ8U.40.43.D10.1.454.CMB.1.raw
  modified_base (195)..(195): a, c, t, g, unknown or other
  misc_feature (195)..(195): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgctccgaggggaangccacctctcctgcagggccagtcagagtgtcggctaccttcttacgcctggtaaccaacgacggaacgccgtaggaccctaagggcccttccccgaagggtccttaccccgttaccgtaattttttaacgtacggtaaaacggtcccgggttaacggaaaacccggtaacggggggtaccccctaaaccggttcggggaaccctaacccgttaccccccgaagggtacccccgtaaacggggttttcccaaagggttcccgggaccccgttaaaggggggtttccgggggttaccggttacgggggggtaaaacccctaaacggggttaaccccgtttttacccgaaaccccgtttacccggtttaccccaaaaccccggtaaacgtttccccgaaaaccgggcccttaaaccgggtaaccccttaaacgggtaccggttacccccgttaagggtaaaaacggtttacgttttttaccggaaccttttaaccgttttttaaacgttaccgtttacggtaccctaaccgtacggtaccggttacgacgttacggtaccgtcggtacccgtaccggtaccggttaccggacccggaaacggggtaccgtaagggtacggaacctacgtacggaacgtaccgtaagtcgggtacggtaccggtcgaccgtaacccgtgttacccgttcgttaccttccgttaacctttcccgttaccccgtaccgtacgttaccg

SEQ ID NO: 271624 - DNA, 889 bp, Homo sapiens
  misc_feature: GYAE6OF02HT55C.40.43.D10.1.454.CMB.1.raw
  modified_base (196)..(196): a, c, t, g, unknown or other
  misc_feature (196)..(196): n is a, c, g, or t
  modified_base (597)..(597): a, c, t, g, unknown or other
  misc_feature (597)..(597): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaatttctgttgacacagtctccaggcaccctgtctttgtctcgaggggaanacgccacctctcctcgcgacggccagtcagtacgtggtccggacctacctttacgttacgacccgttacggtaaccctaaaaccgaggtaaaccgcccgttaggacccgaaacgggttcccttaacccgaacgggccctttacctccgtttaacttttagtaagtaaaccggtaccggttaccgaaaaccgtaacggggtccccaaccgtttacggggacccctaacggttaccccccgaaggtccccgtaacgggtttaccaagggttccggacccgtaggtcgggggttaccgtcgggggaaaccaggtaaccttttacgacctttaccgtaacccgaaccaacgttccgaacggaccacggtaacccaggggtaacctaccgtaagttaaaacggttnttttacggttaccttaaacctttttaacgtttacgttaacccgttactaaaccgtaacggtacgtaacgtcgtacggtaccgttccgggtacctacccgggttaaccgttaaccggggaacccgttaaacggggaacccggtttaaacgggtacggaaaccgtttaagaaccgtaaacgtacgggtaacccgttaggtcgggaccgttcgggaaccctacggtaaccttttcggtctttaacccggttccttacgtttacccccgtttacccgttcccgtaaccgtttaccg

SEQ ID NO: 271625 - DNA, 736 bp, Homo sapiens
  misc_feature: GYAE6OF02I5OGH.40.43.D10.1.454.CMB.1.raw
  modified_base (250)..(250): a, c, t, g, unknown or other
  misc_feature (250)..(250): n is a, c, g, or t
tcagtctagcgactcacgaccggtgctcgatttagactagcagtaaggggagagaggagcccagccctgggattttcaggtgttttcatttggtgatcaggactgaacagagagaactcaccatggagtttggctgagctggcttttcttgtggcttatttaaaggtgtccagtgtgaggtgcagttgttggagtcgtggggagtcttggcacgagccgtgggggtcccgagactctcctgtgcagcctntggattccgcctttcagaacctctgccatcgctacgtcgggtacccgccagcccgtacccgaggggaacgggcgttaggacggttcggtcgtacgaagggttcgttcggggtgacgttggtaactggacacgtagtaccgtacgctaacgcctcgtacggaccggtaacggggcccggtttaccaccgtaacgttcccgtaccgaggaacgtaacctacgttttaacccgaaacgaactaacctacttaccgtactacctacgaacgtaaacgtccgaaacctaaccctacgaggtaacggaccggtacgaccgaacccgacgtaactacttaacgttaacgttacgtacgggtaaccggtaacgggttacggacggtttaaccgtaaggttacccgtaaccggtaaccgggtttacccggggaaccggttaacccgggttaaccccgttaccgggtacccgttaccccggttacccgtaccccgg

SEQ ID NO: 271626 - DNA, 585 bp, Homo sapiens
  misc_feature: GYAE6OF02FW5OL.40.43.D10.1.454.CMB.1.raw
  modified_base (296)..(296): a, c, t, g, unknown or other
  misc_feature (296)..(296): n is a, c, g, or t
  modified_base (349)..(349): a, c, t, g, unknown or other
  misc_feature (349)..(349): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctattttaaaaggtgtccagtgtgaggtgcagttgttggagtcgtgggggagcttggcacagccgtggggggtcccggagctctcctgtgcagcctcgtggattcgcctttcagaacctctgccatgcacgtgggtcccnccagccctccgaggggagggctgggagtgggtctcgaggttagttcgggggtnagttggtactggacacatactacgcaagacctcgtggaccggaaggggtcccgttacacccgtattccaccgagacgactactttaccaaagaaaccactactctatctagacaaatcaacccaacctcagaggcgaggacaccgactatataattactgtacgacgtaaggtggtagaactagtacgaccgtaggtcgggaccgaacgggacccgtgggacctacccgtctcccg

SEQ ID NO: 271627 - DNA, 1054 bp, Homo sapiens
  misc_feature: GYAE6OF02JXVQN.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttcttgtggctattttaaaggtgtccagtgtgaggtgcagttgtggagtcgtgggggaggcttggcacgagtccgtggggggtcccgagacctctccgtgtacgcgagcccttcgtaggtacttccggaccctttttcgacggtaacctctacggcccaagttcgcctacggtcggggtccccgccgagccccgttaccgaggggggaacgggcttacggggaggttcggggttcctacggtaacggggtttaacgtttcgggggggttagtaaacgtttcgggggttaaccgttcgggaaaccgtaaccgttaaacgggttaaaccccgtttaacgggacccccgtaaaagggttaacccccgttccggttacggggaccccggggttaaaaccgggggggtccccggtttttaacccgaacccgttaaccgtttcccccgtaacccggaaaggttaacccgaacccgtttaaacctttttccccgggaaaaacgtaaacccctaaacccgttaaacccgtttaccgttaaacccgtacggttccgtaaaacccgtaaaaaccgtttcccgggaaaacccccttaaacccccttaggggaaacgggttaaccccgggaaccggggtaaacggtaacccccggtaaacccgggtaccccggttaaaaatttttaaaccccgggtttaacttttaaacccggggttagtttaaccccggggggaaaggtttaaaacccgggggtttggggtttaaacccgtaaaccgggttttaaccgttcccggggggtaaaaaaccccttcgggggggtttaacccggggggaacccccgggtttaaacccggggaaacccccggtttttacccggggacccggttaaccccccggttacccggtttacccccgg

SEQ ID NO: 271628 - DNA, 882 bp, Homo sapiens
  misc_feature: GYAE6OF02GL5CC.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggtcttttctaggtggctaattttaaaaggtgtccagtgtgaggtgcagttgttggagtcgtgggggagtcgttggcacgagccgtggggggtcccgagactctcctgtcgcacgtcctcgtggactttccgtcccttttacaacggtaacctctacgccctaagtcggacctaccggttcggggtccccacccaacggtcccccttacccgggaagggggggaaacgggggtccgttagggggaacgggttcgggggtaccttaccgggtaaggggtttaacgggttttccgggggggtaagttacggttacggggttacctaggaaccaacgtaacttaacgtaccggacctaagtaccgttcgtacgggaacggtaacggggtccgttaccgggttaccaacccgtactacccgtaccgaacggtaacgtaaccgttaacttttaacccgaaaacggtaaccaaacctaccttaccgttaacgtaccgtaacgtaaacctaaacttaccgaaaccccgtaaaccgtacggaaacgggaccgggtaacggaaaccgggtaaccgaacccggtacccgttaaattaaaccgtttacgtttaaaccggtacggttaacgggaccgggttaaaggggtttcggtaaacggtaaccgttacgtaccggtaacccgaccggggtaccgggaaccggtaacccggggttaaacccgcgggtttaccccgacccggtttacccg

SEQ ID NO: 271629 - DNA, 652 bp, Homo sapiens
  misc_feature: GYAE6OF02G1FSL.40.43.D10.1.454.CMB.1.raw
  modified_base (171)..(171): a, c, t, g, unknown or other
  misc_feature (171)..(171): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggactgagctggctttttctgtggctattttaaaaggngtccagtgtgaggtgcagttgttggagtcgtgggggagcttggcacgagccgtggggggtcccgagacctctccgtgtgcagcctcgtaggtattcggcctttcagtaacctctcgccatgccacgtcgggtcccnctaacgccctacgaggggaacgggctgggagttcgggtctcgaggttagtcgggggtntacgttggtacctaggactacgtattacctacgacgagacctcgagggacggaacggggtcccgttacacccgtactttccgccgaagaccgtactaacgttacccaagtaaccactacttactctacctacgactaactccgtaaccaactcgaagcggacggaacgacgtacgacctagtacttacgtcgtagttcgaacgttagggtcgtaacgacgttagtaccgaaccgtagggtccgggtaaccgacgggtaacccgttgtaccccgttaccgtctccccg

SEQ ID NO: 271630 - DNA, 909 bp, Homo sapiens
  misc_feature: GYAE6OF02GM3QG.40.43.D10.1.454.CMB.1.raw
  modified_base (348)..(348): a, c, t, g, unknown or other
  misc_feature (348)..(348): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtggtcttttctggtggcttaattttaaaaggtcgtccagtgtgaggtgcagttgttggagtcgtgggggagtcgttggcagaggccggtcggggggtcccgagtaccttccgtccgtggtacgcacggtcctcgtaggtactttccgtccctttcgaacggaaccttcgtcgtacctaagtcgtacgtacccgttcggggtccccncccgtaaggtcccccgtaaccccggggtaaggggggtaaacgggggtccgtacggggtaacggggttcggggtccccgttaacgggtagggggttttaaccgggttcgggggggttataacgggtttacggggtaaccttaacggaacctaaccgtaaagttaccgaccggtacgtaacgtaccgtccggtacgggaacggggtaaccgggggttccccgtaaaccgaccgttaaccgtacccgttaaaccgacggtaaacgtaacccgtttaaacttaacccgaaaaacggtaaccctacgtaacccttaccgtaacgttacccggtaagaaaccgtaaaccttacccggaaaccccgtaaacgttacggaaacgggaccggaacggaaaccgggaaccgaaaccgttacctaagttaactttaaccggttaacgtacgggtaaggaaccggttagggttacggtaccgttaacctaaggtaccccggaacggttaccggtaacggggaccccgttaacggggaacccgtcccgggttacccgtaccgtcccggtaaccc

SEQ ID NO: 271631 - DNA, 776 bp, Homo sapiens
  misc_feature: GYAE6OF02G2YY0.40.43.D10.1.454.CMB.1.raw
  modified_base (386)..(386): a, c, t, g, unknown or other
  misc_feature (386)..(386): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttggctgagctggtctttttctgtggtcttaattttaaaaggtgtccagtgtgaggtgcagttgttggagtcgtgggggaggtcgttggcacgaggccgtggggggtcccgaggacctctcctgtcgcagcctctggacttccgcctttcagaactctgccatgacacgtcgggtcccgccaacgccctaccggaggggaacggggccgtaggggacggtcggggttcctacggtacgggttagttcgggggggtntaagttcgggtaactcggaacaactagtaacctaacggctaacggacctcgtacgggaccgggaaaacggggttcccggttaccaaccgtacttccctaccggagaacgtaaccttactttaacccgaaaacgaaaccgtaacctacctacttaactccgtagaaacctaaagttacccgaaaccctaaaccctacggaacggacgggtaaccggaaaccgggacccgaaccgggtacctaacgttaacgttaaacgttacgttagtaccggaaccggtaaggggttcggtaacggtaacttaacggtaccgtaacccgtaacggtccgggggtaacccctaacggggtaacccccgttagggaccccgtacccgttacccgttaccccg

SEQ ID NO: 271632 - DNA, 726 bp, Homo sapiens
  misc_feature: GYAE6OF02FYSDH.40.43.D10.1.454.CMB.1.raw
  modified_base (262)..(262): a, c, t, g, unknown or other
  misc_feature (262)..(262): n is a, c, g, or t
  modified_base (390)..(390): a, c, t, g, unknown or other
  misc_feature (390)..(390): n is a, c, g, or t
  modified_base (630)..(630): a, c, t, g, unknown or other
  misc_feature (630)..(630): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttgtggtcttaattttaaaaggtgtccagtgtgaggtgcagttgttggagtcgtgggggagtcttggcacagccgtgggggtcccgagactcgtcctgtcgcagccctgnggtcttccgcctttcacgaactctgccatcgcacgtgggtccgcccagccctaccggaagggggacggggtcgtggggacggtcgggtcctacggtagggttaggtttcggggtagtagttggtaccngtaacctacgtaacttaccgaacgcaacgtacttccgtaggaccgggtaacggggtcccggttaccaaccgtctaccgtaccgaagtaacgtaaccttagtttaaccccgaaaagtaaaccctaaccgtaaccgttaccttaactaccgtacgtaaacctaaacgttccgaaaccctaaaccgtacgaagggacggacggaacggtacccgaccggtacctaattaacctaatttaccgngtaaccgtagggtaaggtcgtacggtaactacgtacgaccggtacggttccgggaccttaccgggaacccgtttcggaccctaccggtcctacccg

SEQ ID NO: 271633 - DNA, 714 bp, Homo sapiens
  misc_feature: GYAE6OF02G7BAJ.40.43.D10.1.454.CMB.1.raw
  modified_base (138)..(138): a, c, t, g, unknown or other
  misc_feature (138)..(138): n is a, c, g, or t
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacnccggagaaattctgttgacacagtctccaggcaccctgtctttgtctccgaggggaaanagcccacctctcctgcagggccagtcagagtgtcggctaccttctagcctggtaccaacagaacgcctggccaggcctcccgaggcctcctactatttacgngaacgcgtacgaaacgacgggccaacgtcggactactcccgagtccgaggttcaggtcgaccgtaggtcgggtcgaggggaactacgtactttccgaccttctaccaacctagttcgaacgccgtaacgacccgttaaggaacgtcccgtagaaacggtttagttttacgacctttacttttaacttacgttacgttaccgaaccgtacggtaccgttacgccgtacgtaccgttcggacccgtacggtaaccggttaccgggaacccggtaacgggtaaccggtaacgggtacggaacgtaaccgttaccgaaacggtaccgtaacggttacgtacggcgtacggtaccgtaacctacgttcgttacgttaccttacgttaccttacccggttacccgtaccgtaccttaccgg

SEQ ID NO: 271634 - DNA, 652 bp, Homo sapiens
  misc_feature: GYAE6OF02GK3IN.40.43.D10.1.454.CMB.1.raw
  modified_base (169)..(169): a, c, t, g, unknown or other
  misc_feature (169)..(169): n is a, c, g, or t
  modified_base (295)..(295): a, c, t, g, unknown or other
  misc_feature (295)..(295): n is a, c, g, or t
  modified_base (355)..(355): a, c, t, g, unknown or other
  misc_feature (355)..(355): n is a, c, g, or t
  modified_base (400)..(400): a, c, t, g, unknown or other
  misc_feature (400)..(400): n is a, c, g, or t
  modified_base (544)..(544): a, c, t, g, unknown or other
  misc_feature (544)..(544): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtgcgtttctaggtggctatttaaaggngtcagtgtgagtgcagttgtggagtctgggggagcttaggcacgagccgtgggggtcccgagactctcctgtcgcgagcctatggattcgcctttcgagtaactctcgcctatgcacgtgggtccnccagcctccggaagggacggggctagggcgtcggggtctcgtagggttagttcgggggtntacgtggtactggacaacgtataaccgtacgactacgacgttcgngacgggaacggggtcccggttaacgaccctacgtccgtaccgagtacgtactaccgtttaaccgaaactaacctaacgtactacttacgtcttacgactaaactaccgaacctaacctgaacgtaggaccgtaggacgacgacncttaattactacgtgtaggacgtaagggtcgtacgtaactacgtaccgaaccgtcggtaacgggcccggtaacgggacccgttcggacccggtaccgtcccggtaccc

SEQ ID NO: 271635 - DNA, 735 bp, Homo sapiens
  misc_feature: GYAE6OF02G7QG6.40.43.D10.1.454.CMB.1.raw
  modified_base (158)..(158): a, c, t, g, unknown or other
  misc_feature (158)..(158): n is a, c, g, or t
  modified_base (173)..(173): a, c, t, g, unknown or other
  misc_feature (173)..(173): n is a, c, g, or t
  modified_base (190)..(190): a, c, t, g, unknown or other
  misc_feature (190)..(190): n is a, c, g, or t
  modified_base (332)..(332): a, c, t, g, unknown or other
  misc_feature (332)..(332): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttgtgtggnttaagttttaaaggngtccagtgtgaggtgcngttgtggagtcgtaggggcgtgttggacactcggccggtcggggggtcccgaggtaccgtccttccgtaggtcgacctcggtaccctcgttgggtcctttccggaccttttcaggtaacccttcggtcgaacccgtaagttnaccggttaccggttccgggggaccccgtcccaccgtacccggtaccggggtaacgggggtacggggtcgggtacgggttacgggttcgggttaccggtacggttacgggttacgggttcgggttaggtggtcggtacgtacgacgtacgtaacgtacgtacgtacgtacgtacgtacgtacggtacggtacggtaccgtacgtacgtacgtcgtacgtacgtacgtacgtactaacgaacgtacactactactctctacgtactactacgtacgtacgtacgacggtacgacgtacgaccgacgtacgtactacgtactacgtacgtacgtacgtacgtacgtacgtacgtacgtacgtacgtacggtacgtacgtaccgtaccgtacgtacgtcgtcgtacg

SEQ ID NO: 271636 - DNA, 724 bp, Homo sapiens
  misc_feature: GYAE6OF02HXNZM.40.43.D10.1.454.CMB.1.raw
tcagtctagcgactcacgaccggtgctcgatttagactagcagtaaggggggagagaggagcccagccctgggattttcaggtgttttcatttggtgatcaggactgaacagagagaactcaccatggagtttgggctgagcgtggtcttttctgtggctaatttaaaaggtgtcagtgtgagtgctagttgtgagtcgtgggggagcttggcacgagcgtgggggtccgagacctcgtcctgtgcagcctcgtagtacttccgtcctttacaacgtaccttctcggccctagtcgccgtaaccggttccggggtacccgccaaccggcccttaccggggaacgggggtaaacggggcggtggggtaacgggttcgggttctacgtacggggtttacggttcgggggtagacggttagggttcacggaactacctaacgtaacttcggacctagtacttcgtcggacgggaacgggtcccgttacaaccgtaatccctgaacgtacgacttaaacgttaaccaaacgaacctaacctacttacgtacttacgtacgtaacaagaccgtaacccgtaaccgtcaaccgggaggtaccgaacgggtacgaccggtaccaattaattacgtttgacgttaacggacggtaggttgacggaacttaacgtacgaccgtacgggtaccggacggtaaccggcccgttacggcccgtacccttccgtacc

SEQ ID NO: 271637 - DNA, 798 bp, Homo sapiens
  misc_feature: GYAE6OF02GU5V1.40.43.D10.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
tcagtctagcgactcacgaccggtgctcgatttagactagcagtaagggggaggaactgctcagttaggacccagagggaaccatggaagccccagctcagcttctcttcctcctgctactctggctaccagaaaacaccggagaaattctagttgacacagtctccaggcacctgtctttgtctcgaggggaaanacgccaccctntacctgacagggccagtcagtacggtgtcggacctaccgttcttaacggccttacggtaacccaaacgtagaaacgccgttacggaccagggaccttacccgacggtacctccgtactaagtttaacagaacggtccgtaacggaaacacggggaccaacgtaggacctacgtcccaaggcccgtaaggttcaaggtcgaccgtaggtttcgggctacggggaactataaccgttctaacgtcctacgaaactacgtacaacgacgtaaccggtcccgttaaagaccggttacgttacggaaacgtttacgttttacgaaccgtttaacgttttaacttacgttacgtacctaaccgtagttaccggtaacgcgttaccgcgttacgtaccgtaccggtaaccgggtttaccgaaccggtaaccgggtaaccgtaaacgggtacggtaacgtaaaccgtaacggtaaaccgaccgttaaccggtcggttaccggtagtaccggtaaccgtaacccgttaaacgttccggttaacggttacctttacggtacccgtttaacccggtttacccggtaccttacgttaacccgg

SEQ ID NO: 271638 - DNA, 573 bp, Homo sapiens
  misc_feature: GYAE6OF02FSE5R.40.43.D10.1.454.CMB.1.raw
  modified_base (171)..(171): a, c, t, g, unknown or other
  misc_feature (171)..(171): n is a, c, g, or t
  modified_base (329)..(329): a, c, t, g, unknown or other
  misc_feature (329)..(329): n is a, c, g, or t
  modified_base (378)..(378): a, c, t, g, unknown or other
  misc_feature (378)..(378): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (456)..(456): a, c, t, g, unknown or other
  misc_feature (456)..(456): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggctttttctgtggctattttaaaaggtntccagtgtgaggtgcagttgttggagtctgggggaggcttggcacagcctggggggtccccgagacgtctcctgtgcagcctctggattcgcctttcagaactctgccatgcactgggtccgccagcctcccaggggaaggggctgggagtgggtacncgagggtattcgggggtgatgggtactggacacatacctagcagactcngcgaagggccggttcaccgtactctcccagtacgactacttccaagacacactctatcgtnacaaangaaccaacctnacgaggcaggacacgccaatacattactgtacgacgtaaggtggacggtaactagtacgtaaccgacgttcggggaccgacggggaaccccgttgggaccgacccgttccgtacccg

SEQ ID NO: 271639 - DNA, 738 bp, Homo sapiens
  misc_feature: GYAE6OF02FPOXN.40.43.D10.1.454.CMB.1.raw
  modified_base (386)..(386): a, c, t, g, unknown or other
  misc_feature (386)..(386): n is a, c, g, or t
  modified_base (435)..(435): a, c, t, g, unknown or other
  misc_feature (435)..(435): n is a, c, g, or t
tcagtctagcgactcacgaccggtgctcgatttagactagcagtaaggggggagagaggagcccagccctgggattttcaggtgttttcatttggtgatcaggactgaacagagagaactcaccatggagtttggctgagctggctttttcttgtggctatttaaaaggtgtccagtgtgaggtgctagttgttggagtcgtgggggagcttggcacgcgccggtggggggcccgagacctcctcctgtgcacgcctcgtggacttccgtcccttttacagaaaccttcgtcgcctaatcgcctacgtcgggtcccgcctacgccctaccggaagggggtaacgggtcgtagggacggtgggtctacgtgggttagttcgggggtntagttcggtactaggtaccactagtaccgtaaccgcaacgtcgttacgngggacgggtaaccgggtcccggttacaacccgtatcccgtaccaggacgtaacctactttaaccaaacgtaaccaacctactactacgtcttaggaacctaaacgtcaaaccctaacctcgtaagggaaccgacgggacgggaacctaccgggaacctaattaaccttaattaacggtgttaaccggaacggttaaggggttcggtaacgtacggtaacgtaccggtaaacccggtcggtaaccggggaccgtaaacccggggtaccccgttaggaccccggttacccgtacccgtaccccgg

SEQ ID NO: 271640 - DNA, 635 bp, Homo sapiens
  misc_feature: GYAE6OF02GPP3H.40.43.D10.1.454.CMB.1.raw
  modified_base (220)..(220): a, c, t, g, unknown or other
  misc_feature (220)..(220): n is a, c, g, or t
  modified_base (303)..(303): a, c, t, g, unknown or other
  misc_feature (303)..(303): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttcttttggctattttaaaaggtgtccagtgtgaggtgctagttgttggagtcgtgggggagcttggcacngccgtggggggtcccgagactctcctgtgcagcctcgtggacttccgcctttcagtaacctctgccatcgcacgtcgggtccnccacgccctaccggaggggacggggtctgggacggtcgggtcctcggtaaggttacgttcgggggtatagtcggtactgacactacgtacgtaccgacacgtacctcgtcggacggtaaccggggtcctaccacctacgtccacgacgacgtactaacttacccaaagtaaccactactactactctagactaacgtccaaccactcgagacggacgacgaccgacgactatattacttacgagtacgacgtaaggttcggatacgtgtacgacctacgggtacgggaccgtaacgggtacccgtcggtacccgtaccgtcctccgtacccg

SEQ ID NO: 271641 - DNA, 873 bp, Homo sapiens
  misc_feature: GYAE6OF02HTLYC.40.43.D10.1.454.CMB.1.raw
  modified_base (137)..(137): a, c, t, g, unknown or other
  misc_feature (137)..(137): n is a, c, g, or t
  modified_base (193)..(193): a, c, t, g, unknown or other
  misc_feature (193)..(193): n is a, c, g, or t
tcagtctagcgactcacgaccggtgctcgatttagactagcagtaagggggaggaactgctcagttaggacccagagggaaccatggaagccccagctcagcttctcttcctcctgctactctggctccagaaaacnccggagaaattctgttgacacagtctccaggcaccctgtcttgtctcaggggaaangccacctctcctgcagggccagtcagagtgtcggctaccttcgtagcctaggtacccaacgagaagtccgtggaccaggtcctcccgaggtccttaccgtctaattttacaggaaagcggttaccgaaacgtcggggaccctaacgttcgggacctaacgtaccccgaggtccccgtaaagggtttccaacggtttacggacccgtaagggtttcgggggtaccttacggggggaacctaacgggttaaccttttccgaaccgtttcccgttaaccctaaacccgaaacgtttacccgaaagggacccgtaaaccggtaccccgttaaacggggtaccgtacccgtttaacgggaaaacggtttaaaccgttttttaccggaaccgtttaaacctttttaaacgtttaaacgtttacggttaaccgtaacccgtaacgggtacccgggtttaaacggacgtaaccgggtcgtttaaccgggttaccccgttaaccgggtaaaccgggttttacccgggacccggtaaaacggggtaacccggtaaagggtaccgggtaaacgtaacgtaacgtaaacgtaccggtaacgttacgtacggtacgtcggtaccgtaacctacgttaccgttacgttaccgttaccgtaccttaccggttaccccgtacccgtagttaaccgg

SEQ ID NO: 271642 - DNA, 116 bp, Homo sapiens
  misc_feature: GYAE6OF02I14KM.40.43.D10.1.454.CMB.1.raw
  modified_base (107)..(116): a, c, t, g, unknown or other
  misc_feature (107)..(116): n is a, c, g, or t
tcagtctagcgactcacgaccggtgctcgatttagactagcagtaagggggaggaactgctcagttaggacccagagggaaccatggaagccccagctcagcttctnnnnnnnnnn

SEQ ID NO: 271643 - DNA, 837 bp, Homo sapiens
  misc_feature: GYAE6OF02IO6EI.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccatggagtttggctgagctggtctttttctgtggtcttattttaaaaggtgtccagtgtgaggtgctagttgtggagtcgtgggggagtcgttggcacgaggccgtcggggggtcccggagaccgttcctccgtggtgccacgtccttcgtggtacttccgtccgttttacaacggtaacttccgtgaccctagtcgacctacgtcggggtccgccacggtccctcggaagggggtaacgggtcgtggggtaggttcgggtacctggtaacggggttacgtttcggggggatacggttacgggtaccgtacggaaccaacgttaacgtaaccgttaccgggctaacgggtacccttacgtacgggaaccggggtaaaccggggtttccccggttaccaaaccgtacgtttacccgaccggaacgtaaacggtaaccttaaccgttttaaaccggaaaacgtaaacccgtaacctaaccgttacttaaacccgttcgtaacgtaacctaaaacgtacccgtaaacccctaaaccgtacgtaaacggacgggaacccgtaacgggaacccgtaacccggtactaaacgttaacgttaacgttacgtcgggtaagtaaccggggtaagttcggtaccgtaaacgttacgtcgtaaaccccggagggttccgggaccgtaaccgggtacccgtacggacccttacccgtcgtaaccccg

SEQ ID NO: 271644 - DNA, 794 bp, Homo sapiens
  misc_feature: GYAE6OF02GZREX.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccagtggagtttgggctgagcgtggtcttttctagtggcttaattttaaaaggtgtccagtgtgaggtgctagttgttggagtcgtgggggagcgttggctacgacgccggtcggggggtcccgagtactctcctgtcgcagtcctcgtggtattccgtcctttcaagtacctcgtcgccagtcgctacgtcgggtcccgcctacgcccgtaccggaagggggacgggtcgtacgggaggttcgggtaccgtacggtacgggtttacggttccgggggtagtacggttaggtacgtacgacctaacgtacgtaaccgtacgacgacgtaactcggtacggaccgggtaacggggtcccgttacaaccgtactcccgtacgaacggtactaacgtaactttaacccgaaacgtaaacctacgtaaccttcgttaacgttcgtaacggtaaactaaaccgaccggtaaacccaccgttacgaagggacgggaccggtaaacgggacccgtaaccggacttaaactttacgtttaaacgtaccggttaggtaccgggtacggtaaagggttcggtaacgtaaaccgttggtaacccgggtaaccgtacggggtaacccggggtacccggtaaccgggttaccccgtacgggtacccttaccgtcccgttaccccgg

SEQ ID NO: 271645 - DNA, 817 bp, Homo sapiens
  misc_feature: GYAE6OF02HFNEA.40.43.D10.1.454.CMB.1.raw
  modified_base (419)..(419): a, c, t, g, unknown or other
  misc_feature (419)..(419): n is a, c, g, or t
tcagtctagcgactcacgaccggtgctcgatttagactagcagtaagggggagagaggagcccagccctgggattttcaggtgttttcatttggtgaaaaatcaggactgaacagagagaactcaccatggagtttgggctgagcgtggtctttttcttggtggacttaattttaaaaggtgtccagtgtgaggtgctagttgttggagtcgtgggggaggtcttggcacgagccggtcggggggtcccgagtacctcctcctggtcgctacgccttctggtacttccgtcctttcagtaaccttctacgcctatcgccacggtcgggtcccgccacgccctaccggaaggggggtaaccgggtcgttaggggaggttcggggtacctccggtaaggggttacggttccggggggttanacggtttcggggttaactcggaaccgtacgtaacgttaaccgtacgacgtaacgtacttcgtaggacggtaacggggtcccgttacaacctcgtaccgtaccgaacgtacgtaccttaaccgttaccaaaacggtaaacctcctaacttccttaacgttaccgtaccgtaaacctaaactcccggaaacccctaaccgtacgaacgggtacgggaaccggtacggaacccggtaaccggacccttaagttaaaccgttacgttaccggttcgttaacgggaacgggttaggttccgggtaacgtaaccgtaacgtacggtacccgtaaccgggtccgggggtaaccccgaacgggggttaacccttccggggtaaccctaccccggttacctacccgg

SEQ ID NO: 271646 - DNA, 743 bp, Homo sapiens
  misc_feature: GYAE6OF02GRB0T.40.43.D10.1.454.CMB.1.raw
tcagtctagcgactcacgaccggtgctcgatttagactagcagtaagggggagagaggagcccagccctgggattttcaggtgttttccatttggtgatcaggactgaacagagagaactcaccatggagtttgggctgagctggtctttttctgtggcttattttaaaaggtgtcctagtgtgaggtgcagttgttggagtcgtgggggagcttggcacagtccgtggggggtcccgaggtacctctccgtagtcgcagccttctggattccgcctttcgagtaactcctgccatcggcctaacgttcgggtcccgacacggtcccgtacccggaagggggtaacggggtcctagggggaggtcggggttacctacggtagggttacgttcggggggtgtaggttcggttactacgggacctaacgtaacgtacctaacgcgaaccgtcgttacgcggaccgggtaaacggggtcccgtttaccacccgtactccgtccgaaggactaccgtacctttaaccgaaacgtaaacctacgtaacctctaaccttcctagtaacaacgtaccgaaccctaacctacgaacggacggagaacggaccgtacgaccgtaacttataactttcacggagtacggtaagggttcggtaagaccgtttaacgccggtaaccgtaccgggttacgggaccccggtaacggggttaccccgtaccggttacccgtacccggtccctaccccg

SEQ ID NO: 271647 - DNA, 815 bp, Homo sapiens
  misc_feature: GYAE6OF02HTU7K.40.43.D10.1.454.CMB.1.raw
  modified_base (333)..(333): a, c, t, g, unknown or other
  misc_feature (333)..(333): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagctggtctttttctggtggcttaatttaaaggtgtccagtgtgaggtgcagttgtggagtcgtggggagcgttggcacgacggccggttggggggtcccgaacggtaccttccgtcctggtcaccgacgtcctcgtggtacgttccgttcctttacaacgtacttcctgcccagttcgacctacggtcggtccnccgacggtcccaccggaagggggacgggtcgtaggggtcggtcggtacgttacggaagggtttcggtacggggtagtacgtaggttaccgaggaacctacgtaacgttacccgtaacggaccgtaacgtacgttcgaagggtaccgggtaacgggttcccgtacgacctaacgtcctaacgacggtaccgtaaccttacgttaaccaacgtaacctacgtacttacgtacttcgaacgtactaaccgtaccctaaaccgtaaccctaggtaaccggacgggtaaccggaacgtaccccggtaacgtaaccttaacgttacgtttaaaccgttaccggagggttacggtaaaccgggttacggttacggtaacgttaaccgttaacggtaaccgggtaaccccggtaagggtttcccggggaaccgttaacccggggttaacccggttcccggttaacccctttagggtccccccttaaccgg

SEQ ID NO: 271648 - DNA, 586 bp, Homo sapiens
  misc_feature: GYAE6OF02F1AI2.40.43.D10.1.454.CMB.1.raw
  modified_base (198)..(198): a, c, t, g, unknown or other
  misc_feature (198)..(198): n is a, c, g, or t
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
  modified_base (362)..(362): a, c, t, g, unknown or other
  misc_feature (362)..(362): n is a, c, g, or t
  modified_base (531)..(531): a, c, t, g, unknown or other
  misc_feature (531)..(531): n is a, c, g, or t
tcagtctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggccaccctgtctttgtctccaggggaaagngccaccctctcctgcgagggccagtcagagtgtcgcaccttcttacgcctggtaccaacagacnccgtgccaggcctccaggctcctcatttanggaacgcgtacgaacgacgggccacgtgcacgtccccagcctaggttcaggtcgaccaggtcgggtacgnggacaggtcttacacctcgtcaccatcacgcacgacctagacgtcctaggaagtattttcgaccttacttttatactagtaccacctaagccgttaagcgtagtctacggccctacgtacggttaccgacgtaacgggaccgaagggagacagcaaagccgaagtcggnggcgtagcccaacgtacgtcctagttccctactacttacccgtcccgtccatacg

SEQ ID NO: 271649 - DNA, 768 bp, Homo sapiens
  misc_feature: GYAE6OF02HPOGC.40.43.D10.1.454.CMB.1.raw
tcagtctagcgactcacgaccggtgctcgatttagactagcagtaagggggagagaggagcccagccctgggattttcaggtgttttcatttggtgatcaggactgaacagagagaactcaccatggagtttggctgagctggtcttttcttgtggtcttaattttaaaaggtgtccgagtgtgagtgctagttgtggagtcgtggggagcgttggcacgacgtccggtcgggggtccgagtacctctccgtgtacgcgacgtccttcgtagtacgttaccgtcctttacgaacgtacctcgtacgaccgtacgtccgaccgtaccggtccgggtacccgaccgtaccgtacccgtaaccgggaacggggtaaccgggtcggtacgggtacggttcggtaccgttacggtaacgggttacggtacggggtacgtacggttacggtaacgtacgtaacctaacgtacgtaccgtacgtacgtacgtacgtacggtacggacggtacgggtcccttaacgaccctacgtccgtaacgagtaactacttaacttaaccgaacgtaacctactaccttacgttaactacgtacgtaaacctaacgtaccgtaacccgtactacggtacggaccggtaacggaccgaccgtaccggtactaacttacgttacgtacgtacggtacggaacggttaggtacgtacgtacggtacgtacgtaccggtacgggtacgaacggtaccggtaccggtcgtaccccgtactccgtaccg

SEQ ID NO: 271650 - DNA, 595 bp, Homo sapiens
  misc_feature: GYAE6OF02JTANV.40.43.D10.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (382)..(382): a, c, t, g, unknown or other
  misc_feature (382)..(382): n is a, c, g, or t
  modified_base (424)..(424): a, c, t, g, unknown or other
  misc_feature (424)..(424): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
tcagtctagcgactcacgaccggtgctcgatttagactagcagtaagggggagagaggagcccagcccttgggtattttcaggttgttttctagtttggtgatcgaggactaggaacaagagaagaacctcacagtggtagtttcggctgagcttaggtctttttctggtggtacttaagttttaaaggcgttcagtgtgaggtncgtagttgttggngtcgtagggngtctggcacnggtcgtgggggactgcctcgcctgngcacgctcgagcttcgcttantactcgtctacngtncgtagtcgcgngaacgtccgacggaggggtgcgtaggaggttcgacgtagtggtacgttggatcgtcggtactggacaacgtntacgctagattccgaagtccggacgttggcctacgatttgcnccgagataccgtataccagactaactctacatcattacganacctaccncganccgagcgtagacgaaccgctatagtggtaagtgtaacgtaggtacgttgtaccgtgtacgacgtacggttcggaaccgtacggttacccggtaaccgtcccgtaaccgtacctccgcg

SEQ ID NO: 271651 - DNA, 628 bp, Homo sapiens
  misc_feature: GYAE6OF02F7A51.40.43.D10.1.454.CMB.1.raw
  modified_base (173)..(173): a, c, t, g, unknown or other
  misc_feature (173)..(173): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (393)..(393): a, c, t, g, unknown or other
  misc_feature (393)..(393): n is a, c, g, or t
tcagtctagcgactcacgaccggtgctcgatttagactagcagtaagggggagagaggagcccagccctgggattttcaggtgttttcatttggtgatcaggactgaacagagagaactcaccatggagtttgggctgagcgtgcgtttttctaggtggctattttaaaaggngtcagtgtgaggtgcagttgttgagtctgggggagcttggcacagccgtggggggtcccgagactctcctgtncagcctntggattcgccttcagaactctgccatgcacgtcgggtccnccagccctaccgaggggaaggggctggaggtcgggtctacagggttacgttcggggttgagttggtaactggaacctacgatacctacgcagtactacgnggacgaacggggccgtttaccaacctagtcctccgagacgactacgtttacccaaagaaccacgtaccttaccgtatcctagaacctaatccgaaccctaaacgtcgaagacggcgacggaacaccggaccaattacgtaatttacctggacgacgaaggttgtacggacttaacgtacgaccgttaagggtcggaccgtaacgggtaccctgggtacccctaccggtctccccg

SEQ ID NO: 271652 - DNA, 739 bp, Homo sapiens
  misc_feature: GYAE6OF02F6I6Q.40.43.D10.1.454.CMB.1.raw
  modified_base (336)..(336): a, c, t, g, unknown or other
  misc_feature (336)..(336): n is a, c, g, or t
tcagtctagcgactcacgaccggtgctcgatttagactagcagtaagggggagagagagcccagccctgggattttcaggtgttttcatttggtgatcacggactgaacagagagaactcaccagtggagtttgggctgagctggtctttttgttgtggacttaattttaaaaggtgtccagtgtgaggttgctagttgttggagtcggtgggggaggtcgttggcacgaggccggtcgggggggtcccgaagcctccgtcccttgtcgacgcgtcctcgtaggtattccgtcctttacagtaacctctcgcctatcgcctaccgtcgggtacccnccgacgtcctacccggaaggggacgggcgtagggaggttcgggtcctaggtaacgggttaggttccggggtagtaagtcgggtaactacggaacacgtaactacgtacgactacgtaccgtgaccggtacgggaaccggttccggttaccaacgttactccgaaccgagaaccgtaactacgttaaccgaaacgaacctaactaaccttctaacgtctacgtaaactaacgtaaccgtaaccctaccgtacgaggaacgacggaacggaaccgtaaccgactaacgttagttaactacggttaagcggtaaacggtagggtcgtaacggtaatccggtaacgtacgtaccgggtacggaccggtaacccgggtaccgtaccggtcccgtaccgtcccgtaccg

SEQ ID NO: 271653 - DNA, 802 bp, Homo sapiens
  misc_feature: GYAE6OF02HR9JN.40.43.D10.1.454.CMB.1.raw
  modified_base (134)..(134): a, c, t, g, unknown or other
  misc_feature (134)..(134): n is a, c, g, or t
tcagtctagcgactcacgaccggtgctcgatttagactagcagtaagggggagagaggagcccagccctgggattttcgaggtgttttcatttggtgatcaggactgaacagagagaactcacatggagttggntgagcgtggtctttttcttgtggtcttaattttaaaaggtgtaccagtgtgaggtgctagtttgttaggtagtcggtggggagtcgttggacacgacgccggtcgggggtccgagacctcgtcgtgtgcgacgtcctcgtgtacttcgtcctttagaactacttctacgccgatcgctacggttcgggcccaccgtaccgtcccgtacggaacggggtacggggccggtagggtacggtcggttccgtacggtaaggttcggttcggggtaagtaggttacggtacgtcgaactacgtagtaaccgtacgtacgacgtactcgacggtaacggacgggtccgtactaccgtactaccgtacgtaagacgtaactacgttaaccaaccgtaactacctaacgttaccttaataccgtacgtaaactaaaccgtacgtaaacccctaaacgtacgacgggaacggaacccgaacgggaaaccgacccggtaaactaacgttaacgtttaaccgtaacggttacgtaaccggtaaaagggttaggttccggttaacggtccgttaaaccggtacccggtaaaccggtaacccgggttcccgggaaacccggttacccgggttaaaccccggttcccgtaaccccgtttacccggttaccccgttacccggg

SEQ ID NO: 271654 - DNA, 782 bp, Homo sapiens
  misc_feature: GYAE6OF02FXVSC.40.43.D10.1.454.CMB.1.raw
  modified_base (157)..(157): a, c, t, g, unknown or other
  misc_feature (157)..(157): n is a, c, g, or t
  modified_base (172)..(172): a, c, t, g, unknown or other
  misc_feature (172)..(172): n is a, c, g, or t
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
tcagtctagcgactcacgaccggtgctcgatttagactagcagtaagggggagagaggagcccagccctgggattttcaggttgttttcatttggtgatcaggactgaacagagagaacttcaccatggagtttggctgagcgtggtcttttctagnggctaatttaaaggngtcagtgtgagtgcgngttgttggngtcgtgggggngtcttggataacgcggttccgtacgggggtacccgacgacgttcgtccttggtaagaccgtcgggtccccttggtaccggtattcccggccttttaccgagtaaacgtctcgtacatcgtacacggtttcggaccgtacgtccgtaccctccggtaggggtaagggtcgtggtaccgggttcggtcggttcgtggggtttacggtttacgggtcggttaggtcggttaacgtccgtaagtaacgtaccggttaacgttaccgggaccacggtttacccgcgttaaccgggtcgtaaccggggtacccggttttaccaacccgtccggtcttacccgtaggtaacgtaccttaaccgtttccgaacttaaccgacctaccttacggttaccacgtttaagaaccgtaagtaccgaaccaacccttagaccggttacgaccggaaccgtacgaccggacccttaatacgttacgaaactttcggacgtaaccggttgccgggttaactccgtaacgttacacccggttacgtaccggtacccggaacgttacccggccgttaacggtctacgcccc

SEQ ID NO: 271655 - DNA, 537 bp, Homo sapiens
  misc_feature: GYAE6OF01C7WS5.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgactttatgatacaaacaacaaacactcctggacccctgcccggttctcacggctccctcgttcggggcaaagctgccctgacccgtttcggtcgcgcacgcctgaggatgaggctgagtattacgtgcttgctctcctatagtggtgttcgggtgttcggcggtaggacagctgaccgtctaggtcagcccgaaggctcgcccccgtcggtccactcctcgtcccaccctccgtcgtaacg

SEQ ID NO: 271656 - DNA, 513 bp, Homo sapiens
  misc_feature: GYAE6OF01EIDN3.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgtccgtctcagctcctcgtggggcaaagctgccctgaccctttcggtgcgcagcctgaggatgaggctgagtattactgcttgctctcctatagtgtgttcgggtgttcggcggaggaccagctgccgtctaggtcagccgaggctcgcccctcgtcactctcgtcccacctcctcgtacg

SEQ ID NO: 271657 - DNA, 554 bp, Homo sapiens
  misc_feature: GYAE6OF01AKFO5.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgacttatgatacaaacaacaaacactcctggacccctgcccggttctcagctccctcgttggggcaaagctgccctgaccctttcgggtgcgcagcctgaggatgaggctgagtattactgcttgctctcctatagtggtgttcgggtgttcggcggtagggaccaaggctgacccgtcgtaggtcaggccccgaagggcctacggccccccttcggtccaccgttccgtacgttccccgccccttccgtcggtaacgg

SEQ ID NO: 271658 - DNA, 725 bp, Homo sapiens
  misc_feature: GYAE6OF01BAT8Y.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggagctgtcaccaatggtcattatccctactgttccaacagaagcctggccaacgcccccaggaccactgatttatgataacaaacaacaaacactcctacggacccctgcccggttctcgacggcctccctcggttcggggacaaacgctacgccctgtacccctttcgggtgcgcacgccctggacggtagtcggacggtctaggaagttaacgttacgtcgtcgttcggtccttccgttacccttaggtttacggttgggtttcgggtttccgggggttcggtttaccggggaccgggggtaacgggtaacccgtaaacggtccgttacgggaaccccggttcccgttaacggggtccctaaccggtacccccggtaaacgggtccccgttacccgggtccccccccgttacggggttccccctaacccggtttccccgttaccccgggtttcccccccgaccccccgtttccccggtacccgggttaaacccggg

SEQ ID NO: 271659 - DNA, 677 bp, Homo sapiens
  misc_feature: GYAE6OF01BOPMB.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaacgcctcggccaagcccccaggaccactcgatttatgactacaaacaacaaacactacctggacccctgcccggttctcaggcctccctcggttcggggacaaagctcgccctcgtacccgtttcggcgtcgcacggcctgacggagtcggaggtctaggacgttaacgttacgtcgtacgtttcggcttcgtccttagtttacggttcgggttggtttcggggttcggtttccggggacgggtacggggaacccgtaaggccggttacggtacccggttaccggttacgggtccgaaccgggtccccgtaaacggggtccctacccggtccccccgttcccgggttccctaacccgttccgttaccccggtttccccccgccccgttcccgttccggttaaaccgg

SEQ ID NO: 271660 - DNA, 546 bp, Homo sapiens
  misc_feature: GYAE6OF01DCLSG.16.88.H11.1.454.CMB.1.raw
  modified_base (516)..(516): a, c, t, g, unknown or other
  misc_feature (516)..(516): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggaggacagtcactctcacctgtggctccagcactggagctgtcaccaatggtcattatccctactggttccaacagaagcctggccaacgcccccaggacactgatttatgatacaaacaaacaaacactcctgacccctgtccgttctcaggctccctcgttcggggcaaagctgccctgtacccgtttcggtcgccgcgacgcctggaggagtgaggcgtgagttattcgtgcttgctctccgtatgtggtgttcggtgttcggcggaggacgagcgtgaccgtccgtacgcgacgcccgaaggctcgccccgtcggtaccncgttctcgttccccaccctccgtcgtaacg

SEQ ID NO: 271661 - DNA, 973 bp, Homo sapiens
  misc_feature: GYAE6OF01DB0O9.16.88.H11.1.454.CMB.1.raw
tcagtgtactactccacgaccggtgctcgatttagcgacagcgagaacacgacaaaggggctggcaccaggggtcccttccaatatcagcaccatggcctggactcctctctttctgttcctcctcacttgctgcccagggtccaattcccaggctgtggtgactcaggagccctcactgactgtcgtcccaggagggacagtcactctcacctgtggctccagcactggagctgtcaccatggtcattactccctaactcggtttaccaaacgtacgaaacgcctacgggacccgaaacggcccccccgaagggaacccgtaacctttacggtaattttttaacgtacggtaaacttaaacccaaaaaccaaaacctaaaaaccctacccgtttaccccgtaccgggtaaacccccccgtttcgggtaccccccgggttttacccgttaccgaaccgggttcccctttcccccggttaccggggtttaccgggggggaccctaaaaacgggtcccttaaccgggtccccccgttcgggttaacccccggttttccgggggttccgacccggtaccgtacggtaccccgtttagggaacggggtaactttacggggaacgggtcccgttaggtaaacggtttaactttaaccggtcggttacctttcggtacctttcccttaccgttaagttacggtttcggggtttcggtttcgggggtttaccggttccggggtaccggggtaaccggggtaacccgtaaacgggttccggtttaccgggtaaccccgggtttacccggttaacggggtaccctaacccggggtacccccggtaaacggggtcccccggtttaccccgggtccccccccggtttacccggggttaccccgtaacccgtttccccggtttacccccgggtttccccccccggtcccccggtttccccgttacccgggtttaaaaccccgggg

SEQ ID NO: 271662 - DNA, 724 bp, Homo sapiens
  misc_feature: GYAE6OF01B40BC.16.88.H11.1.454.CMB.1.raw
  modified_base (177)..(177): a, c, t, g, unknown or other
  misc_feature (177)..(177): n is a, c, g, or t
  modified_base (316)..(316): a, c, t, g, unknown or other
  misc_feature (316)..(316): n is a, c, g, or t
tcagtgtactactccacgaccggtgctcgatttagcgacagcgagaacacgacaaaggggctggcaccaggggtcccttccaatatcagcaccatggcctggactccctctctttctgttcctcctcacttgctgcccagggtccaattcccaggctgtggtgactcaggagccctnactgactgtgtccccgaggagggacaggtcgactctcacctgtggctccagcactggagctgtcaccaatggtcattactccctactggttccaactagaagcctgggaccaacgcccccagggaccacgtcgatttangaataaccgaaaacaacaaaacactaccgtacgggaacccctgtcccggttactcgaacggtcctacccgtcgggttacggggacaaacggtcgttaccgcccgttcggtaaccccgttttcggggacgaccggacgtacggcccgttaggacgggactggaacggtctaggtaagttaacgttacgtcgttcgttagtccttcgttaccttagtaccggttagggtcggtttcggggtcggtttcgggaccggggtaacgggaaccgaacggttaccgtacggtaaccccggttcgttacgggtacctaccgggtacccgaacgggtccgttcccggccccccgttaccgggtcctaacccggtccttacccgggttacccctaccccggttcgtaccgggtaaacg

SEQ ID NO: 271663 - DNA, 660 bp, Homo sapiens
  misc_feature: GYAE6OF01BA9F8.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttaccaactagaagcctggccaacgcccccaggacactgactttatagataacaaacaacaaacactacctcgacccctgcccggttctcgacgctccgtcggttcgggacaaacgctcgccctcgtacccgtttggcgtcgacctaacgtgaggtatggacggcgtaagtacttacgtgtacttgtccttcttcccgttatacggttggttcggttacggggttcggtttcggggacggtacgggaacccgtaacggtctacggtacccgttaccgtacgggtaccaacgggtcccgaaagggcccgttcccggccccccgttacgggtccctaacccgttcgttccccgtttacccccaccccgtttcccgtacggtaccggttaaccgttaacccgg

SEQ ID NO: 271664 - DNA, 653 bp, Homo sapiens
  misc_feature: GYAE6OF01B0C00.16.88.H11.1.454.CMB.1.raw
  modified_base (320)..(320): a, c, t, g, unknown or other
  misc_feature (320)..(320): n is a, c, g, or t
  modified_base (447)..(447): a, c, t, g, unknown or other
  misc_feature (447)..(447): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtgctccagcactggagctgtcaccaatggtacattactccctacgttcggttaccaacaagaacgcctgggacccaaccgcccccgaggaccacgtgtaatttanagaactaacaaaacaaacctaaaacacctacctaccggacccctcgtaccccggttctaccgacggtcctcccgtacgggttcggggacaaacggtccgtacgtccctacggtacccgtttcgggtnccggacacgtccgtagacggagttacggaggtccgtaggtaacggttaacttacgcgtcgttagccgttcttaccgtagtaggtcggtttggttacgggtcggtcgggtaggacggaccaagtcgtacgtaccgtacgtagccgtagacccgaagcgtcccgcccctcgtccacctcgttcccgtacccgccctccgtcgtaacgg

SEQ ID NO: 271665 - DNA, 532 bp, Homo sapiens
  misc_feature: GYAE6OF01CXI87.16.88.H11.1.454.CMB.1.raw
  modified_base (343)..(343): a, c, t, g, unknown or other
  misc_feature (343)..(343): n is a, c, g, or t
  modified_base (483)..(483): a, c, t, g, unknown or other
  misc_feature (483)..(483): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
  modified_base (520)..(520): a, c, t, g, unknown or other
  misc_feature (520)..(520): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtccaccaatggtcattatccctactggttccaacagaagcctggccaagcccccaggacactgatttactgataacaaacaacaaacactcctgacccctgcccgttcncaggctcccgtcgttggggcaaagctcgccctgtacccgtttcgggtcgcgcagcctggaggatgaggctgagttattactgtcttgctctctatggtggtgttcggtgttcgggcggtaggacagctgccgtctaggcngccgacggctcggccccncggtcnctcgtcgttcccnccctcctgtacg

SEQ ID NO: 271666 - DNA, 754 bp, Homo sapiens
  misc_feature: GYAE6OF01CP4UN.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcacatgtcattatccctactggttccaactagaagcctggaccaagccccccaggacactgatttatgataacaaacaacaaacactcctacggacccctgacccgttctcacggcctcccgtcggttcggggacaaagtcctcgcccctcgtaccccgtttcgggtcgcgccacgccgtacggaggacgttggacgggtcgtaggaagtttaacttacgttcggtaccgtttcgccgttccttacccgttaagttacgggttcggggtttcgggttttacggggtttcgggtttacccggggtaccgggggtaaccggggtaacccgtaaacgggtcccggttacggtaaccccgggttacccggttaacgggttacccgaaccgggtaacccccggaaacggggttcccctaccccgggtcccccccccggttacgggttcccctaacccggtttcccggttccccggtttaccccccccggttcccccccgttcccgttcccgggttaaacccggg

SEQ ID NO: 271667 - DNA, 522 bp, Homo sapiens
  misc_feature: GYAE6OF01CUH6B.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgatacaaacaacaaacactcctggacccctgcccggttctcaggctccctcggttggggcaaacgctgccctgaccctttcggtgcgcagccgtgaggatgaggctgagtatactgcttgctctcctatgtggtgttggtgtcggcggagggaccagctgaccgtctaggtcagccgaaggctcgcccctcgtcactctcgttccccgcctccgtcgtacg

SEQ ID NO: 271668 - DNA, 666 bp, Homo sapiens
  misc_feature: GYAE6OF01CT12N.16.88.H11.1.454.CMB.1.raw
  modified_base (307)..(307): a, c, t, g, unknown or other
  misc_feature (307)..(307): n is a, c, g, or t
  modified_base (415)..(415): a, c, t, g, unknown or other
  misc_feature (415)..(415): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggagctgtcaccaatggtcattactccctactcggttccaacagaagcctggaccaacgcccccaggaccactgtacttangaataacaaacaacaaacactacctacgacccctcgacccggttctacgacggtcctcccgttcggtcggggacaaacgctcgccctcgtacccgtttcggtcgcgcncgccgtgaggagtggaggtctggtagtacttacgtgtcgttcgccttctccttagttaggttgggttcgggtttcgggtcggttcgggacgggtacgggtaacctaaggtccgtacggacccggttaccggtacggtccgtaaccggaccccggtaacggtcccgtacccggtccccccgttccgggttaccctaacccgttcccgttcccggttccccccggtccccgttccccggtccggttaaaccgg

SEQ ID NO: 271669 - DNA, 683 bp, Homo sapiens
  misc_feature: GYAE6OF01DG535.16.88.H11.1.454.CMB.1.raw
  modified_base (341)..(341): a, c, t, g, unknown or other
  misc_feature (341)..(341): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtcccaggagggacagtcactctcacctgtgctccagcactggagctgtcacaatggtcattatcctactggttccaacagaagcctggccaacgcccccaggacactgatttatgataacaaacaacaaacactcctcgacccctacgcccgtcncacggcctcctcggttggggcaaacgctcgcctgacccgttcggtgcgcgacgccgtgacggacgtgaagggtctggtaagttaacttacgtcgtcttacgtcttcctacccttagttacggtggttcgggtttacggggttggtttaccggggcggggtaaccggggtaaccgtaacgggtaccgttacggtaacccgggtttcccgttaacgggttacccgaacggacccccggtaaagggtccccgttcccggtcccccccgttacccggggtccctaacccgttcccggtttacccggtttccccccggtcccctccccgttccgggttaaacccggg

SEQ ID NO: 271670 - DNA, 684 bp, Homo sapiens
  misc_feature: GYAE6OF01D5Z3T.16.88.H11.1.454.CMB.1.raw
tcagtgtactactccacgaccggtgctcgatttagcgacagcgagaacacacaaaggggctggcaccgggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactcggttaccaacagaacgccgtggccaacgcccccaggacactgactttatgataacaaacaacaaacactcctcgaccctcgtcccgtctcacgctccgtcggtgggcaaagctcgccctcgtaccctttcgggtcgcgcgacgccgtggaggacgtggacggtcgtaggtagtacttacgtcgtcgtttcggcttaccgttccttagttacggttgggtttacgggtttcggggttcggtttaccggggcggggtaacgggtaacccgtaaggccgttacggtacccggttccgttaagggtccgaaccggaccccgaaacgggtcccgttacccgggccccccgttacccgggttccctacccgttcccgttacccggttccccccgttcccccgttccccgttccggtaccggttaacccgg

SEQ ID NO: 271671 - DNA, 907 bp, Homo sapiens
  misc_feature: GYAE6OF01EDZKZ.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtccccgaggagggacagtccactctcacctgtcggcctccagcacgtggacgctcgccacctaagtcggtctaagtttacttaccccttacgttcgggtttacccaaacgtaagaaccgtcccgtacggaccccaaaccggacccccccgaagggacctaccgttggtaacttttagtacggaacttaaaccaaaaacctaaaaccaaaaccgtaccttacccgtaccgggtaccccccttcggtaccccggtttcctaccgacggtcccttcccggttacggggttcggggacgtaaacgtccgtaccgtccctaccggttacccggttttccggggtcgtacccggtaccgtaccggacccgtttacgggaacggtaacggttagggaccgggttacgttacgggtaacgtttaacgtttaaccggttcgttaccggtttcggttcccttaccgtttacctttaacggttacgggtttgggtttaccgggttttcgggggggtttacgttacccggggggtacggggaacccgggttaaccggtaacggtcccgttacgggtaccccggttcggtaaccggtaccgtaaccggaccccggttaaacgggtccccgttacccggtccccccggttaaccggttccccgtaacccggtttcccggttccccgggtttacccccccgtcccggtttaacccccggtggtttaaaaccccggg

SEQ ID NO: 271672 - DNA, 571 bp, Homo sapiens
  misc_feature: GYAE6OF01EY591.16.88.H11.1.454.CMB.1.raw
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggcactgattatgatacaaacaacaaacactcctgaccctgccgtctcagctcctcgtgggcaacgcngccctcgaccctttcggngtcgctacgcgtcgaggagtcgaggctagagtacttactgtctgtctctctatagtggtgttgggtcgtcggcggacgggtaccagtctcgtaccgtcgtcggtcacgcccgaacggtcgtcccggcccccgttccgggtcctaacccgttcccttccggtttccccccgccccgttcccgtccgggttaaaccgg

SEQ ID NO: 271673 - DNA, 577 bp, Homo sapiens
  misc_feature: GYAE6OF01ASYXF.16.88.H11.1.454.CMB.1.raw
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
  modified_base (438)..(438): a, c, t, g, unknown or other
  misc_feature (438)..(438): n is a, c, g, or t
  modified_base (561)..(561): a, c, t, g, unknown or other
  misc_feature (561)..(561): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattatccctactggttccaacagaagcctggccaacgcccccgaaggaccactgatttangatacaaacaacaaacactcctggaccccctgcccggttctccacggcctacccgtcggttggggacaaagctcgccctcgtaccctttcgggcncgcacgccgtggaggatggnggctaggagtagttacngtcttgctctctagtggttggtggttcgggtgttcggcggacgggacagctacggaccgtcgtacggtcacgcccgaaggtcctccggtcccccctggtcccaccgttccgtccgttaccccnccctccgtcggtaacg

SEQ ID NO: 271674 - DNA, 699 bp, Homo sapiens
  misc_feature: GYAE6OF01B526X.16.88.H11.1.454.CMB.1.raw
  modified_base (562)..(562): a, c, t, g, unknown or other
  misc_feature (562)..(562): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcgaggacgccctcactgactgtcgtcccgagggaggacagtcactctcacctgtcgctaccgagctacgtggagctcgtaccaaccgtaagtcggtactattaactcccttacgtcggttaccaacgaagacgccgtcgaccgaaccgccccgaggactactagtactttagacaactaaacaaacaaacaacacctaccgtaccgtaccccgtacgtacccgttctacgacggcctccgtacgggtacgggactaacgcgtaccgccgtcgtacccggttggtcgtcgacgtacgaccgtagacgtagtacggtacgggcttacggtaattacgttacgtcgtacttacgtccttactacgtagttggttacgggttcggttcgggtcggtaccggngggtaacggtacctagggtaccttacggtacccgtagggtaccgacgaccggtacccgtacggtaccgtcccggtaccccgtgtacccgtactttacccgaccccgtttaaccccgacctttccgtcccggtaaacg

SEQ ID NO: 271675 - DNA, 696 bp, Homo sapiens
  misc_feature: GYAE6OF01C3PMV.16.88.H11.1.454.CMB.1.raw
  modified_base (322)..(322): a, c, t, g, unknown or other
  misc_feature (322)..(322): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccgaggagggacagtcactctcacctgtgctccagcacgtggagctgtcaaccaagtcggtcaattactccctaactcggttaccaaactagaacgcctcgaccaacgcccccgaaggacacgtgtaactttanagaactaacaaaacaaacaaaccaactcctacggacccctcgtcccggttctaccgacggtcctacccgtcgggttacggggacaaacgcgtcgccctcgtaccccgttggtcgcgacgacgcgtaggaggtacgtggaacggtcgtagtaacgttaacgttacgtgtaccgttcgtccttaccttacccgttaagtacggtttagggttcgggtttacgggttcgggttacgggacggggtaacgggaaccgtagtcccgtacggtaacccggtccggttacggtaccgaccgaccccggtaaggtccgtacccgtccccggtacgtcccaaccgttctaccccggttccccaccccttcgtaccggtaaacg

SEQ ID NO: 271676 - DNA, 687 bp, Homo sapiens
  misc_feature: GYAE6OF01BQ9VQ.16.88.H11.1.454.CMB.1.raw
  modified_base (233)..(233): a, c, t, g, unknown or other
  misc_feature (233)..(233): n is a, c, g, or t
tcagtgtactactccacgaccggtgctcgatttagcgacagcgagaacacacaaagggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggcctccagcactgganctgtcaccaatggtcattactccctacttcggttacccaacagaacgccgtaggaccaacgcccccaggacctactcgtatttataggactaacaaaacaaacaaaacctacctcctaccggacccctcggtaccccggttctaccgacggtcctcccgtcgggttcgggggacaaacgtctacggccctcggtacccgtttcgggtcgcgcgtacgtccgtggacggtagtcggacggtctggagttacttactggtccttggtccttctcccttaagttcggttcgggtttcgggttcgggttagggttccggggtacggggtaacggggtacccgtaaggtccgtcgtaccggttccgtacggtccgacggacccgacgggtccctaccggtcccccgtcggtaccctacccgttccgacccgtttcccgaccccgtttccgacggtaacg

SEQ ID NO: 271677 - DNA, 631 bp, Homo sapiens
  misc_feature: GYAE6OF01DQWSK.16.88.H11.1.454.CMB.1.raw
  modified_base (231)..(231): a, c, t, g, unknown or other
  misc_feature (231)..(231): n is a, c, g, or t
  modified_base (342)..(342): a, c, t, g, unknown or other
  misc_feature (342)..(342): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccatggtcattactccctactggttccaacagaacgcctggccaagccccccaggacactgatttatgatacaaacaacaacactcctcgacccctgcccgttcncacggcctcccgtggttcggggacaaagtcctcgtccctcggtaccccgtttcgggtcgcgcgtagccgttggacggagtggaggtcgtgagttattactggtcttcgctcctacgttagtaggttgggttggtttcggggttgttccgggacggggtaggaaccgagtcgtcggtacccgttcggtagtccggtacgcccgtaagggtccctacccgggtcccccgtaccgggttcgaacccgtttccggttccccgtttcccccgcccccgttcgttcccggtacgg

SEQ ID NO: 271678 - DNA, 755 bp, Homo sapiens
  misc_feature: GYAE6OF01BTAVE.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattagtccctacttggttccaacagaagcctggaccaacgccccccaggaccactgatttatgaactacaaactaacaaacacctacctcggaccctcgcccgttctcacgcctcctcggtcggggcaaacgcgtcgccctcggtacccgtttcgggcgccggtacgacgtccgtggacggtagtacggacgggtctaggtacgttaacgttaaccgttcggtacgttttcggaccctttccgttaccgtttaaggttacggtttacggggttcggggttttccggggtttcgggtttaccggggtacgggggtaaccggggtaacccgtaaacgggtcccggtaccggtaacccccgggttccggttaaaccgggttaccgtaccgggtaccccgtaaacggggtcccttaccccgggtcccccccgttacggggttaccccctacccgttcccgtttaccccggttacccccctaaccccgtttccccggtaccggttaaacccggg

SEQ ID NO: 271679 - DNA, 731 bp, Homo sapiens
  misc_feature: GYAE6OF01EVQAU.16.88.H11.1.454.CMB.1.raw
  modified_base (232)..(232): a, c, t, g, unknown or other
  misc_feature (232)..(232): n is a, c, g, or t
  modified_base (316)..(316): a, c, t, g, unknown or other
  misc_feature (316)..(316): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactgganctgtcaccaatggtcattactccctactcggttaccaacagaacgtcctcggaccaacggccccccaaggaccactagatttanagaataaccaaactaaccaaacgtacctaccgtacgacccctcgtcccggttctcgacggtcctccgtcggttacggggacaaacgtccgtcgcccgttacgtacccgtttcgggtcgccgacgtacgtccgtacggaacggtagtcggaagggtcctaggtaacgttacttacgtcgtacgttcgtccttccttaccgttaggttacggttgggtttcggttccgggttacgggttccgggacgggggtacgggtaacccgttaacggtcgttaccgggtacccgttccggtaacgggttaccgaccgggtaccccggtaacggttcccgtccccggtccccccgttacgggttccctaacccggttccctttcccggttacccccgtccccgttcccgtacggttaaacccgg

SEQ ID NO: 271680 - DNA, 515 bp, Homo sapiens
  misc_feature: GYAE6OF01EHLHW.16.88.H11.1.454.CMB.1.raw
  modified_base (347)..(347): a, c, t, g, unknown or other
  misc_feature (347)..(347): n is a, c, g, or t
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
  modified_base (447)..(447): a, c, t, g, unknown or other
  misc_feature (447)..(447): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactcggtttccaaacagaaagcctggccaagcccccaggacactgactttatgatacaaacaacaaaacactcctggacccctgcccgttcncagcctcctcgtggggcaaagctgccctcgaccctttggcncgcagcctgaggntgagctagatntactgacttgctctctatagtggtgtggtgtcggngtggacngcgngcgtcgtacgnacgccgaagctcgccctgtcncttcncttcccncctccgngtaacg

SEQ ID NO: 271681 - DNA, 618 bp, Homo sapiens
  misc_feature: GYAE6OF01AIRXP.16.88.H11.1.454.CMB.1.raw
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
  modified_base (393)..(393): a, c, t, g, unknown or other
  misc_feature (393)..(393): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtctattatccctactggttccaacagaacgcctgccaacgcccccaggacactgattngatacaaacaacaacactcncgaccctcgccgtctcacgctccgtgtcgggcaagctcgccctgtcccgtttggcgcacgcgcctggacgntcggagcgtagtagtacgttacgtgtacttgtacctcttaccgtattacgggttgggttacgggtttcgggttcgggttccggggcgggtaacgggaaccgtaggcccgttaggaccccggtctagggtcccacggtaccccggacggcgttaccccggtcccccgttacggtcccttccgttccggttcccgttccccccgccgttcccggtcggttaacccgg

SEQ ID NO: 271682 - DNA, 656 bp, Homo sapiens
  misc_feature: GYAE6OF01DBGY8.16.88.H11.1.454.CMB.1.raw
  modified_base (305)..(305): a, c, t, g, unknown or other
  misc_feature (305)..(305): n is a, c, g, or t
  modified_base (413)..(413): a, c, t, g, unknown or other
  misc_feature (413)..(413): n is a, c, g, or t
tcagtgtactactccacgaccggtgctcgatttagcgacagcgagaacacacaaaggggctggcaccaggggtcccttccaatatcagcaccatggcctggactcctctcttttctgttcctcctcacttgctgcccagggtccaattcccaggctgtggtgactcaggagccctcactgactgtcgtccccaggagggacagtcactctcacctgtggctccagcactggagctgtcaccaatgtcattatcctactcggttccaacagagcctggccaacgcccccaggacactcgtatttangtataacaaactaaacaacacctcctacgacccctcgtcccgttctcacggtcctcccgttcggttcggggacaaagcctcgcccgtcgtacccgttcgggtgcgtcncgtccgtggacggtagtggaggtctgaagttagttactgtcgttcggcctccttacttagttaggtgggtttcggttcggggttcggttcggggaccgggtacgggacccgtaaggtccgtacggtacccgttccggtaccgggtcctaccggacccgtaaccggtcccgtacccggcccccgttaccgggtccctaccgttcccgttacccgttcccccgccccgttccgtccggtaaacgg

SEQ ID NO: 271683 - DNA, 702 bp, Homo sapiens
  misc_feature: GYAE6OF01CH0L4.16.88.H11.1.454.CMB.1.raw
  modified_base (295)..(295): a, c, t, g, unknown or other
  misc_feature (295)..(295): n is a, c, g, or t
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctggtggtgactcgacggcgccctcacgtgactgtcgtcccgagggaggacagtcactctcactgtcgctcagcactggagctgcacagtgtcattctacctactcggtcaacgagagcctcggaaccacgccccgaggacnctagtacttagagaactaacaaacaaacactaccgtcgacgtaccgtcgtaccgttncgacggtccttcggttacggngggtaactaacggcctacgccgtcgtaccggtttggcaccggtacncgtaccggagtacgggattcggaacgtccggtaagtaccggttattacgggtcttacccgggtacttaacccgtccgtttaacgttaacggttcggggttttcgggttaacggggtttccggggtttacggtccggggtaaccgggtaacgggtaacccgtacggtaccggttaccgtacccgggttacgtacgggttaaacccgccgtacccggtaacgtccggtacccgtccgtcgtaccgtctacccggttcaccccggtttcctcgggtcgttaaccgg

SEQ ID NO: 271684 - DNA, 600 bp, Homo sapiens
  misc_feature: GYAE6OF01BOHLG.16.88.H11.1.454.CMB.1.raw
  modified_base (312)..(312): a, c, t, g, unknown or other
  misc_feature (312)..(312): n is a, c, g, or t
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
  modified_base (585)..(585): a, c, t, g, unknown or other
  misc_feature (585)..(585): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggacgccctcactgactgtcgtccccaggagggacagtcactctcacctgtggctccagcactggagctgtcaccaatggtacattactccctactcggttaccaacagaacgcctcggaccaacgcccccaggacactgatttangataacaaacaacaacactccncgaccctcgcccgtcncgacgtcctccgtcggtcgggacaagctcgcctcgactacgttcggcgcgcacgccgtggagatggacggtgtgtaagttacttacgtgtcttcgtcctactccttagtagttcggttcgggttcgggttcggtcgggacgggtacggaaccgaagtccgtacgacccgtcgtacggtacaccgccgtaagcccgtaccgccccgttacgtcctaccgttcgtaccgttcccccnccgttccgtaaccgg

SEQ ID NO: 271685 - DNA, 641 bp, Homo sapiens
  misc_feature: GYAE6OF01BS7G6.16.88.H11.1.454.CMB.1.raw
  modified_base (304)..(304): a, c, t, g, unknown or other
  misc_feature (304)..(304): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggaccactgatttangataacaaacaacaaacactcctcggacccctcgcccggttctcacggctccctcggtggggcaaagctcgccctgtcccgtttcgggtcgcgcacggcctggaggtagtcggtacggcgtagacgttattacgtgtcgttcggtccttccgtcttagttacggttgggttcgggtttcggggttggttcggggccggggtaacgggaccgtaacggtccgtacggtacccgttccggtacgggtcccgaacggaccccggtaacggtccgttcccggcccccgttcggtcctaccgttccgttcccgttccccgtccccttcccgtcggtaaccgg

SEQ ID NO: 271686 - DNA, 730 bp, Homo sapiens
  misc_feature: GYAE6OF01CIYV0.16.88.H11.1.454.CMB.1.raw
  modified_base (178)..(178): a, c, t, g, unknown or other
  misc_feature (178)..(178): n is a, c, g, or t
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (440)..(440): a, c, t, g, unknown or other
  misc_feature (440)..(440): n is a, c, g, or t
tcagtgtactactccacgaccggtgctcgatttagcgacagcgagaacacacaaaggggctggcaccaggggtcccttccgaatatcagcaccatggcctgactcctctctttctgttcctcctcacttgctgcccagggtccaattcccgaggctgtggtgactcgaggacgccctnactgacctgtcgacccgagggacggacacgtcactcncnccgtgtcgacctcngctacgtgagtctgcaccaagtggtacacttactccttacgtcggttacaacgagaacgccgcggaccaaccgccccgaaggtacactatatttacagaacaacaaaacaacaacacctccgacgaccctacggtccgtctcgacgtcctccgtcgggtacgggactaaacgctacgtccctacggtacccgtttcggacgcgacgtcncggtgaggacgtgacggtatagggtaactttaagtaccttcgggtccttaacgtcctaccgtttacccgttaagggtttacggtttaggggtttccgggtttcggggttcgggttacccggggtaaacggggtacccgggaacgtaacggttacccggtacgggtaacccgttaacggtcgtaccgacccggtaaccgacggtccccgttaccggtcccccgttaaccgggtcctttcccgttaccccgtacccggttccccgtccccgttaccgtaacggttaacccgg

SEQ ID NO: 271687 - DNA, 666 bp, Homo sapiens
  misc_feature: GYAE6OF01EHRRW.16.88.H11.1.454.CMB.1.raw
  modified_base (323)..(323): a, c, t, g, unknown or other
  misc_feature (323)..(323): n is a, c, g, or t
  modified_base (363)..(363): a, c, t, g, unknown or other
  misc_feature (363)..(363): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggacgccctcactgactgtcgtccccgaggagggacagtcactctcacctgtggctccagcacgtggacgctgtccaccaatcggtacatttactccctacttcggtttaccaaacagaacgcctaggaccaacgcccccaggaccactgtatttangactaacaaacaacaacactcctcgaccctcgcccgttcncgacgcctccgtcggtcgggacaacgcgtcgccctcggtacccgtttcgggtcgccgcgtacgccgtaggaggacgtggacggtctagtacgttacgttacgtgtactttcgccttccgttacgtagtttacggttcgggttcggtttccggggtttcgggttaccgggacgggggtaacgggtaccgaacggtccgtacgtacccggtcgtacgggtccaaccggtcccgaacggtcctacccggtccccgtcggtaccctcgttccgtcccggttaccccgcccttccgtcggttaaccgg

SEQ ID NO: 271688 - DNA, 842 bp, Homo sapiens
  misc_feature: GYAE6OF01AEWGV.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctggtggtgactcaggacgccctcactgactgtcgtccccgagggaggacagtcactctcacctgtcgcctcagcactggagctgtcacctatgtacattactccctactcggtaccaacagaacgcctcggaccaaccgcccccgaaggacctactcgttaatttacgagaactaaaccaaaacaaaacctaaacctaccctacccgtccggaacccccgttccggtaccccggttccgtaccgtaaccggtccccttaccccgggtttccggggtttacgggggaaccaaacggtccgttcccggtccccggttacccggttaccccggttttcggggccggtcccggtacgacccggtccgtagggacggtaggtgggacggttcgtaaggtacgtttacgttacgttcgtctttcccggtactttaccgttacccgtttaaggtttcgggttttcgggggtttcggggttttccgggggttttacggggttacccgggggtacggggtaaacccgggggtaacccgttaccgggtccgttacccgggttacccggttcccggttaacggcccggtaaccgggaccccggtaccgggttccccgtccccgggttccccggtaccgtttacccgtccgttaccccgttccctaaccccccgtcccttcccggtacggttaaacccgg

SEQ ID NO: 271689 - DNA, 822 bp, Homo sapiens
  misc_feature: GYAE6OF01CQDCO.16.88.H11.1.454.CMB.1.raw
tcagtgtactactccacgaccggtgctcgatttagcgacagcgagaacacacaaaggggctggcaccaggggtcccttcaatatcagcaccatggcctggactcctctctttctgttcctcctcacttgctgccagggtccaattccaggctgtggtgactcaggacgcctcactgactgtcgtccccagggacgggacagtcactctcacctgtcgactccagtcactggacgctcgtacaccaagttcgggtactaagtttactccccgttaacgttcgttaccaaacgaggtaaacgtccgtacggaccctaaaccggcccccgaagggtaccctacgttacttagtttactaccggtaaacttaaacaaaaccggtaaactaaaacctaccgttaccgtaccggtaccccggttacgtaccccggttactaccggtacggtccccgttaccgttacggggttacggggaacctaaacggtccgtaaccggtcccgttaccggtaacccggttttcgggggtactaccgtcggtaccggtaccgttacgggaacggttagtacgggtacggttaacgttcgggtaaagtttaaccgtttcggtacggttaaccttttcggaccgttaacctttacggttaaccggttgggtttacgggttcgggttttacggggtccgggttagggtaccggggttaacgggaccgttacgtcggtaccgtacccggtttacgacgttcgaccggtaccgtacggtccgtccggtacctcggttaaccctcgttacccctccggtacccttccgtgttacccggtacgg

SEQ ID NO: 271690 - DNA, 764 bp, Homo sapiens
  misc_feature: GYAE6OF01B5JHN.16.88.H11.1.454.CMB.1.raw
  modified_base (170)..(170): a, c, t, g, unknown or other
  misc_feature (170)..(170): n is a, c, g, or t
  modified_base (175)..(175): a, c, t, g, unknown or other
  misc_feature (175)..(175): n is a, c, g, or t
  modified_base (355)..(355): a, c, t, g, unknown or other
  misc_feature (355)..(355): n is a, c, g, or t
tcagtgtactactccacgaccggtgctcgatttagcgacagcgagaacacacgaaaggggctggcaccaggggtcccttccaatatcagcaccatggcctggactcctctctttctgttcctctcacttgctgccagggtccaattcccaggctgtggtgactcgagganccctnactgactgtcgtcccgagggaggactacgtacactctacaccgtggtcgacctcgacgcacggtaggcgctcgtaccaactaagtcgtactactttacctacccgttacgtcggttaaccaagtaacggaaccgtccgtacggaaccgaaccgccccgaaggaccctaagtagtatttanaactaactaaacaaaacaacaaactacctaccgtaccgaccctccgtacccgtctaccgtacgtcccgtaccggtaggggttaccggaactaacgtccgtaccgtcccgtaccggttcccgggttacggcgacgtaccgacggtaccggtagaggtacgtacggtagtaccgttagtagttaccttagtcgtcgttacgcctttacgtacttcgggttaggtcgggttgggtttccggggtacggtcccgggggaagggtaccgaacgtcggtacgtaccggtaccggtcgggtaaccgtcctaacccgggaccgtacggtccccgtacccccgggttccgacccggttacttccccggttacctttaccccggtacccctaccccggttcgtaaccggggttaaaccg

SEQ ID NO: 271691 - DNA, 897 bp, Homo sapiens
  misc_feature: GYAE6OF01BX1FS.16.88.H11.1.454.CMB.1.raw
  modified_base (362)..(362): a, c, t, g, unknown or other
  misc_feature (362)..(362): n is a, c, g, or t
  modified_base (573)..(573): a, c, t, g, unknown or other
  misc_feature (573)..(573): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtcccaattcccaggctgtggtgactcaggacgccctcactgactgtcgtcccagggaggacagtcactctcacctgtggctccagcacgtggacgtctcgtaccacctaagtcggtacctaatttaccttaccctacgttccgggttaaccaaacaaggaaccgtcccgttacggaccccgaaacccgccccccgtaacgggacctaacttgtaacttttanacggtaaactaaaccaaaacaaaccaaaacctacccttacccgtaccggtacccccgttccgtccccgggtttactaccgtaccggtaccccttcccgggttcggggttacgggggtaacctaaaacggtcccggtaccgtaccccctttaccgggttacccccggttttcgggccggtacccggaccgtcgggtacccgtggaacgggtntacgggaggacgtttaaggtaaccgggtttatttaccggttacgttcctttccggtacccgtttaccgtttaccgtttaaacggtttggggtttaccggggtttcggggttttccgggggtttcgggtttcccgggggaaccgggggttaaccgggaaacccgttaagggttcccgtaccccgggttaaccgtacccgggttaccgggtcctaacccgggaccccggtaccgggtcccccggttccgtccccccgttcgggtacccccgttaccttccccggttacccttaccccccctacccggtcccggtcggtaaaccggg

SEQ ID NO: 271692 - DNA, 736 bp, Homo sapiens
  misc_feature: GYAE6OF01CH1BV.16.88.H11.1.454.CMB.1.raw
  modified_base (175)..(175): a, c, t, g, unknown or other
  misc_feature (175)..(175): n is a, c, g, or t
  modified_base (243)..(243): a, c, t, g, unknown or other
  misc_feature (243)..(243): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttcgctgtccccagggtccaattcccaggctgtggtgactcgaggacnccctcactgactgtcgtcccagggaggacacgtcactcctcgacctggtcgctaccgagcacgtggancctgtccgacaagtcggtactatttaccttcctagttccggtacaaacgaggtaacgccgtacggacccaaccggccccgaaggacctacgtacgttaatttagaacgtaaactaaaccaaaaaccaacaaaacctcccttacccgtaccggtaccccgtcggtttacccggtactaccggtaccggtccgttcccggttaggggtacggggaactaacgtccgtaccggtcccgttacccggttccggtttcggaccgcgtaccgacggtaccgtggtaccggtagtacggtagtacgtaagttacgttacgttcgtcgtacttcggtcccttacgtaccttaggttcggttcgggtttcggttcgggttaggtccggggacggtacggactacgtcgttacgtaccgttcgtaacggtcaacggtaccgacggtccctccggtcccgtcgtaccctccgttacctcccgtacccctacctgtccggtaacg

SEQ ID NO: 271693 - DNA, 771 bp, Homo sapiens
  misc_feature: GYAE6OF01AHGR2.16.88.H11.1.454.CMB.1.raw
tcagtgtactactccacgaccggtgctcgatttagcgacagcgagaacacacgaaaggggctggcaccaggggttcccttcaatatcagcaccatggcctggactcctctctttctgttcctcctcattgctcgccagggtccaattcccgaggctggtggtagactcgaggtacgccctcacctgacgttgtccgtcccgaggggacgggaactcgtctacctccgttctaccgttggtcggctaccgacgccacggtaggcgtactcgacctaacgtacgttgtactattaccgtaccgtagtacggtaccaacgacgacggtaccgcggaccaccggacccgacgactacgtagttacttacgtagtaaactaacaaactaaaccaaacctccgtacccgtaccggacccgtccgttacccgtcgtccgacgttcccgtacccggttcggggtacggtacctaaacggtccgtaccggtccccgtacgtttacccgggttcggtccgacgtacgtacgacccggtagtaacggtcgaggtcggtacgtaggtacgtttacgtacgttcgttccgtatccgttcttacttagggttcgggttacggtttcgggtttcggggtacggttaccggggacgggtacggtacgacggtactacccggtaccggttaggtccgacggtacccggtaccgtccggacccgtccggtccccgttacctccgttaaccgttcccgtaccttaccccgacggtccgttcggtaacccg

SEQ ID NO: 271694 - DNA, 1086 bp, Homo sapiens
  misc_feature: GYAE6OF01EBRQT.16.88.H11.1.454.CMB.1.raw
  modified_base (160)..(160): a, c, t, g, unknown or other
  misc_feature (160)..(160): n is a, c, g, or t
  modified_base (170)..(170): a, c, t, g, unknown or other
  misc_feature (170)..(170): n is a, c, g, or t
  modified_base (226)..(226): a, c, t, g, unknown or other
  misc_feature (226)..(226): n is a, c, g, or t
  modified_base (332)..(332): a, c, t, g, unknown or other
  misc_feature (332)..(332): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctcgccaggtcctaattccagctgtaggtnactcgaggcnccctcactgtacgtggtccgtacccgagggaacgggactacggtctactcctaccnccgtggtccggccttaccgacgctacgtacggactccgtacgtaccaccgtaagtcggtactaactttaccgtcccgtacgttacgttaacccaagtaacggtacnccggtacggaacccaacccggtccccgaaggtaccctacgtagttacttaacgaacgtaactaaaaccgaaaaacaaccgaaaccttacccgtacccgtacccggttaaccccggttccggttccccgttaaccttaccggaccggttaccccgtttaccggggtccggggttaaacgggggaaccttaacggtacccgttccgggttacccggttttaaccccggggtcccgggtttttcgggaacccgggttcccggtaccggtacccggttacccggggtaggtaacggggttaccggttaacgggggtaacccggtttaaggtaaccggggttttaaacgtttaaacccccgggtttagttcccgggttttaaccccgtttccggttaaccccggtttttaaccgggtttaacccgggttttaacgggtttaaggggggttttccgggtttacccgggggtttttcggggggttaaacccgggggttaccggggggtaaccgggtaaaacccgggttacccggtaaccgggggttaacccgggttaacccgtttccccgggggtaaaccgggtttaacgaacccggggttaaccccgttaaaccccggggtaaaccccggggtttccctaacccccccgggggttaccccggttccgggtttaaacccccgttacccgggttttccgttttaccccccgggggtaccttttacccccggggtaacggtttaacccgggttaaacccgggg

SEQ ID NO: 271695 - DNA, 865 bp, Homo sapiens
  misc_feature: GYAE6OF01DEA7N.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctcgttcctcctcacttgctcgcccgagggtccaacttcccgaggcttggtggtgactcgaggaccgccctcacgtcgactcggtccgtcccgaagggacgggtacacgtacctactctcgaccgtgtcgctaccagctacgtggacgtctacgtaccacgtagtcggtactaactttaccgtacctacgttaacggttaaccaaacgtaagaaccgtccgtacggaaccgaacccgtccccggaaggtaacctacgtattaactttacgaacgaaactaaaccgaaaaaccaacctaaaccgaacccgttccggttaaccggaccccgttcgggtacccgttaccgtaacggtccggtccccgtaacggttcggggtaacggggaactaacggtccgtccggttacccgttcggttaacccgggtttcggcgtccgtacggtacgtaccggtagggtaagtcggtaaggtacggtaacgtaggtaactttactcggtacgtttcgtaaccggttcctaccgttaagtcggtttacggggtttcgggtaccggggtttcgttaccgggggtccggggtaacgggaaccgggttaacgtaaccgggtactaccgggttaaccccggttggtaaacgggtcccgtaaaaccggggtcccggttcccgcccgggtttaacccccgcccggttacggttaccccggttcccttcccggtacccggttacccccgtacggttaccgcggttaaacgg

SEQ ID NO: 271696 - DNA, 1088 bp, Homo sapiens
  misc_feature: GYAE6OF01B8AJ1.16.88.H11.1.454.CMB.1.raw
  modified_base (181)..(181): a, c, t, g, unknown or other
  misc_feature (181)..(181): n is a, c, g, or t
tcagtgtactactccacgaccggtgctcgatttagcgacagcgagaacacacgaaaggggctggcaccaggggtcccttccaatatcagcaccatggcctggactcctctctttctgttcctcctcacttgctgcccaggtccaattcccgaggctggtggtgactcgaggacgcccttanactcgacgttgtccgtcccgaagggacggactaggtccactccgtcgaccgtgtcggcctccgagtccgtacgtaggtacgtccttacgtaccaccgtaacgtcggtactaacttttaccgtaccccgttaacgttaccggttaacccaaacgtaacggaccggtaccgttacggaaccccgaacccggaccccccgtaaggggtaccctaacggttacttaacgttttacgaacggttaaaccaaaacctaaaaccggaaaaccctaaaaccgttcccgttaacccgtacccgggttacccccgttacgggttccccggtttaccgtaccggtaaccggtccccgtttaccgggttaaccgggggttacggggaacctaaccgggtccgtacccggttcccgttaaccgggttcccgggttcgggaccgttaccggactaccggtaccggtaggtaacggtacggtaacggtaccgggttacgttaacgggttaaacgtttaccggttaccgttaccgttaccggtttaccgtaccgtttacccgttaaccgggtttcggttttaaccggggtttcggggtttacggggttttaccgggggtttaccggggtttaacccgggggaacccgggggtttaaccgggtaaacccggtaccggggttttaaccccgggtcccgggttttaaaccccggtttacccgggttaaacccgggttaccccgggtaaacccggggttacccccggggtaaaaccccggggttttcccccgggttaaaccccccggggttccccctttaacccccggggttccccgtttcccggggttttaaccccggttccccccgggtttacccccccggttacccccggtttaccccgggttaaaccgggtttaaaccccggg

SEQ ID NO: 271697 - DNA, 820 bp, Homo sapiens
  misc_feature: GYAE6OF01EF3OM.16.88.H11.1.454.CMB.1.raw
  modified_base (243)..(243): a, c, t, g, unknown or other
  misc_feature (243)..(243): n is a, c, g, or t
  modified_base (341)..(341): a, c, t, g, unknown or other
  misc_feature (341)..(341): n is a, c, g, or t
  modified_base (802)..(802): a, c, t, g, unknown or other
  misc_feature (802)..(802): n is a, c, g, or t
tcagtgtactactccacgaccggtgctcgatttagcgacagcgagaacacgacaaaggggctggcaccaggggtcccttccaatatcagcaccatggcctggactcctctctttctgttcctcctcacttgctgcccagggtccaattcccaggctgtggtgactcaggacgccctcacgtgactgtcgtccccgaggacgggacagtccactcctcaccgtgtggcctccagcacgtggacnctcgtacacaatggtctattactaccctacttcggttaccaagacgtaacgcctacggacctaaccggcccccaaggacctacgttagtacgtttaanacggtaactaaaccaaaactaaacctaaaaccctaccgttaccccgtacccggtaacccccgttccgggtcccgttttaccgtaccggaacggttccccttacccgggttacggggttaccgggggaacctaaaccgggtccttcccggtaccccgttaaccgggttccccggttttcgggacggtccgtacgccgtcggtacgggacgtacggtcggtaacgggtatacggtaggtttaaaccttcgtccgggttcctttcggtaccctttacccgtttaccggttaaggttttccgggtttaggggtttacccggtttcgggggtttacgttacccgggggacgggtaacggtaccgtaaggtcccgtacgggtacccgtccggtaggtacccgaacgtacccggtaggtcccgtcccggtaccccgtcggttcctacccgttactccccggttacccncccgttccgtaaggtacg

SEQ ID NO: 271698 - DNA, 717 bp, Homo sapiens
  misc_feature: GYAE6OF01CII0W.16.88.H11.1.454.CMB.1.raw
  modified_base (323)..(323): a, c, t, g, unknown or other
  misc_feature (323)..(323): n is a, c, g, or t
  modified_base (706)..(706): a, c, t, g, unknown or other
  misc_feature (706)..(706): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggacgccctcactgactgtcgtccccaggaggacagtcactctcaccgtgtcggctccagcacgtggacgctgtccaaccaagtcggtcattactcctactcggtaccaacagaacgcctacggaccaccggcccccgagaccacgtagtactttanagtaactaacaaaacgaacaaaccacctccgaccggacccctacggtcccggtactccgtacggtcccttcccggttcgggttacgggaacgtaaacgccgtccggtaaccccgttcggtaccccggtttggggcgccgcgaacgtccgtaggtacggagttcggacggtagttacgtaagttaaccgttacgtggttccttacgccgtttaccttaccgtaggttcggttagggttcgggttcgggttcggttcgggacgggtacggtaacgacgttccgacgtaccggtacgacgttaccgaccgtccgacggtccgtaccccggtcccggttcccggtacttaccgtcccgttacccggtaccccctcccgttacccggngttaaacccgg

SEQ ID NO: 271699 - DNA, 964 bp, Homo sapiens
  misc_feature: GYAE6OF01D48DH.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcgaggacgccctcactgactgtcgtcccgaggagggacagtcactctcacctgtcggctccgagcacgtggactcgtgtccaacctaagttggtacctattacctcccttacgtacggttacccaaagacgaaccggtcctacgggacccgaaccggaccccccgaagggtaaccctaacgtacggttaacgttttaacgtacggtaaacttaaaacccaaaaactaaaaccgaaaacctaaacccttccccgggtaacccgggttaaccccccgttacgggttaccccgggtttactaacccggtacgggttacccccggtttacccggttccgggggtaccggggggtaacctaaaaccggttccgtcccggttaccccgttacccgggtttaccccgggttttcggggtacgtcccggtaacgccgggtccgttaacgggacgggacggtttacggaaacggggttacgtttaacggtaacggtttaccgtttaccggtaaccgttccggttttcgtacccgttttaccgttaccgtttacggtttaacggggtttcggggtttaaccggggtttccgggttaacgggggttccggggggtaaacggggtacccggggtaaaccggttacggttacccggaccgggttaacccgggttacgtaaccgggtcccgaaccgggtaccgtaccgggtccccggttccccggttacccccggttaccggtaccccgtaccgtttccccggttaccccgtttacccccggtaaccccccttgggtaaccccggttaaccggg

SEQ ID NO: 271700 - DNA, 988 bp, Homo sapiens
  misc_feature: GYAE6OF01EXJSP.16.88.H11.1.454.CMB.1.raw
  modified_base (178)..(178): a, c, t, g, unknown or other
  misc_feature (178)..(178): n is a, c, g, or t
  modified_base (183)..(183): a, c, t, g, unknown or other
  misc_feature (183)..(183): n is a, c, g, or t
  modified_base (958)..(958): a, c, t, g, unknown or other
  misc_feature (958)..(958): n is a, c, g, or t
tcagtgtactactccacgaccggtgctcgatttagcgacagcgagaacacacaaaggggctggcaccagggggtcccttccaatatcagcaccatggcctggactcctctctttctcgttcctcctcacttgctcgcccagggtcctaacttccgaggctgtggtcgactcgaggtcnccctnactgtacgtgtccgacccgagggacgactcgtacctacttcgcctacgtggtacggtcctaccgacgtacgaccggtacggtacgtccgttacggtaacccaaccgtaaggtttaccggttaccttaaccggttttaacccttacccccgttttaacggttaacccgtttaaacccgaaaccggtaaacgggtaacccgttacccggtacccgggaacccccgtaaacccccggtacccccggaaagggtaaccccgtttagttaacggttaaaccttttaacggtaaaccgtaaaccttaaaaaccaaaaccggtaaacctaaacccgttcccgttacccggttaccccgtaccccggttccccggttaccggttaccgtaccggttcccggtaccccgttacggggtcggggggttaaccgtaaacgtaccgggttacccgtccggttaccctttcccggggtacccggttttacgggggccctaaccggtccggtacggttccggtaagggttacgggtacttacggggacggtttaattacgggttaacgtttacgggttacccttacggttttccgtccgtttcccgttaccggtttaacggtttacgggttagggttcccgggggttttgggtaacggggtttcccggggcggggttaaacgggtaccgtacccgttagggtacccgtacggtaccggtttccggaacggttcccgaccggtacccggtcgacccgttcccggaccggttacctcgtcccgtttacccncccggttaccctttacgccggtagtaccgg

SEQ ID NO: 271701 - DNA, 528 bp, Homo sapiens
  misc_feature: GYAE6OF02GFEOA.16.88.H11.1.454.CMB.1.raw
  modified_base (416)..(416): a, c, t, g, unknown or other
  misc_feature (416)..(416): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattacngcttgctctcctatagtggtgttcgggtgttcggcggagggaccaagctgaccgtctaggtcagcccaaggcctcgcccctggtccactctcgttcccaccctcctcgtacg

SEQ ID NO: 271702 - DNA, 538 bp, Homo sapiens
  misc_feature: GYAE6OF02GRRBP.16.88.H11.1.454.CMB.1.raw
  modified_base (522)..(522): a, c, t, g, unknown or other
  misc_feature (522)..(522): n is a, c, g, or t
tcagtgtactactccacgaccggtgctcgatttagcgacagcgagaacacacaaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcagctcctcgttggggcaaagctgccctgaccctttcgggtcgcgcagcctgaggatgaggctgagtattactgcttgcttctcctatgtggtgttcgggtgttcggcggagggaccaagctgaccgtcctaggtcagcccgaaggcctcggccccctcggtccacgtctcgttccccncccgttcctccgtacg

SEQ ID NO: 271703 - DNA, 643 bp, Homo sapiens
  misc_feature: GYAE6OF02I1I28.16.88.H11.1.454.CMB.1.raw
  modified_base (343)..(343): a, c, t, g, unknown or other
  misc_feature (343)..(343): n is a, c, g, or t
  modified_base (393)..(393): a, c, t, g, unknown or other
  misc_feature (393)..(393): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtccaccaagtggtcattactccctactggttccaacagaagcctcggccaacgcccccaggacactgattacgatacaaacaacaaacactctcgaccctgcccgtcncacgctccgtcggttggggacaagctcgccctcgtacccgtttcgggtcncggctacgccgtaggaggtatgggacggcgtaggtagttaattccgtgtccttgtccttctccgttagtaggttggttcggtttcgggtgttcgggacgggtacgggacgaacgtccgttacggacccgttacggtacggtccgaccggtacccgaacggtcccgttcccggacccccgttcggtacccgtaccgttacccgttccgggttccccccgtccccgttcccggttccggtaacgttaaccgg

SEQ ID NO: 271704 - DNA, 530 bp, Homo sapiens
  misc_feature: GYAE6OF02HEQV5.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgatacaaacaacaaacactcctaggacccctgcccggttctcagctcctcgttggggcaaagctgccctgacccttcggcgcgcagcctgaggatggaggctagagtattacgtgtcttgctctcctatacgtggttgttcgggtgttcggcggagggaccagctgaccgtcgtacgtcagcccgaaggctcgcccctcggtcactcgtcgtcccgactccgtcgtacg

SEQ ID NO: 271705 - DNA, 520 bp, Homo sapiens
  misc_feature: GYAE6OF02IR58D.16.88.H11.1.454.CMB.1.raw
  modified_base (382)..(382): a, c, t, g, unknown or other
  misc_feature (382)..(382): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctgacccctgcccggttctcacgctcctcgttggggcaaagctgccctgacccttcgggngcgcagctgagatgagctgagtatactgcttgctctctatagtgtgttcggtgttcggcggaggacaagctgaccgtctaggtcagcccgaaggcctcgccccctggtccacgtctcgttccccaccgtcctcgtacg

SEQ ID NO: 271706 - DNA, 543 bp, Homo sapiens
  misc_feature: GYAE6OF02HGOE7.16.88.H11.1.454.CMB.1.raw
  modified_base (304)..(304): a, c, t, g, unknown or other
  misc_feature (304)..(304): n is a, c, g, or t
tcagtgtactactccacgaccggtgctcgatttagcgacagcgagaacacgacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgatttangatacaaacaacaaacactcctgacccctgcccgtctcagctcctcgttggggcaaagctagccctgaccctttcgggtcgcgtcacgcctgagatgagctgagtatactgcttgctctctatagtgtgttcggttgttcggcggaggaccagcgtgaccgtcgtagtcagcccgaaggccgtcgcccccgtcggtcctacgtccgttacgttcccccgtcccttcccgtcgtaaccgg

SEQ ID NO: 271707 - DNA, 582 bp, Homo sapiens
  misc_feature: GYAE6OF02H9DJ1.16.88.H11.1.454.CMB.1.raw
  modified_base (309)..(309): a, c, t, g, unknown or other
  misc_feature (309)..(309): n is a, c, g, or t
tcagtgtactactccacgaccggtgctcgatttagcgacagcgagaacacacaaagggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctatggttccaacagaagcctggccaagccccaggacactgatttatgatacaaanaacaaacactcctgaacccctgacccggttctcagcctcctcgttggggcaaagctagccctgacccctttgggtcgcgcgacgcctgacggattggacgcgtgacgttattacgtgacttggctcttcctatagtggttgttcgggtgttcggcggacgggaccaagtcgtgaccgttcgtaggtccaggccccgaagggccttaccggcccccgttacggtccgtaccgttcgtccgtttacccccggtccccttacccgtccgtaacggg

SEQ ID NO: 271708 - DNA, 671 bp, Homo sapiens
  misc_feature: GYAE6OF02IFYCL.16.88.H11.1.454.CMB.1.raw
  modified_base (346)..(346): a, c, t, g, unknown or other
  misc_feature (346)..(346): n is a, c, g, or t
  modified_base (430)..(430): a, c, t, g, unknown or other
  misc_feature (430)..(430): n is a, c, g, or t
tcagtgtactactccacgaccggtgctcgatttagcgacagcgagaacacacaaagggctggcaccaggggtcccttccaatatcagcaccatggcctggactcctctcttctgttcctcctcacttgctgcccagggtccaattcccaggctgtggtgactcaggagccctcactgactgtgtccccaggagggacagtcactctcacctgtggctcagcactggagctgtcaccaatggtcattactcctactcggttccaacagaacgcctggccaacgccccaggaccactcgattatgatacaaacaacaagacactcctacgacccctacgcccggttcnccgtacgcctcccgtacggttcgggggacctaaacggctaccgccttacgacccgtttcggacgtccgcgacgcctggaacggngtacgacggcgtagtacggttacgttacgttcgcgtttcgtccgttcctaccgttatacggttggttccggttacgggttcggtttaccggggtcggtaacggggtaaccgtaacggtacgtcgggtaacccgttccggtacggtccggttacggcccggtaacggcccgttaccggttaccccccgtcggttcccgaccgttccgttacccggtttcccctaccccgttccgttacccgg

SEQ ID NO: 271709 - DNA, 623 bp, Homo sapiens
  misc_feature: GYAE6OF02I7TNJ.16.88.H11.1.454.CMB.1.raw
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaacgcctggccaacgcccccaggacactgatttangatacaaacaacaaacactcctcggaccctgcccgttcncacgcctcccgtggtcggggacaagctcgccctgtacccgtttcgggtcgccgcgacgcctggaggtatcggaggctagagttacttacgtgtcttgccttcttcctagtaggttggttggtttccggggttggttccgggacgggtacgggtaccaaggtccgtacggtacccggttccgtacggtccgacggtaccccgtaagggccttcccggtcccccgttaggtccctaccgttcccgttccggtcccccgtccccgttccgtaccggtaaccgg

SEQ ID NO: 271710 - DNA, 588 bp, Homo sapiens
  misc_feature: GYAE6OF02IDBYC.16.88.H11.1.454.CMB.1.raw
  modified_base (436)..(436): a, c, t, g, unknown or other
  misc_feature (436)..(436): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctactcggttccaacagaacgcctggccaacgcccccaggacactgatttatgatacaaacaacaaacactcctggacccctgcccggttctcacggcctccctcggttcggggcaaagctcgccctcgacccgtttcgggcgcgcagcctgaggatgagctgagtatacgtgcttgtcctntcctatagtgggtgttcgggttgttcgggcgggacggaccgtaagcgtacgaccgttcgtaggtccacggacccgaaggcccgtcggccccccgttcggtcccgtaccgttcccgttaccggtttcccccgtccgttcccgtcggtaaccgg

SEQ ID NO: 271711 - DNA, 588 bp, Homo sapiens
  misc_feature: GYAE6OF02GY2FA.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgatttatgatacaaacaacaaacactacctggacccctgacccggttctccacggctccctcggttcggggggaccaaagctcgccccgtcgtaccccgtttcgggtgccgtcgacgccttgaggatggaggctggtagtattacgtgtcttgccttctcctagtacgtggttcgttcgggttgttcggggcggagggtaccaagcgtcgaccgtccgtaggttaccacggacccgtaaggcctcggccccccgtggtccacttcgtcttccccggcccttccgtcgtacgg

SEQ ID NO: 271712 - DNA, 531 bp, Homo sapiens
  misc_feature: GYAE6OF02FWIT0.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgatttatgatacaaacaacaaacactcctggacccctgcccgttctcagctcctcgttggggcaagctgccctgaccctttcgggtgcgcagcctgacggatgaggctgagtattactgcttgcttctcctatagtggtgttcgggtgttcggcggagggaccaagctacggaccgtccgtaggtcagcccgaaggctcgcccctggtccactctcgtccccgcctcctcgtacg

SEQ ID NO: 271713 - DNA, 746 bp, Homo sapiens
  misc_feature: GYAE6OF02HU8SU.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtcggctccagcactggagctgtcaccaatggtcattactcccctatcggttaccaacagaagcctggaccaacgcccccaggaccactgatttatgaatacaaacaacaaacactcacgacccctgcccggttctcacgcctccctcggttaggggccaaagctacgccctcgtacccgtttcgggcgtcgcacgcctggacggtagtggaggctaggagttaactttacgtgtacttcggtaccttccgttaccgttaagtacggttcgggtttcgggtttccgggggtttcggggttttccggggaccgggggttaacccggggtaacccgtaaagggtcccggttacgggtaacccccggtttacccggttacggggttaccccgtaacgggtacccccggtaaagggttccccggtacccccgtaccccccgggttaccgggttaccccttaacccgggtttcccccgtttaacccggtttccccccccggttaccccgtttacccccggttacgggttaaaccccgg

SEQ ID NO: 271714 - DNA, 574 bp, Homo sapiens
  misc_feature: GYAE6OF02HSSQS.16.88.H11.1.454.CMB.1.raw
  modified_base (300)..(300): a, c, t, g, unknown or other
  misc_feature (300)..(300): n is a, c, g, or t
  modified_base (490)..(490): a, c, t, g, unknown or other
  misc_feature (490)..(490): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgagctgtcaccaatggtcattatccctactggttccaacagaagcctggccaagccccaggacactgatttangatacgaaacaacaaacactcctggacccctgacccggttctcacggccttacccgtcggttcgggggcctaaaagcgtcgaccccgttgtaaccccgtttcggggtcgcgtcgacgtcctgagggacttggacggtcttaggagtagttacgtgacttgctctctatagtggtgttcggtgtcggcggnggacagtctcgaccgtctaggtcacgtcccgaaggctcgcccctggtccacgtcctccgttcccacccgttccgtacgtaaccg

SEQ ID NO: 271715 - DNA, 522 bp, Homo sapiens
  misc_feature: GYAE6OF02HD9RO.16.88.H11.1.454.CMB.1.raw
  modified_base (516)..(516): a, c, t, g, unknown or other
  misc_feature (516)..(516): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggcccaacgcccccaggacactgatttatgatacaaacaacaaacactcctgacccctgcccgttctcacgctcctcgttggggcaagctgcctgtacccgttcgggtgcgcagcctgaggatgaggctgagttatactgtcttgctctctatagtggtgttcggtgttcgggcgaggacagcgtgaccgtctaggcacgccgaaggcctcgccccgtgtcactctccgtccccgcctccncgtacg

SEQ ID NO: 271716 - DNA, 548 bp, Homo sapiens
  misc_feature: GYAE6OF02FWDIP.16.88.H11.1.454.CMB.1.raw
  modified_base (232)..(232): a, c, t, g, unknown or other
  misc_feature (232)..(232): n is a, c, g, or t
  modified_base (349)..(349): a, c, t, g, unknown or other
  misc_feature (349)..(349): n is a, c, g, or t
  modified_base (536)..(536): a, c, t, g, unknown or other
  misc_feature (536)..(536): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccaggtccaatcccaggctgtgtgactcaggagccctcactgactgtgtccccaggagggacagtcactctcacctgtggcctccagcacctgggacnctgtcaccaattggtcattatccctactggttaccaacagaacgcctggccaagccccccaggaccactgatttatgattacaaacaacaaacactcctggacccctgcccggttcncacggctcccgtcggttcggggcaaagtctacgccctcgtaccctttcgggtgcgcagcctgacggatgaggctgagtattactgtcttgctctctatagtggttgttcgggtgttcggcggtagggaccaaggcgtacgaccgttcaggtcacgccgaaggcctcgcccctgtcactctcgtcccnccctctcgtacg

SEQ ID NO: 271717 - DNA, 764 bp, Homo sapiens
  misc_feature: GYAE6OF02IXRRT.16.88.H11.1.454.CMB.1.raw
  modified_base (284)..(284): a, c, t, g, unknown or other
  misc_feature (284)..(284): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgccagggtccaattcccaggctgtggtgactcaggacgccctcactgactgtcgtccccaggacgggacagtcactctcacctgtggcctaccagcacgtgggacgtctgtccaccaatcggtcattactccctatcggttccaacagaacnccgtggaccaaaccgccccgaaggaaccacgttagaactttagtacgtaactaacaaaacaaccaaacctaccgttccgaccgggtaccccttcgggtacccctttacgaccgtaacggtcccgttacccgtcggggttacgggggaacctaaaccggtccgtccggtaccccgttaccggttaaccccggtttcgggggtaccgtccgggaccgtaacggtcccggttaagggtaacggtacggtacgggtacgtacggttacgggtaaacggtttacttaaccgttcgttcgttcgtcccgttaccttacgtagttacggtgggtttacgttcggggttcgttcgggcgggaacggtacacggttcgtaccgaccggttacgtacggtacgtaccgacccggtaaggcccgttcggtaccccgttacggtacctccgttcccgttaccggttcccctcccggtccgtaccggtaaccg

SEQ ID NO: 271718 - DNA, 530 bp, Homo sapiens
  misc_feature: GYAE6OF02IC7BE.16.88.H11.1.454.CMB.1.raw
  modified_base (326)..(326): a, c, t, g, unknown or other
  misc_feature (326)..(326): n is a, c, g, or t
  modified_base (448)..(448): a, c, t, g, unknown or other
  misc_feature (448)..(448): n is a, c, g, or t
  modified_base (498)..(498): a, c, t, g, unknown or other
  misc_feature (498)..(498): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactcggttccaacagaagcctggccaacgcccccaggacactgatttatgatacaaacaacaaacactccngacccctgcccgttctcagctcctcgtggggcaaagctcgcctcgacccttcgggtgccgcacgcctgaggatggaggctgagtatactgcttgctctctatgtgtgttcggtgtcggcggnggacaagctcgcgtcgtagtcgacgccgaggcctcggccccctcggtccncctcgtccgttccccgccttcccgtcgtaacg

SEQ ID NO: 271719 - DNA, 771 bp, Homo sapiens
  misc_feature: GYAE6OF02HEUVK.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtccaccaagtggtcaattacttcccctactcggtttacccaaacgaacgaacgccgtgggaccccaacggcccccccgaaggaccaccgtacgtagttttatacggaattaaccaaaaccaaacctaaaacctaaccttaccctacggacccccgttcggtaccccggtttcctccgaccggtcccgttcccgttcgggttacgggggacgtaaacggtcctcggtccccgttccgtacccgtttccgggtcgtccggtacgacgtcccgtagggacggtacgtgggtaacggtcgttaggtaacgtttaacgttccgttacgttcttcggtccgttccttaccgttagttacgggttgggttcggttttccggggttcgggtttccgggtacggggaacgggtaaccgtaggtccgtaccggtacccgtaccgtacgggtaccgaccggtacccggtaacggtcccgtaccggtcccccggtccgttccgacccgtttccggttcccgtaccccctcccgtccgttaggtaaccg

SEQ ID NO: 271720 - DNA, 643 bp, Homo sapiens
  misc_feature: GYAE6OF02HK110.16.88.H11.1.454.CMB.1.raw
  modified_base (309)..(309): a, c, t, g, unknown or other
  misc_feature (309)..(309): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcacgtggagctgtcaccaatggtcattactccctatcggttaccaactagacgcctggccaacgcccccaggaccactagatttangaatacaaactaacaaactactactacggacccctcgcccggttctcgacggtccctccgtcggtacggacaacgctaccgtccgtacgtaccgttcggcgtcgacgcgcgtaggacggtagtcgacggtcgttagaacgttcgtagtcgttacgttcgtccttacctacgtttaagtggttcgggttacggttcgggttcggttacgggcgggtaacggtactacgccgtacgtacccggttcgtacgcgtaccgacccggactccgtcccggtccccgtcgtaccgttccgttccgttcccgtacccccgtaccgttcccgtaggtaacccg

SEQ ID NO: 271721 - DNA, 611 bp, Homo sapiens
  misc_feature: GYAE6OF02HDD61.16.88.H11.1.454.CMB.1.raw
  modified_base (415)..(415): a, c, t, g, unknown or other
  misc_feature (415)..(415): n is a, c, g, or t
tcagtgtactactccacgaccggtgctcgatttagcgacagcgagaacacacaaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctcagcactggagctgtcaccaatggtcattactccctactggttaccaacagaagcctggccaagcccccaggaccacgtcgatttatgaactacaaacaacaaacactcctgaccccctgcccgttctcacggtcctcccgtcgttggggacaagcgtcgtccctgtacccgtttcgggtcgcgcagcctgaggtntggaggctgtacgtattactgtcttgcctctctagttaggtgggttgttcggggtcgtttcgggcgggtacggaccgtagtcgtcggtaacccgttcgtaggtcctacggcccgtaagggccttccggacccccgttccggtaccctaccgttccgttccgtttcccccgaccccgttcccgtaccggttaaccgg

SEQ ID NO: 271722 - DNA, 665 bp, Homo sapiens
  misc_feature: GYAE6OF02G5D9N.16.88.H11.1.454.CMB.1.raw
  modified_base (312)..(312): a, c, t, g, unknown or other
  misc_feature (312)..(312): n is a, c, g, or t
tcagtgtactactccacgaccggtgctcgatttagcgacagcgagaacacgacaaaggggctggcaccaggggtcccttccaatatcagcaccatggcctggactcctctctttctgttcctcctcacttgctgcccagggtccaattcccaggctgtggttgactcaggagccctcactgactgtgtccccaggagggacagtcactctcaccgtgtggctccagcacgtggagctgtcaccaagtgtcattactccctactggttaccaacagaagcctggccaacgccccccaaggaccactgatttangatacaaaacaacgaaaacactcctaggacccctcggcccggttctcacggtcctcccgtcggttcgggggcaaagcctcgcccgtgtaccccgtttcgggcgccgcgacggccgtacggacggtacgtaggacgggtccgtgaggttaattaccgtgtaccgtttgccttcttccttaattacgggttggttcggtttcggggttacggttccggggcggggtacgggaaccgtaacgggtcgtacggtacccggtccgttacgggtcctaacggcccgaaaggtccctacggtccccccgtggttacccacgttccgtccgttacccctacccgttcctaccggttaacgg

SEQ ID NO: 271723 - DNA, 557 bp, Homo sapiens
  misc_feature: GYAE6OF02GF66S.16.88.H11.1.454.CMB.1.raw
  modified_base (303)..(303): a, c, t, g, unknown or other
  misc_feature (303)..(303): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttangatacaaacaacaaacactcctggacccctgcccgttctcaggctccctcgttggggcaagctgccctgaccctttcgggtcgcgcagcctgaggatggaggctgacgttattactgacttgctctcctatgtggttgttcgggtgttcgggcggagggaccaagcgtgacccgtcgtaggtcacgcccgtaaggcctccggcccccgttcggtccacgttcctccggttccccgccccgttccgtcgtaacgg

SEQ ID NO: 271724 - DNA, 669 bp, Homo sapiens
  misc_feature: GYAE6OF02GBJZ0.16.88.H11.1.454.CMB.1.raw
  modified_base (316)..(316): a, c, t, g, unknown or other
  misc_feature (316)..(316): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtccccagggagggacagtcactctcacctgtggcctccagcacgtggacgctgtcaccaagtggtacattactccctactcgttaccaacagaacgcctcggaccaacgcccccgaggacactgtattanagactaacaaacaacaaacactcctcgaccctcgtacccgttctcgacgtcctccgttcggtcgggacaacgcgtcgtcctcgtacccgtttcgggcgcgcgacgtcgtaggaggtactggacggtcgtagtagtaacttcgtgtcgttcgtccttcttaccgtaagttggtcgggtttcgggtttcggggtcggtttccggggacgggtaacggggtaccgtaaggtaccgttaccggtacccgttacccgtacgggttaccgaccggtacccggtaacgggtccgtcccggtcccccgttggtaccctccgttccgttcccggttcccccgtcccgttccgtaccggtacg

SEQ ID NO: 271725 - DNA, 806 bp, Homo sapiens
  misc_feature: GYAE6OF02JKIK9.16.88.H11.1.454.CMB.1.raw
  modified_base (170)..(170): a, c, t, g, unknown or other
  misc_feature (170)..(170): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcagganccctcactgactgtcgtccccgaggacgggacagtccactctcgacctggtggcctccgagcacgtcggagctgtcaccaatggtcattactccctactggttaccaaccagaacgcccgttggacccaaacggccccccaaagggtaccaaccgtaggtacttttaacgtcggtaaacttaaccgaaaacctaaaccgaaaaactaaaccttccccgttaaggggaacccccccttaaggtcccccgggtttacttaccgaaacgggtcccttaacccccggtttcggggtttaccggggggaaccttaaaacgggtaccccttcggtacccccgtttacgggttaaacccccgtttttcgggggtacaccgggtccgttaacgcccgttaggtacgtaacggtcgtaacggccgttaggtacgttacgttaccgtgtcgtttcgcttacgtacccgttagtagttcgggttacggtttcgggttcgttcgggtaccggaggtacccgaagttcgaccgtacggttccgttaaggtcctacggtaacccgtaagggtccgtacccggtaccccgtcgggttacctaccgtttccgaccgtttcccccgaacccgggtttcctacggttaacccgg

SEQ ID NO: 271726 - DNA, 636 bp, Homo sapiens
  misc_feature: GYAE6OF02GEV7H.16.88.H11.1.454.CMB.1.raw
  modified_base (304)..(304): a, c, t, g, unknown or other
  misc_feature (304)..(304): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttacngatacaaacaacaaaacacctacctacggacccctgtaccccggttctccgacggcctcccgttcggttcgggggacaaacggctcgccctcgtaccccgtttcggggtcgccgcgacgccgtgaggacgtggaggtctagacgttacgttacgtcgtcgttagtccttactccttagtacgtgggtaggtttcgggtggttcgggcgggaacgggtacaacggcgtacgtacccggtacgtacggtcgacgcccgtaacggcccgttccgcccccgttacggtcctaaccgttccgttacccggttccccaccccgttccctcggtaacgg

SEQ ID NO: 271727 - DNA, 686 bp, Homo sapiens
  misc_feature: GYAE6OF02GUWX5.16.88.H11.1.454.CMB.1.raw
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtcccagggagggacagtcactctcacctgtggctccagcacgtggacgctgtaccaccaagtcggtctattactccctatcggttccaacagaagcctaggaccaacgcccccaggacacgtgtatttangaactaacaaacaacaacactcctacgaccctgcccgttcncgacgctccgtggttcgggacaagctcgcctcgtaccgttcgggcgccgcgacgtccgtaggaggacgtaggacggtcgtagtaacgttacgttacgtgtcttcgtccttcctacgttagttacggttgggttacgggtttcggggttacggtttaccgggacggggtacgggaaccgtacggtacgttccggtaaccggttcccgtaacgggttaccaccggtaccccggaaccggttaccccgtacccccggttccggttacccgttacccgttccgtttcccggttacccccctaccccgtttccgtaccggtaacgttaacccgg

SEQ ID NO: 271728 - DNA, 541 bp, Homo sapiens
  misc_feature: GYAE6OF02IOB36.16.88.H11.1.454.CMB.1.raw
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (517)..(517): a, c, t, g, unknown or other
  misc_feature (517)..(517): n is a, c, g, or t
  modified_base (529)..(529): a, c, t, g, unknown or other
  misc_feature (529)..(529): n is a, c, g, or t
  modified_base (535)..(535): a, c, t, g, unknown or other
  misc_feature (535)..(535): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatgtcattatccctactggttccaaacagaagcctggccaacgccccccaggaccactgatttatgatacaaacaacaaacactcctgacccctgcccgttcncngcctccctcgtcggggacaagctcgccctcgaccgtttcgggtcgcgcacgcctgaggagtgagcgtagagtatctgtcttgcttctcttatggttggtggttcgggttgtcgggcggacggacagcgtcggtaccgtcgtagtcgacgccgaggcctccgcccgtcgtcncctcgtctcccncctccncgtacg

SEQ ID NO: 271729 - DNA, 852 bp, Homo sapiens
  misc_feature: GYAE6OF02H0IZS.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtccccgagggacgggtacagtcactctcacctgtggctccagcacgtggacgtctcgtcaccgaatggtactattactcccctacttacggttaccaagaagaacgtcctaggacccaacgccccaaggacctactaggaacttttagagaactaaccaaaacaaacaaactcctaccgtacggtacccctgtccggttactcgacggtcccgttcccgtacgggttacgggggactaaacggccgtcgtaccccggtacggttaacccgttttcggggtaccgccgtaccggtacgtcccggtttagggaaacggttaggttacgggtacgggtacgttacgggtaacggttaacctttacggttacggtaccgttttaaccggtcccgtttaccttaccggtttaacgttacgggtttacggggttcgggtttacggggtttaccgggttaccgggggtaacccgggggtaacgggtaacccgtaacggttccggtaaaccgggtacccgttttaaccgaccgggtttccgaaaccccgggcccgttaaaacggggtcccttaccccggggtccccccgtttacgggtaccccgttacccggttaccccgttttaccccggtaccccccgtacccgtttaccccggttaccgggttaacccggg

SEQ ID NO: 271730 - DNA, 651 bp, Homo sapiens
  misc_feature: GYAE6OF02IET2C.16.88.H11.1.454.CMB.1.raw
  modified_base (637)..(637): a, c, t, g, unknown or other
  misc_feature (637)..(637): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaagtggtacattactccccttatcggttaccaacagaacgcctggacccaaacgccccccgaaggaccactagtaactttatgaactaacaaacaaacaaaccactccgtacgacccctcgcccggttctaccgacgccctccgtcgggttacggggacaaacggtctcgtcccgtcgtacccggtttcgggtcgaccggtcacggtcccgtggtaacggattcgggacggtctaggtaacgttacgttactgttaccttgtccttcttaccgttagttaggtgggtttcggttcggggttacgggttcgggcgggtacgggaaccagtcgtacgtaccgtcgtacggctacggcccgaaggtccgtccgtccccgttagctaccgtctcccgtcccncgttccgtgtacgg

SEQ ID NO: 271731 - DNA, 798 bp, Homo sapiens
  misc_feature: GYAE6OF02JZTUQ.16.88.H11.1.454.CMB.1.raw
tcagtgtactactccacgaccggtgctcgatttagcgacagcgagaacacacaaagggctggcaccagggtcccttccaatatcagcaccatggcctggactcctctctttctgttcctcctcacttgctgcccagggtccaacttcccaggctgtggtgactcaggagccctcactgactgtcgtcccaggaggacagtcactctcacctgtggctcagtcaactggaacgcgtgtacacccgtaaagtcggtctattacttacccttacgtcggtttaccaacgtacgaaagcccgtaggccaaccgccccgacggaaccaactggaactttactcgaagttacaaaacaacaaacctacctctaccggaccccttagtcccgttacgttacgaacggtcctacccggttggttccgggggaacaaacggtcctcggtaacccgttccgtaacccgttttaccgggacgttccgaccgtaccggtaccgtaggtacgggtacgtacggtacggttaacgttcggtaacgttaaaccgtttaggtaaccgttcggtttaacgccgtttaaccgttaaccgtttacgtttaggttccgggttttacgggttaccggggtttacgttaccgggggtacgggtacggggtaaccgttacggacggtacgtaaccccgggttcgtttaacccgggcgttaaccggtacccggtaacccggtccgttaaaccccgttccggtacccttaccgtcgttaccccggttaccctccccgtttaccgaccggtacgtttaacccgg

SEQ ID NO: 271732 - DNA, 949 bp, Homo sapiens
  misc_feature: GYAE6OF02I5R4J.16.88.H11.1.454.CMB.1.raw
  modified_base (292)..(292): a, c, t, g, unknown or other
  misc_feature (292)..(292): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtcgtccccgaggagggacagtcactctaccacctgtcggtctccgagcactggacgtctcgtccaacctaagtcggtactacttactcccttactacggttacccaaanaacgtaacgcccgtacgggacccaaccggacccccaagggacctaaccttaggtaattttaacgtacgaaactaaaccaaaacaaaacctaaacctaaccgtccctaccggtaccccgtccggtcccggttacctccggaaccggtcccgttacccggtttccggggttaacggggtaaccaaacgtcccggtaccggtacccgttaccgggttacccgtttccggggaccggtccgaccgtaccggtaaccgtagggtaacggtacggtacgggtacgggtacgtacggttaacggttaacctttaacggtcggtttacccttaccgggttaccctttccccgggttaaccgttttaaaacggtttcggggtttcggggtttaaccgggggttttccggggttttcgggggtaccgggttacccgggggggtaaaccggtaaacccggttacgggttacccgggttaaaccgggtttacccgtttaaaccccggggtcggttaacccccgggaccggtaacccgggtaacccgggccggtttacccccccggggtaacccccgttaccggtttaaccccgttccccgggtttacccggttccccccggtttaccccccgtaaccccgtttaccccgggttacccggttaacccggg

SEQ ID NO: 271733 - DNA, 879 bp, Homo sapiens
  misc_feature: GYAE6OF02HZ6FW.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccgaggagggacagtcactctcactgtgctccagcacgtggagctgtacaccaatcggtactacttacgttaccctacgttcggttacccaacaacggaacgcctcggaccctaaacggccccccgaacgggtaaccaccgttagtaacttttaatacggtaactaaaccaaaaaccaaacgtaaaaacctacccgttacccgtacggtaccccctaggtccccggtttacctacgtacggcccgttaccccgttcggggttacgggggtaaccaaaacggtccgttacggtcccccgttacggttacccccggtttttcgggggtccgaccggtaccgtaaccgtccggtacgggaacggtacggtcggaacgggtcgtacggtacggttaactttacgtcgttaccgttgtaccgttcttaccgtaacgtacggtttcgggttagggtttccggggttacgggtttccggggtaccggggtaaacggggtaaccgtaaccggtaccggtacggtaaccccgtttaccggtaacgggtaccgtaaccgggtaccccggttaaagggttcccccggtaccggttaaccccccccggtttacggggtacccctttacccggtttaccccggtttacccggttacccccccgggttacccccgtttaccccggttacgggtttaaaacccggg

SEQ ID NO: 271734 - DNA, 860 bp, Homo sapiens
  misc_feature: GYAE6OF02HYQBK.16.88.H11.1.454.CMB.1.raw
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctggtggtcgactcaggacgccctcactgactgtcgtcccgaggagggtacagtcactctccacctgtgctcagccacgtggacgcttcgtacctaaccgaagtcggtactaacgttacctacccttacgttacgggttaccaaacgaacggtaacgtaccccgtacggaacccgaaccgacccccgaacggtaaccgtaacccttaggtaaacttttacgtaacgaaaaccgttaaaaccgaaaaaaccaaacctaaaaacctacccgttaacccgtacccggtaaaccccccgttcggtacccccgggttacctacccggtaacggtccccgttcccggttaccggggttacggggaacctaaaacggtcgtacccggtccggtacccggttaacccggtttccgggtccggaccggtacccgtaccggtccgtacgggaacggtacgtagggacggtacgttagtacgttacgttaaccggtcgttcgttacgccgtttaaccgttaccgttacgtacgggtttcgggttcggttttacggggttggttaaccggggacgggtacgggtacccggtaaaggccgttaccggaaccgttacggtaaccgttacggaccggtaccggaacggttccgtcccgtaccccgtacccggttacacccgttccgtccccgttacccctcccgtttaccgtcccggtaagg

SEQ ID NO: 271735 - DNA, 767 bp, Homo sapiens
  misc_feature: GYAE6OF02HWU69.16.88.H11.1.454.CMB.1.raw
  modified_base (175)..(175): a, c, t, g, unknown or other
  misc_feature (175)..(175): n is a, c, g, or t
  modified_base (306)..(306): a, c, t, g, unknown or other
  misc_feature (306)..(306): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctnactgactgtgtccccaggagggacagtcactctcacctgtggctccagcatggagctgtcaccaatggtcattactccctactcggttaccaacagaagcctggccaacgcccccaggaccactgatttangactaacaaaacaacaaacacctacccgtacgacccctcgcccgttctacgtacggcctacccgtcggttcggggacaaacggtctcgcccttcgtacccgtttcgggcgtcgccacgtccgtggaggtagttgggacggtacgttaggtaagttacgtttacgtcgtccgtttcggtcccgtttaccgttccgttaagttacgggtttcggggtttcggttttccgggggtttcgggttaccgggggtaccggggtaacggggtaacccgtaaacggttcccggttaacgggtaccccgggtttaccggtaccggggttacccgtaaccgggtaacccccggtaaacggggttcccgttaaccccgggtccccccggttaccggtcccgttaacccgttcccgttttacccggttacccccccttaccccggtttacccggttacccggttaaacccggg

SEQ ID NO: 271736 - DNA, 806 bp, Homo sapiens
  misc_feature: GYAE6OF02J1ZQT.16.88.H11.1.454.CMB.1.raw
  modified_base (177)..(177): a, c, t, g, unknown or other
  misc_feature (177)..(177): n is a, c, g, or t
  modified_base (317)..(317): a, c, t, g, unknown or other
  misc_feature (317)..(317): n is a, c, g, or t
  modified_base (353)..(353): a, c, t, g, unknown or other
  misc_feature (353)..(353): n is a, c, g, or t
tcagtgtactactccacgaccggtgctcgatttagcgacagcgagaacacacaaaggggctggcaccaggggtcccttccaatatcagcaccatggcctggactccctctctttctgttcctcctcacttgctgcccagggtccaacttcccgaggctggtggtgactcgacggacnccctacactagctgtccgtcccgagggagggacagtcactcctcacctggtcggactccacgaccaccgtcgggacgcgtcgtccaaccgtaagttcggttactacgtacctacccttacgtcggttaccaacgacgacncgtcggaccgaccacccgacgactactgtattatanactaacaaaccaaccaccacctcctaccgtaccccgtcgttaccgtcgtccgaccgttccgtaccggtcggttacgggacctaacggtccgacccgtccgtacccggttcccggttcggacgtccggcgtaccgtaccgtaggccgtacggtacggtcgggtcggtttaccgagttaacgtccttcggtccgttccgttccgtttaccgtacggttacggtttcggttttacggggtaccgggttttcggggtttcccgggtagggttacccgggggtaacgtacccggcccggtttaacgggtacccggttaggtaccgttaccggtaccggttaccggaacccgggttacccggtcccggttacccggttcccccggttacgttaccccgttcccgggttcccttccccgggttacccccggtcccggttaccgggttaaccgtacccggg

SEQ ID NO: 271737 - DNA, 765 bp, Homo sapiens
  misc_feature: GYAE6OF02ISLMX.16.88.H11.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (312)..(312): a, c, t, g, unknown or other
  misc_feature (312)..(312): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtcaattcccaggctgtggtgactcaggagccctcactgactgtcgtccccaggaggacagtcactctcacctgtggctccagcactgganctgtacacctagnggtacattactcctactcggttaccaacagtaagcctggaccaacgccccaggacaacgtgactttaancgaactaaccaaactaaccaaaacctacgtaccgttaccggtacccctacggtccccgggttaccacgtaccggtccttacccgttccggttacgggggaactaaacggtcctacggccccgttacgtaccccgttttacgggcgtccgtacgacggtcctagggaacgtcggttacgacgggtacgtagtacggttaacgttacgtcgttccgttacgccgttacgttccgttagtacggtcgggtttcggtttacggggtacggttccggtacggggtaccggtacgtaacggttcccgtaacggttacccggttaccgttaccgggttaccgtaccggtaacccggtaaaccgggtccgtaccccgggttcccccgtaccgggtaccccgttaccgttaccggtttccttacccccccggaacccctttccggtaccccggttaaaccgg

SEQ ID NO: 271738 - DNA, 767 bp, Homo sapiens
  misc_feature: GYAE6OF02IHTFA.16.88.H11.1.454.CMB.1.raw
  modified_base (199)..(199): a, c, t, g, unknown or other
  misc_feature (199)..(199): n is a, c, g, or t
  modified_base (548)..(548): a, c, t, g, unknown or other
  misc_feature (548)..(548): n is a, c, g, or t
tcagtgtactactccacgaccggtgctcgatttagcgacagcgagaacacacaaagggctggcaccaggggtcccttccaatatcagcaccatggcctggactcctctctttctgttcctcctcacttgctgccagggtccaattcccaggctgtggtgctcaggagccctcactgactgtcgtccccgagggaggganacgtcactctcacctggtcggctccagcacgtggagtcctcgtaccaacctaagtcgggtactaattacttaccccttacgttcggttaccaacgagaacgccgtcggacccaacgaccccgaggaaccactacgtaatttagagaacgtaacaaaactaacaaaaccacctaccgtacgtaaccccgtccgtaccggttacctacgtacggtcccgttacccgtacggggtcgggggacgaaacgtccgtacgtcccgttacgtaacccggtttccgggtaccgtcggacgtaacgtcccgttagggacgggtactaacgggaggacgttaggaacgttattaccggngttccgttacgtcctacttaccgttaaggttacggttgggttccgggtttcggggttagttcgggggaacgggtaacgggaaccaaggttcccgtaaggttccccggttagtaaccgggtctaaacccggttaccggaaacggtcccttcccgggtaccccgtcggtaccgaccgtttcggttcccgtacccccgtcccgttaccgtacggttaaccgg

SEQ ID NO: 271739 - DNA, 819 bp, Homo sapiens
  misc_feature: GYAE6OF02I9XRP.16.88.H11.1.454.CMB.1.raw
  modified_base (208)..(208): a, c, t, g, unknown or other
  misc_feature (208)..(208): n is a, c, g, or t
  modified_base (231)..(231): a, c, t, g, unknown or other
  misc_feature (231)..(231): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggacgccctcactgactgtcgtccccagggacgggacagtcnctctcacctgtcggctcagcacngacgctcgtccacaatcggtctattactcctacttacggttccaaactagaacgccctacggaccctaaccggacccccgaggaacctacgtacgtaacttttaagtacgaacttaaaccaaaaaccaaaccctaaaccgaccttacccgtaccggttaacccccgtccgggtaccccgggtttcctaccgtacccggtcccttaccccggtacgggtttccgggggaacgttaaacggccttaccggtcccgttacggttccccgtttcggggtcgtcccggactaccgtccgttagggacgtacggtgacgggtcgttaggtacgttacgttaaccgtggttccgttacttcccgttaccgtttacgtactttaggggttcggttttcgggttaggggggtttccggttaccggggaccggggttaaaccggtacccggtaaacgggttcctaccggtacccggttccgttacgggtaccgtaccggacccgggtaccggtcccggttacccggcccccgtttcggtacccttaccggtttccccgttaccgttccccccgtacccgttcccggtacgttaaccgg

SEQ ID NO: 271740 - DNA, 685 bp, Homo sapiens
  misc_feature: GYAE6OF02G24F4.16.88.H11.1.454.CMB.1.raw
  modified_base (236)..(236): a, c, t, g, unknown or other
  misc_feature (236)..(236): n is a, c, g, or t
tcagtgtactactccacgaccggtgctcgatttagcgacagcgagaacacgacaaaaggggctggcaccaggggtcccttccaatatcagcaccatggcctggactcctctctttctgttcctcctcacttgctgcccagggtccaattcccaggctgtggtgactcaggagccctcactgactgtcgtccccgaggaggacagtcactctcacctgtggctcagcactggagctntcaccaagtggtcacttactccctactcggttccaacgtagaacgcctgggcccaacgcccccgaaggacctacgtgtatttagtcgataacaaaacaacaaacactacctacggacccctcggtcccgttctcgaacggtcctacccgtacggttcggggacaaacggtcgtcgccctacggtacccgtttcggggtacgcggtccgacgtcccgtgacgggtactggacggtcgtaggtaacgttacgttacgtcgtcgttcgcgttccgtctacgttacggttgggttacggttcggggttaggttcggggacggtaacgggtaccgtaacggtccgttacggaccgttcgtaccgggtcgtaccggaccgtaacggcccgttccggcccccgttcggtaccctacgttccgttcccttacccctacccggttcctacggtaaccg

SEQ ID NO: 271741 - DNA, 722 bp, Homo sapiens
  misc_feature: GYAE6OF02JIY0P.16.88.H11.1.454.CMB.1.raw
  modified_base (228)..(228): a, c, t, g, unknown or other
  misc_feature (228)..(228): n is a, c, g, or t
tcagtgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtcggctccagcacnggagctgtcaccaagtggacacgttactccctacgttcggttccaacgagaacgccgtcggccaacggcccccaggaccactgtatttagtagactaaccaaacaaacaaacactaccgtaccggaccccttacggtcccgttctcacgtccttacccgtcgggttacggggactaacgtctacgcccttacggtacccgtttcggggtcgtccggacgacggtccgtaggacgggtacgtcggacggtacgttcggtaagttacgtttaactcggtccgttttacggccctttaccttaccgttaacggttaggttcggggttcggtttacggggttccgggttacgggtacggggaacgggtccaacggttcgtacgtacccgttacgtcggtccgaacggtcccggaacggtccccgtaccggtccccgttacggttaccttccgttacccggttacccggttacccctacccgttccgtaccttaacggg

SEQ ID NO: 271742 - DNA, 636 bp, Homo sapiens
  misc_feature: GYAE6OF02JYI0J.16.88.H11.1.454.CMB.1.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (366)..(366): a, c, t, g, unknown or other
  misc_feature (366)..(366): n is a, c, g, or t
  modified_base (479)..(479): a, c, t, g, unknown or other
  misc_feature (479)..(479): n is a, c, g, or t
  modified_base (534)..(534): a, c, t, g, unknown or other
  misc_feature (534)..(534): n is a, c, g, or t
  modified_base (567)..(567): a, c, t, g, unknown or other
  misc_feature (567)..(567): n is a, c, g, or t
  modified_base (601)..(601): a, c, t, g, unknown or other
  misc_feature (601)..(601): n is a, c, g, or t
tcagtgtactactccacgaccggtgctcgatttagcgacagcgagaacacacgaaaggggctggcaccaggggtcccttccaatatcagcaccatggcctggactcctcgtctttctgttcctcctcacgttgctcgcccgagggtccaacttcccaggtctggtcgggtagacctcgagggacgccctcgaccttgacctggtcgtaccccgaggagggacagtccactcactccgtgngcctcanctactggactcgntaccacgtagtgacctattctccgtgtcgtaccaagagaccgccgtaggacccaaacgtccccggaatacctaacgtgtatttacaggacaacaaacccaataacncgtaccgtcgccctcggtcccgtatcgccgtcctccggtacggttgggaccaaggtcacgtccgttcgtccgtggacgctacgcgcgtagcgtagtcggctgtgtaagttctncgttgtaactcgtctaacgtgtggtcggttcgggtttcccggtgttaaccggggngtacggtaagccgtaaccgtgtaaccgtcgtanccgtaaccgccgaagttccggtaccgcccgtttncccggttactcttacccggactccgtactcggaac

SEQ ID NO: 271743 - DNA, 817 bp, Homo sapiens
  misc_feature: GYAE6OF02I6GUH.16.88.H11.1.454.CMB.1.raw
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
  modified_base (704)..(704): a, c, t, g, unknown or other
  misc_feature (704)..(704): n is a, c, g, or t
  modified_base (720)..(720): a, c, t, g, unknown or other
  misc_feature (720)..(720): n is a, c, g, or t
tcagtgtactactccacgaccggtgctcgatttagcgacagcgagaacacacgaaaggggctggcaccaggggtcccttccaatatcagcaccatggcctggactcctctctttctgttcctcctcacttgctggcccagggtccaattccaggtctggtcggtgactcgaggcnccctacacgtgctcgtcgtacccgagggcgggtacncgttcactcgtccacgtggtcgccttacncgctacgtggacgtctcgtcaacctagtcggtctactaccttccctagtccggttaaccagtacgtaccgtccgacggacccaccggtccccgaaggtactcgtacgttatttacgacgtaaaccttaacgaaaccgtaacctaaccgtcgttacccgtaaccggtaccccgtgggttccccgtacgtaaccgtggtcccccttaccggggttacgggtaccggggtaactaacggtccgttacccggtacccggtttcggttaccccggtaggggtcccgtaccgaacggtccgttacgacggtgtacgacgggtcgtcggtagtacgttactcgtacgtcgttcgtcgttacgtaggttaacttcgggtttccggttcgggttaccggttacggggtaccggttacgggaccggttaaccgtcgggtcccgttaccggtaaccggtttcgggaaccgttacnccgggtttaacccggngggttcccccgtacccgggtaaccccgacgggtttacccgtaaccgtttcccgggtttcccggttcccccgtacgggttacccgtacgtttacccgg

SEQ ID NO: 271744 - DNA, 707 bp, Homo sapiens
  misc_feature: GYAE6OF02IV32B.16.88.H11.1.454.CMB.1.raw
  modified_base (348)..(348): a, c, t, g, unknown or other
  misc_feature (348)..(348): n is a, c, g, or t
tcagtgtactactccacgaccggtgctcgatttagcgacagcgagaacacacgaaaggggctggcaccaggggtcccttcaatatcagcaccatggcctggactcctctctttctgttcctcctcacttgctgccaggtccaattcccgaggctgtggtcgactcgaggacgccctcactgactgtcgtcccgagggaggacagtcactcgtcaccgtgtcgctcgagctacgtggagcgttacgaccaacgtagtgtactacttacctccttacgtcggtacctaacgaacggaacgtccgtacggaccctaaccggccccgtagaccgtacgtacgtacgttttanacgtaactaaacgaaactaaccaaacctctaccggtccgtacccgttcgtaccgtcgtacgacgtccgttccggtcggtacggaactaacgtcgtaccgtccgtaccgttccggttaccggcgccgtaccgacgtccggtaggtaccggttagtaccggtacggtgttaacggttacgttaacgttcgtacgtcgttactcttacgtcgttaagtcgggtcgttggttacggtcgggtacggaccgggttagacgtacggtctaccggttctaccggtacgcgaccggtacgtcggtcctcccggtccgttaccgtccttaccgtcccgttccgtcccgtcccgtacgttcgtaaccgg

SEQ ID NO: 271745 - DNA, 834 bp, Homo sapiens
  misc_feature: GYAE6OF02JH1ZB.16.88.H11.1.454.CMB.1.raw
  modified_base (620)..(620): a, c, t, g, unknown or other
  misc_feature (620)..(620): n is a, c, g, or t
tcagtgtactactccacgaccggtgctcgatttagcgacagcgagaacacacgaaaggggctggcaccaggggtcccttccaatatcagcaccatggcctggactcctctctttctcgttcctcctcacttgctgcccagggtccaattcccaggctgtggtgactcgaggacgccctcacgtgactggtccgtcccgagggacggacacgtccacgtctaccaccgtgtcggctaccgacgacacgtaggacgtctcgtacaccgagttcggtactacttacctccgtaacgtccggttaaccaagaacgtaacgtcccggtacggaacccctaaccggaccccgaaaggtaccctaacgttagtaactttaactaacgtaaacctaaaccaaaaccgtaaaaccgaaaccttaccgaccgttacccggtaccccgtaccggttacccgttcaccggccggtacccttacccggggtcgggttaaccggaacgtaaccgttccggtaccgtacccgttaccggtttaccccgggttcgggacccggttaccggccgtaccggtccggtacgggaacggtacgtcggggtaaccgtcggttaacgggtacttaaccggtntccggtacgttcgttccgttaccgttagttacgttagggttccgggttaggttccgggttcgtaccggggagggtaaccgtacgtaacgccggttaccgtaccggttcggaaccgttaccgacggtaccgtccggttcccggcccgtccccggttaacgccgttcccgttccggtacccccgtttcccggcccttaccgtaccgggttaaccgg

SEQ ID NO: 271746 - DNA, 504 bp, Homo sapiens
  misc_feature: GYAE6OF01C0ZZT.13.39.D06.1.454.CMB.1.raw
  modified_base (236)..(236): a, c, t, g, unknown or other
  misc_feature (236)..(236): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccaggacagcctcctaagctgctcatttactgggcatctatccgggaatccgggtccctgaccgattcagtggcaggcgggtctgggacagatttcactctcaccatcagcagcctgcaggctgaagatgtggctagtttattactgtcagcaattattatagtactcctccgtagctcacgtttcggcggacgggaccaggtggagatacgaaacgacgtagg

SEQ ID NO: 271747 - DNA, 566 bp, Homo sapiens
  misc_feature: GYAE6OF01C5UHZ.13.39.D06.1.454.CMB.1.raw
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (431)..(431): a, c, t, g, unknown or other
  misc_feature (431)..(431): n is a, c, g, or t
tcagtcacgtactacacgaccggtgctcgatttagtgacatctcgcagttctttgggggctacaacaggcaggcaggggcagcaagatggtgttgcagactcaggtcttcattttctctgttgctctggatctctggtgcccacggggacatcgtgatgacccagtctccagactccctggctgtgtctctgggcgagagggccaccatcaactgacaagtccagccagagtgttttatacagctccaacaataagtaacttcttagcttggtaccagacagaacaggacagcctactaagctgctcatttactggcatctagtccggtaatccggggtccctagaccgatttcagtggcgaggtcggtcgtagggacagtnttcgactctacaccatcancacgccctgacacggctaggaagtagttgnggtacttaagttttaacttacgttgttacagtactaattacttaagtaacgttacctcccgtaccgtacgtcgtacttacggtttcgggacgggacgggtaaccgtaagggtaggagaactacgaaacggtaacg

SEQ ID NO: 271748 - DNA, 493 bp, Homo sapiens
  misc_feature: GYAE6OF01AE6LD.13.39.D06.1.454.CMB.1.raw
  modified_base (403)..(403): a, c, t, g, unknown or other
  misc_feature (403)..(403): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagagtgttttatacagctccaacaataagaacttcttagcttggtaccagcagaaaccaggacagcctctaagctgctcattactgggcatctatccgggaatccgggtcctgaccgattcagtggcagcggtctggacagatttcactctcaccatcagcagcctgcaggctgaacgntgtgctagtttattactgtcagcaatattatatactcctccgagctcatttcggcggagggaccaagggtcggagatacaaacgagtcgg

SEQ ID NO: 271749 - DNA, 510 bp, Homo sapiens
  misc_feature: GYAE6OF01AYLCL.13.39.D06.1.454.CMB.1.raw
  modified_base (445)..(445): a, c, t, g, unknown or other
  misc_feature (445)..(445): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcggacccagggctagtggatggaggctgactattactgtcgaggcgtgggacagcagcacgtcgcccgnttacgtcgttccgttacgggaaccgttcggggaaccctaagggtccaacccggtccgttaaacgg

SEQ ID NO: 271750 - DNA, 502 bp, Homo sapiens
  misc_feature: GYAE6OF01CTNZ5.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccgggtccctgaccgattcagtggcagcgggtctggacagatttcactctcaccatcagcagcctgcaggctgaagatgtggctagtttattactgtctagcaattattatacgtactcctccgagctctatttcggcggagggaccaggtaggagatacgaaacgacgtagg

SEQ ID NO: 271751 - DNA, 529 bp, Homo sapiens
  misc_feature: GYAE6OF01BNAYU.13.39.D06.1.454.CMB.1.raw
  modified_base (315)..(315): a, c, t, g, unknown or other
  misc_feature (315)..(315): n is a, c, g, or t
tcagtcacgtactacacgaccggtgctcgatttagtgacatctcgcagttcgtttgggggctacaacaggcaggcgaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgtttatacagctccaacaataagaacttctagcttggtaccagcaagaaaccaggacagcctacctaagctgctcatttacngggcatctagtaccgggaagtcccgggtcctgaccgtattcgagtggcagcgggtctgggacagattcactctcacatcagcagcctgacgaggctagaagatggtgactagtttatactgtcagactaatattatagtactactccgaggtcctcgtacgttcgggacggaacgggacccgaagggtcggaatatacgaaacgtacgtacggg

SEQ ID NO: 271752 - DNA, 556 bp, Homo sapiens
  misc_feature: GYAE6OF01DOI1J.13.39.D06.1.454.CMB.1.raw
  modified_base (207)..(207): a, c, t, g, unknown or other
  misc_feature (207)..(207): n is a, c, g, or t
tcagtcacgtactacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatctcttgttctgaaagcagctccaacaccggaactggtgatataaactggtaccagcagctcccaggaaccggcccccaaacagctcatctataggaataatcagcggccctcgagggtccctagaccgattctctcggctccaagtctggccacctcacgccctccctggcccatcaggtcgggacctccgggtccgaggatcgaggctggatttattactgtgcagcagttgggatgacagccgtagtacggttcggtccgggttgttccggggacgggacgggaccgaaggccgtagacccggttccgtagggtccacggcccgaaggtccccg

SEQ ID NO: 271753 - DNA, 520 bp, Homo sapiens
  misc_feature: GYAE6OF01EJZED.13.39.D06.1.454.CMB.1.raw
  modified_base (312)..(312): a, c, t, g, unknown or other
  misc_feature (312)..(312): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttacngggcatctatccgggaatcccgggtccctgaccgattcgagtggcaggcgggtctgggacagtattcactctcacatcagcagcctgcaggctagaagatgtggctagtttattactgtcagtacaattattatagtactcctccgagtctcgtacgtttcgggcggacgggaccgaagggtcggaagaagtacgaaacgacgtacgg

SEQ ID NO: 271754 - DNA, 529 bp, Homo sapiens
  misc_feature: GYAE6OF01D6BJ1.13.39.D06.1.454.CMB.1.raw
  modified_base (178)..(178): a, c, t, g, unknown or other
  misc_feature (178)..(178): n is a, c, g, or t
  modified_base (380)..(380): a, c, t, g, unknown or other
  misc_feature (380)..(380): n is a, c, g, or t
  modified_base (478)..(478): a, c, t, g, unknown or other
  misc_feature (478)..(478): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggacagataaatatacttctggtatcagcagaagtcaggccagtcccctgtcgctggtccatctatcaagatgaccaagccggccctagacgggactccgtgagcgtattctctggcctccaactcgtagggactcgagccactctanacccatccgaggccggacccaggcctaagtggactggaggcttagacttaattacgtggttacgaggtcggtaggacaggcaggccacgtcgcccgtntagtcgtcttcgggaacgttcgggacctaacgggcctacccgtcgtaacgg

SEQ ID NO: 271755 - DNA, 503 bp, Homo sapiens
  misc_feature: GYAE6OF01DW10J.13.39.D06.1.454.CMB.1.raw
  modified_base (237)..(237): a, c, t, g, unknown or other
  misc_feature (237)..(237): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctcaacaataagaacttcttagcttggtaccagcagaaccaggacagcctcctaagctgctcatttactgggcatctatccgggaatccgggtcctgaccgattcaagtggcagcgggtctgggacagatttcactctcaccatcagcagcctgcaggctgagatgtggcagtttatactgtcagactaatacttatagtactctcgaggctctactttcggcggaaggaccaagggtggaagatacgaaacgtactacggg

SEQ ID NO: 271756 - DNA, 584 bp, Homo sapiens
  misc_feature: GYAE6OF01D11AC.13.39.D06.1.454.CMB.1.raw
  modified_base (240)..(240): a, c, t, g, unknown or other
  misc_feature (240)..(240): n is a, c, g, or t
  modified_base (323)..(323): a, c, t, g, unknown or other
  misc_feature (323)..(323): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagttgttttanacagctaccaacaataagaacttcttagcttaggtaccagacaagaaaccaggacagcctacctaagctgctactatttacgnggacatctagtccgggaacgtcccggggtcctagaccgtattcgaggtcggcacggcgggtacgtcgggaactaggtactttacgaccgtactaccacctatcaacgcaacgccctgaccgagggtactaggaagacgttggtacggtacttaggttttaattacgtgttacagtactaaattacttatacgtactccctacgtaggtcctacgtacgttcgggacggaacggacgtaaggtgaagtactacgaaagtacg

SEQ ID NO: 271757 - DNA, 529 bp, Homo sapiens
  misc_feature: GYAE6OF01A34GY.13.39.D06.1.454.CMB.1.raw
  modified_base (407)..(407): a, c, t, g, unknown or other
  misc_feature (407)..(407): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccgggtcctgaccgattcagtggcagcgggtctgggacagatttcactctcaccatcagcagcctgcaggctgaagntagtggctagtttatactgtcagctaatattatagtactccgtccgaggtcctctaccgtttacgggcgggtaacgggacccgtaaagggtcggaacgtaatacgaaaaccggacttacggg

SEQ ID NO: 271758 - DNA, 519 bp, Homo sapiens
  misc_feature: GYAE6OF01DJE4S.13.39.D06.1.454.CMB.1.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
  modified_base (371)..(371): a, c, t, g, unknown or other
  misc_feature (371)..(371): n is a, c, g, or t
tcagtcacgtactacacgaccggtgctcgatttagtgacatctcgcagttctttggggagctacaacaggcaggcaggggcagcaagatggtgttgcagacccaggtcttcattttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctctaagctgctcatttacnggcatctatccggaagtccgggcctgaccgattcagtggcagcgggtctgggacagtnttcgactctcacatcacgcacgctgcaggctgaacgatgtgctaagtttatacgtgtcagactaagtattatagtactccgtacgagtctacgtactttcgggacggtagggacccgaaggttacggagtactaacgaaacgtaacgg

SEQ ID NO: 271759 - DNA, 531 bp, Homo sapiens
  misc_feature: GYAE6OF01C5TJN.13.39.D06.1.454.CMB.1.raw
  modified_base (420)..(420): a, c, t, g, unknown or other
  misc_feature (420)..(420): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgtttatacagctaccaacaataagaacttcttagcttaggtaccagacaagaaaccgaggaacacgacctacctaagctgctcatttactggcatctagtacggaactccgggtcctgaccgattcgagtggctaggcggtcgtggactagtatttcactctacaccatcagcagcctgcagctagagntgtgctagtttatactgtactagactaattattatactacctctaccgtagtctcgtacgttcgggcgggtacggtacgaagggtcgaagtataacgaaacgtcgtacggg

SEQ ID NO: 271760 - DNA, 495 bp, Homo sapiens
  misc_feature: GYAE6OF01CQIUC.13.39.D06.1.454.CMB.1.raw
  modified_base (208)..(208): a, c, t, g, unknown or other
  misc_feature (208)..(208): n is a, c, g, or t
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (341)..(341): a, c, t, g, unknown or other
  misc_feature (341)..(341): n is a, c, g, or t
  modified_base (489)..(489): a, c, t, g, unknown or other
  misc_feature (489)..(489): n is a, c, g, or t
tcagtcacgtactacacgaccggtgctcgatttagtgacatctcgcagttcttcggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggacccccgggnagagggtcaccatctctgtctggaagcagctcaacatcggaataatatgtatattgtatcagcagctcccaggaacgccccaaanagctcatctatagaataatnagcggcctcagggtccctgaccgattcnctggctcctaagtctggcaccgtcagcctcctggccatcagtcggctccggtcgaggatgaggctgattatactgtgctgacagtgggatgacagcctgagtgggtccggtgttcgggcggagggaccaaggctcgactccgaggtcngacccg

SEQ ID NO: 271761 - DNA, 512 bp, Homo sapiens
  misc_feature: GYAE6OF01EY7OD.13.39.D06.1.454.CMB.1.raw
  modified_base (236)..(236): a, c, t, g, unknown or other
  misc_feature (236)..(236): n is a, c, g, or t
  modified_base (406)..(406): a, c, t, g, unknown or other
  misc_feature (406)..(406): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccaggacagcctcctaagctgctcatttactgggcatctatccggaatccgggtccctgaccgattcagtggcagcgggtctgggacagatttcactctcaccatcagcagcctgcaggctgaagntgtgctagtttattactgtcagctaattattatagtactcctccgaggtctcgtacgtttcggcggacgggaccgaaaggtcggaagagtacaaaggacttacggg

SEQ ID NO: 271762 - DNA, 552 bp, Homo sapiens
  misc_feature: GYAE6OF01DEQ2V.13.39.D06.1.454.CMB.1.raw
  modified_base (237)..(237): a, c, t, g, unknown or other
  misc_feature (237)..(237): n is a, c, g, or t
  modified_base (409)..(409): a, c, t, g, unknown or other
  misc_feature (409)..(409): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagtgtttanacagctaccaacaataagaacttctagcttggtaccagcagaaacaggacagcctactaagctgctcatttactgggctatctagtccgggaactcccgggtcctgaccgattcgagtggcaggcggtctggacagattcactctcaccatcagcagcctgcagctagaagntgtgactagtttctaactgtacagtactaattattataacggttacctccgtaccgtaggtccttaccgttacgtttaccgggccgggaacgggtacccgtaaaggggtggaacggtaactaacgaaaaccgtaggttacggg

SEQ ID NO: 271763 - DNA, 517 bp, Homo sapiens
  misc_feature: GYAE6OF01BQSYR.13.39.D06.1.454.CMB.1.raw
  modified_base (234)..(234): a, c, t, g, unknown or other
  misc_feature (234)..(234): n is a, c, g, or t
  modified_base (309)..(309): a, c, t, g, unknown or other
  misc_feature (309)..(309): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagaggccacatcaactgcaagtccagccagagtgtttanacagctaccaacaataagaacttcttagcttggtaccagcagaaaccaggacagcctctaagctgctctattacnggcatctagtccggaatccgggtcctgaccgtattcgagtggcaggcgggtctgggactagtatttcactctacaccgatcagcacgcctgcagtcagaacgagtgtgactagtttatacgtgtacagtactaatatatacgtactcctacgagctctacgttcggacggacggaccgaagggtcggaacgagtacgaaagtcgtagg

SEQ ID NO: 271764 - DNA, 559 bp, Homo sapiens
  misc_feature: GYAE6OF01DHSVF.13.39.D06.1.454.CMB.1.raw
  modified_base (240)..(240): a, c, t, g, unknown or other
  misc_feature (240)..(240): n is a, c, g, or t
  modified_base (352)..(352): a, c, t, g, unknown or other
  misc_feature (352)..(352): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatgacccagtctccagacctcctggctgtgtctctgggcgagacggccaccatcaactgacaagtccagccagagttgtttaanacagctaccaaacaaataacgtaacttcttagtctttggtaaccagacaagaaaccaggacagcctcctaagctgctctattacgtggcatctagtccggaatccgggtccngacatcagtggcagcgggtctgggacagtagtttcactctcaccatcagcagcctgcaggctagaacgtatgtcggtactagtttaattacgtgtacgacgtaacgtaattagtttactaagtaccttcccgtaccgacgtctacgtacgtttcgggacgggaacgggaccgtaagggtcggaagactaacgaaacgtacgtacggg

SEQ ID NO: 271765 - DNA, 495 bp, Homo sapiens
  misc_feature: GYAE6OF01DUCBU.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaccaggacagcctcctaagctgctcatttactgggcatctatccgggaatccgggtcctgaccgattcagtggcagcgggtctgggacagatttcactctcaccatcagcagcctgcagctgaagatgtggcagtttatactgtcagcaatattatagtactcctccgagctcactttcggcggaggaccaaggtggagagtacaaacgagtacgg

SEQ ID NO: 271766 - DNA, 496 bp, Homo sapiens
  misc_feature: GYAE6OF01EZXXJ.13.39.D06.1.454.CMB.1.raw
  modified_base (368)..(368): a, c, t, g, unknown or other
  misc_feature (368)..(368): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccggaatccgggtccctgaccgattcagtggcagcgggtctggacngatttcactctcaccatcagcagcctgcaggctgaagatgtggcagtttattactgtcagcaatattatagtactcctccgagtctctacttcggcggaggaccaaggtggagatcgaaagactacgg

SEQ ID NO: 271767 - DNA, 502 bp, Homo sapiens
  misc_feature: GYAE6OF01DYDG8.13.39.D06.1.454.CMB.1.raw
  modified_base (236)..(236): a, c, t, g, unknown or other
  misc_feature (236)..(236): n is a, c, g, or t
  modified_base (405)..(405): a, c, t, g, unknown or other
  misc_feature (405)..(405): n is a, c, g, or t
  modified_base (487)..(487): a, c, t, g, unknown or other
  misc_feature (487)..(487): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccaggacagcctcctaagctgctcatttactggcatctatccgggaatccgggtccctgaccgattcagtggcagcgggtctgggacagatttcactctcacatcagcagcctgcaggctgaagntgtgctagtttattactgtcagactaatattatagtactcctccgagcttcactttcgggcggaagggaccaagggtggaanagtacaaagacgtgg

SEQ ID NO: 271768 - DNA, 647 bp, Homo sapiens
  misc_feature: GYAE6OF01CAGPD.13.39.D06.1.454.CMB.1.raw
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatccgtgggctcagtctgccctgactcagcctcgctcagtgtccgggtctccgtggacagtcagtccaccatctcctgccacgtggaaccagcagtgagtggttggtgttatactatgtctcctacgtacaacaacaccaggaccaaacgaccccaaatcatagtatttatgtatgtacgagtaacggccgtaccgtcggtacgggtcctagtactccgtacttcgtccgtcgacctaccgtacgtcgtacggaccaaccggtacccggtccctacccgacgaccctacgtccgtcggtcggtcctacggacggtcgtacggaacgtagtcggtacgtacttagtacgtttacgttacgtcgtacgtcgtcctagtacgttagtcgacgacggactacgtacctaacgtacgttaccgttaagttacggttccggggaacgggtaaccgggaaccctaagggttacccgtacccgggtaacccgttcccggtaggtaaccccgg

SEQ ID NO: 271769 - DNA, 511 bp, Homo sapiens
  misc_feature: GYAE6OF01DZCDM.13.39.D06.1.454.CMB.1.raw
  modified_base (364)..(364): a, c, t, g, unknown or other
  misc_feature (364)..(364): n is a, c, g, or t
  modified_base (496)..(496): a, c, t, g, unknown or other
  misc_feature (496)..(496): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtcctgaccgattcagtggcagcgggtcngggacagtatttcactctcaccatcagcagcctgcagtctagaagtatgtggctagtttattactgtacagtactaatattatagtactccgtccgaggctctacgtttcggcggaggaccaagggtggaanatacaaacgagtcgg

SEQ ID NO: 271770 - DNA, 584 bp, Homo sapiens
  misc_feature: GYAE6OF01CS6PF.13.39.D06.1.454.CMB.1.raw
  modified_base (227)..(227): a, c, t, g, unknown or other
  misc_feature (227)..(227): n is a, c, g, or t
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaancaacagtgattagttggtggttatacctatgtctcctgtaccaacagcaccaggacaaacgccccaaactcaattatttatgtatttcaactaagccgaccctcgacgggtccctgactcgtcttctctcggctccgaagtcctagaccaacgaccggtccctccctcgaccatcctcgtcgggtcctccgaggtcctggacgagtcggaggtctggtacttattcctgtcctgtctactagtcgtagggacgcctaaccgttacttacgtttaatacggttcgggaccgggtacggaacccgtggtccgttaccgacccggttccttacgggtccaaccggtcccgaaaggtcccg

SEQ ID NO: 271771 - DNA, 507 bp, Homo sapiens
  misc_feature: GYAE6OF01AU9BM.13.39.D06.1.454.CMB.1.raw
  modified_base (370)..(370): a, c, t, g, unknown or other
  misc_feature (370)..(370): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccgggtccctgaccgattcagtggcagcgggtctgggacngatttcactctcaccatcagcagcctgcaggctgaagatgtggcagtttattactgtcagcaatattatagtactcctccgaggcctctactttcggcggtacgggaccgaagggtcggagagtacaaacggactgg

SEQ ID NO: 271772 - DNA, 886 bp, Homo sapiens
  misc_feature: GYAE6OF01EEWK6.13.39.D06.1.454.CMB.1.raw
  modified_base (112)..(112): a, c, t, g, unknown or other
  misc_feature (112)..(112): n is a, c, g, or t
tcagtcacgtactacacgaccggtgctcgatttagtgacatctcgcagttctttgggggctacaacaggcaggcaggggcagcaagatggtgttgcagacccaggttctctnttctctgtcgtctgtagtctctcgtggtccgacccggacggactacgtcggtagtagtaccgaaccgtacgtacctaccgaacgtacccttccggtcggtcgttggttcgttccgttcgggtacggggacggaacgggaccggaccccaacgtactaacctaacgtcgaacgtaaccgtaccgaccgaccgtaggttacggttttagtttaacaacgacgtcctaaacccaaataaagtaaacggttaacctttacgttacgttcggtttaaccgtaaccgacgtacgaaaaccgaaaccggacggaacgaccggtacccttaaccggtaacgtccgtacgtcctactttaacgttttacgggcggtaactacttaccgttaccgggtaaccgggttaaccgggttccccgggtaccgtacgggaaccgttacgtacggtaggtcggacgtacgggtccggtcggtacggaactagttacttaccgaccttcctacccactacgtacgactcgaccgtctacgacgacgtcgtaaggaacgtgttacgggtccgtaacgttttaagttttaaccgttacggttacgacgtaacggttaaaccttaaattttaacgttaaccggtttaccgtaccccgttacccggtacgggaccgttcccgttaacggtttacccggggttcccgggggaaaggggaaaccccggggtaaccgttaaagggggtcgaaaacgttaaccggttaaaacccggtaaaacggttcgggttaacgggg

SEQ ID NO: 271773 - DNA, 519 bp, Homo sapiens
  misc_feature: GYAE6OF01DS4IA.13.39.D06.1.454.CMB.1.raw
  modified_base (236)..(236): a, c, t, g, unknown or other
  misc_feature (236)..(236): n is a, c, g, or t
tcagtcacgtactacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccaccctcagcgtctcggggacccccggcagagggtcaccatctcttgttctggaancagctccaacatcggaagtaattatgtatattggtatcagcagctcccaggaaccggccccaaacagctcatctataggaataatcagccgccctcgagggtccctgaccgattctctggctaccaagtctggccacctcacgcctccctggcccatcgagtcgggccttccgggccgaggatggaggtctggatttattactgtgcagcagtgggatgacagcctggagtcggtcggtggttcgggcggagggaccagcgtggaccgtcgtaggcagacccg

SEQ ID NO: 271774 - DNA, 612 bp, Homo sapiens
  misc_feature: GYAE6OF01CUNRO.13.39.D06.1.454.CMB.1.raw
  modified_base (240)..(240): a, c, t, g, unknown or other
  misc_feature (240)..(240): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctccctggctgtgtctcgtgggcgagagggccaccatcaactgacaagtccagccagagttgtttanacagctaccaaactaataagaacttacttagcttaggtaccagcaagaaccaggacagcctctaagctgctacatttacgnggcatactagtccgggaattcccgggtccctggaaccgnttcgagtcggcaggtccgggtactggggactaaggtactttccacgtctacctaaccatacacgcaacgcctgaccgtacggctaggaagtgtggtacggtacttaagtttaacttacgtagttacaacgtactaaagttaatttacgtaacgttaccttacccgtccggtacggtcctacgttaccgtttaccgggacggtaacgggtaccgtaagggtcggaacgtaacgtacgaaaccgtaggttacgg

SEQ ID NO: 271775 - DNA, 671 bp, Homo sapiens
  misc_feature: GYAE6OF01DB0S6.13.39.D06.1.454.CMB.1.raw
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgcactggaaccagcagtgacagttggtagtaattataattatcgttcctccgtaggtaaccaactagtcgacccgaggaccaaaccgacccccaaactctaatttaactttttacgtgttacagtcacgtccggccttcgtacgggtttactaacgttcgtttctcgtcgtctacctaagtctacggacaaccgaccggtccctcccgtacgaccctacttaccgtcgtcgggtcctaccgaggtacctaggaacgacggtaggtactagtactttacgttacgtcgctacgtctactaatacgtaacgaacggccgactacgtccttactttacctttacgtaccgtttaccgggttacgggtacgggttaccgggtaacccgtaacgggttcccgtaacccggttaccttaacggtacccgaaccggtaccccgtaacggtaaaccccccg

SEQ ID NO: 271776 - DNA, 618 bp, Homo sapiens
  misc_feature: GYAE6OF01CQY2A.13.39.D06.1.454.CMB.1.raw
  modified_base (244)..(244): a, c, t, g, unknown or other
  misc_feature (244)..(244): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggacgggccaccatcaactgcaagtccagccagtagttgttttanacagctaccaaacaataagaactttctagtccttaggtaccagaccaagaaaaccaggaaccacgtaccctacctaagcctcgccttactatttacgcgggtacatcgtaacgtaccgggtaacgtcccggggtccctaggaccgtattcgagtcggcgacggtcggtctagggacagtacttccactctccacatcagctacgccgtgcgaggcctagacgtgtaggtgtacgtagttttacgtacgtgtactagtacttaaattagttataacgtacctaccgtaccgtagtaccttccgtacggtttcgggacgggtaacgggtaaccgtaagggtacggaacgtaacgtaaccgtaaacggtacgtcggg

SEQ ID NO: 271777 - DNA, 506 bp, Homo sapiens
  misc_feature: GYAE6OF01B06RW.13.39.D06.1.454.CMB.1.raw
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggacagataaatatacttcctggtatcagcagaagtcaggccagtcccctgtgctggtcatcatcaagatgccaagcggccctgagggatccctgagcgattctctggctccaactctgggaactcacgccactctgaccatcacgccggacccaggctagtggatgagctgactattacgtgtcgaggcgtagggacagcgagctaccgcgcccgatacgtcgttcgttacggaacgttcgggaccgaaggtccgtacccgtccgtaaacgg

SEQ ID NO: 271778 - DNA, 600 bp, Homo sapiens
  misc_feature: GYAE6OF01AK1DN.13.39.D06.1.454.CMB.1.raw
  modified_base (240)..(240): a, c, t, g, unknown or other
  misc_feature (240)..(240): n is a, c, g, or t
  modified_base (330)..(330): a, c, t, g, unknown or other
  misc_feature (330)..(330): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatgacccagtctccagactccctggctgtgtctcgtgggcgagagggccaccatcaactgcaagtccagccagagttgttttanacagctaccaaacaaataagaactttcttagtcttaggtaccagacaacgaaaccaggacacgcctacctaagctcgctactatttacgngggctatctacgtaccgggtaacgtcccgggtcctcgaccgtattcgaggtcggcgacggtcgggtacgtacgggactagtacttccactctaccactactcacgacacgccgtgacgaggctagaagtgtggtagtacgttagtttactacttcgtacaagtacttaattattatacgttacctccgtaccgacgtccgtacgttaccggttacgggcggtaacgggaaccgtaagggtacggacgtaactaacgaaacggtcgtacgg

SEQ ID NO: 271779 - DNA, 520 bp, Homo sapiens
  misc_feature: GYAE6OF01CJI0N.13.39.D06.1.454.CMB.1.raw
  modified_base (405)..(405): a, c, t, g, unknown or other
  misc_feature (405)..(405): n is a, c, g, or t
  modified_base (462)..(462): a, c, t, g, unknown or other
  misc_feature (462)..(462): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatactctgtatcagcagaatcaggccagtccctgtgctggtcatctatcaagatgaccaagcgccctgacgggactcccgtgacgcgtacttcgtctcggcctccaactcgtagggacctcgacgcccactctacgacccatcgacgccggaccaggctagnggatggagtctgacttagtcgtgtcgaggtcgtagggacagcagcacgtcgcccgtntacgtcgtaccgttacggacgtcgggaaccctagggtacccaccggttccgtaaacgg

SEQ ID NO: 271780 - DNA, 541 bp, Homo sapiens
  misc_feature: GYAE6OF01BIT82.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccgggtcctgaccgattcagtggcagcgggtctgggacagtatttcactctcaccatcagcagcctgcaggctgaacgatgtggctagtttattactgtactagactaattattataacgtacctcctaccgtaggtcttctacgtttccgggcggtaacgggaacccgaagggtacggaacgtaataaccgaaaacggtaacgttacggg

SEQ ID NO: 271781 - DNA, 518 bp, Homo sapiens
  misc_feature: GYAE6OF01AOAUQ.13.39.D06.1.454.CMB.1.raw
  modified_base (409)..(409): a, c, t, g, unknown or other
  misc_feature (409)..(409): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgaccaagccggccctcgagggactcccgtgagcgattctcgtcggcctccaactcgtaggacctcacgccactctcgaccatcacggccggacccaggcctagcgagnggagcgtgaacttattacgtgtacgaggtcgtaggacacgcagcacgtcgcccgtgtacgtcgtacgttacggaacgtacgggtaccaacggtccaccgtccgtaaacg

SEQ ID NO: 271782 - DNA, 381 bp, Homo sapiens
  misc_feature: GYAE6OF01CBNGT.13.39.D06.1.454.CMB.1.raw
  modified_base (367)..(381): a, c, t, g, unknown or other
  misc_feature (367)..(381): n is a, c, g, or t
tcagtcacgtactacacgaccggtgctcgatttagtgacatctcgcagttctttgggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataaatggcagataaatatacttcctggtatcagcagagtcaggccagtcccctgtgctggtcatctatcaagatgccaagccggcctcgacgggatcccgtgacggcgggcgtcggacgaacgggcgacgagtagcannnnnnnnnnnnnnn

SEQ ID NO: 271783 - DNA, 621 bp, Homo sapiens
  misc_feature: GYAE6OF01BTJD1.13.39.D06.1.454.CMB.1.raw
  modified_base (240)..(240): a, c, t, g, unknown or other
  misc_feature (240)..(240): n is a, c, g, or t
tcagtcacgtactacacgaccggtgctcgatttagtgacatctcgcagttctttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgaggagggccacatcaactgcaagtccagccagagttgttttanacagctaccaacaaataagtaacttcttagcttagtaccagcaagaaaccaggacacgcctacctaagctgctctatttacgtggactactctacgtccgggaacgtcccggggtcctaggaccgtattccgaggtcggcgagggtccgggttcgtaggggacctaggttactttaccgtaccttcctcctacactacacgcacgtcctcggacgaggaccgtagaagagttggtacggtacgttaacgttttacttacgtagtactagtactaattagttaacgtattaccgtcccgtaccgacggtccttacgtacggtttccgggacgggtaacgggtaccgtaagggtacggtaagacgtaacgtaaacggtaacgg

SEQ ID NO: 271784 - DNA, 571 bp, Homo sapiens
  misc_feature: GYAE6OF01EZ4QW.13.39.D06.1.454.CMB.1.raw
  modified_base (275)..(275): a, c, t, g, unknown or other
  misc_feature (275)..(275): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccatcctccctgtctgcatctgtaggagacagagtcaccatcacttgccggcaagtcagggcattagaatgtatttaggctggtatcagcaagaaaccgagggaacncccctaagctactgatctagtggtgcatacctaaggtttaaaaggtcgggtacccagtacgtaaggttcgaggcggcgtaggtggatcgtcggacacgagtacttctacttcctacacctatcagcgacgccctgcagtaccgtagtaagttatttcgactaactttattacgtctactaacaagtactacgtaataattacgtccgtagggtaccgttccggaccgtaaacgggaccgtaagggtacgaaatacgaaacgtacgtaggtacgacgtacgaccacctgtcgttacg

SEQ ID NO: 271785 - DNA, 569 bp, Homo sapiens
  misc_feature: GYAE6OF01ADIHC.13.39.D06.1.454.CMB.1.raw
  modified_base (237)..(237): a, c, t, g, unknown or other
  misc_feature (237)..(237): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtatctctgggcgagagggccaccatcaactgcaagtccagccagagtgttttanacagctaccaacaataagaacttcttagcttggtaccagcagaaaccaggacagcctctaagctgctcatttacgtgggcatctagtccgggaacgtccgggtccctgaccgtattcgagtggacaggtcgggtctgggactaggtactttcgactctacaccatcagcacgcctgcgaggctagaagagtggtggtactagtttacttacgttgtactagtactaaattagttaatacgtacctccgtacccgaggtccttacgtacgtttacgggcgggaacgggaaccgtaagggtacggaacgaacttacgaaaacggtacgtacggg

SEQ ID NO: 271786 - DNA, 601 bp, Homo sapiens
  misc_feature: GYAE6OF01D23CY.13.39.D06.1.454.CMB.1.raw
  modified_base (238)..(238): a, c, t, g, unknown or other
  misc_feature (238)..(238): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccacatcaactgcaagtccagccagtagttgttttanacagcctaccaacaataagaacttcttagcttggtacctagcagaaaccaggacagcctactaacgctgcctcatttactgggcatctagtccgggaacgtcccgggtcctcgaccgtattcgagtcggacaggtcgggtcgtgggacagtatttcactcgtcacctatcagcacgtcctcgcgaggctagaagtagtgtggtctagtttacttacgtcgtactaggtaccttaagttaattacgtagttacccgttacccgttaccggaacggttccgtacccgttaccgtttccgggaccggggtaacgggaaccgtaacgggtacggtacggaaagtaccgaaaacggtacgttacgggg

SEQ ID NO: 271787 - DNA, 630 bp, Homo sapiens
  misc_feature: GYAE6OF01EP620.13.39.D06.1.454.CMB.1.raw
  modified_base (236)..(236): a, c, t, g, unknown or other
  misc_feature (236)..(236): n is a, c, g, or t
  modified_base (350)..(350): a, c, t, g, unknown or other
  misc_feature (350)..(350): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccaggacagcctcctaagctgctcatttactgggcatctatccgggaatccgggtccctgaccgtattanggtcgacgcggtcggtcggtaggacgagttacgttcgtactccgtaccacctactacgacacgacgtccgtcggacgacggtaccgtaagaaggtagttggtacggtaccgttaagttttaacttaacggttcgtacgtacgtaacttaaagttaattaacgttacgttaccttaccccgtacggaccggtaccttccgttaccgttcgggaaccggggtaaccggtaaacggtaacgggtcgtaacgtaacgtaaaccgaaaccgtaaggttaccgggg

SEQ ID NO: 271788 - DNA, 667 bp, Homo sapiens
  misc_feature: GYAE6OF01C1XK1.13.39.D06.1.454.CMB.1.raw
  modified_base (244)..(244): a, c, t, g, unknown or other
  misc_feature (244)..(244): n is a, c, g, or t
  modified_base (337)..(337): a, c, t, g, unknown or other
  misc_feature (337)..(337): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccacggggacatcgtgatcgacccagtctccagacctccctggctgtgtctcgtgggcgagacgggccaccatcaactgcaagtccagccagtagttgttttanacagactaccaaacaaataacgtaactttcttagcttaggtaccagacaagaaaccaggacacgacctacgaagctgcttactaatttaccgngggactaacttcgtaacgtacccggggtaacgttccccggggtaccctacggaacccgttattccggaaggtcgggacgacgggtcgggtaccgtaggggactaggtactttaccgactcctacacctatcagtacacgccgtagcgtacggctaggaacgtgtcgtggtacttaggtttaatacgtgtacgaagtactaaattacgttaagttactaaccgtcccgtaaccggagttacccgtacgttaccggttcgggaaccggggaacggtaacccggttaaagggtcggtaaagtaaccgtaaccggtaaaacggtcggttacggg

SEQ ID NO: 271789 - DNA, 517 bp, Homo sapiens
  misc_feature: GYAE6OF01BFSKG.13.39.D06.1.454.CMB.1.raw
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
tcagtcacgtactacacgaccggtgctcgatttagtgacatctcgcagttctttgggggctacaacaggcaggcagggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagcctccaacaataagaacttctagcttggtaccagcagaaaccaggacagcctctaagctgctcatttactgggcatctagtccgggaatcccgggtccctgaccgnttcagtggcaggcgggtcngggacagtacttcactctcaccatcagcagcctgcaggctaggaagagtgtggcttaagtttacttactgtacagtactaattattatacgtactcctcgaggtctctacgttcggcggtaggaccgaggtgagatacgaaacgtgtcgg

SEQ ID NO: 271790 - DNA, 671 bp, Homo sapiens
  misc_feature: GYAE6OF01BC4PU.13.39.D06.1.454.CMB.1.raw
  modified_base (229)..(229): a, c, t, g, unknown or other
  misc_feature (229)..(229): n is a, c, g, or t
  modified_base (414)..(414): a, c, t, g, unknown or other
  misc_feature (414)..(414): n is a, c, g, or t
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatcctctgcactggaaccngcagtgatgtggtggttataactatgtctcctggtaccaacaacacccaggcaaacgcccccaaaatcatcgtatttatgtatgtcagtaagccggccctcgacggggtccctgactcgtccttctcctgcccttccaaacgtcctacggaccaaccgtaccggtccctacccgtacggaacccncttcctacgtcgggtacctccgaggtccgtagaaggtacgtgtacgtcgtagtacgtttaacttacgtacgtccgttacgtaccttaccgtaattacgtaccggaccgtaacgggtacctaacggtaccccgtttaaaccgtaccggtttaccgttaaccgtttaccgggttcccgggggaaccgggggtaacggggtaaacccctaacgggtacccgtaccgggttaccccgtacccggttaacgggtaacccccg

SEQ ID NO: 271791 - DNA, 531 bp, Homo sapiens
  misc_feature: GYAE6OF01DQQLZ.13.39.D06.1.454.CMB.1.raw
  modified_base (237)..(237): a, c, t, g, unknown or other
  misc_feature (237)..(237): n is a, c, g, or t
  modified_base (365)..(365): a, c, t, g, unknown or other
  misc_feature (365)..(365): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgtttanacagctccaacaataagaacttcttagcttggtaccagcagaaaccaggacagcctcctaagctgctcatttactgggcatctagtccgggaatccgggtccctgaccgattcagtggcaggcgggtntgggacagatttcactctcaccatcagcagcctgcaggctagaagatgtggctagtttattactgtcagtactaattattatagtaccttcctccgaggtcctacgtacgtttcgggcggtaacggggaccaagggttggaacgtataaccgaaacgtagtacggg

SEQ ID NO: 271792 - DNA, 702 bp, Homo sapiens
  misc_feature: GYAE6OF01DDVLF.13.39.D06.1.454.CMB.1.raw
  modified_base (240)..(240): a, c, t, g, unknown or other
  misc_feature (240)..(240): n is a, c, g, or t
  modified_base (324)..(324): a, c, t, g, unknown or other
  misc_feature (324)..(324): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatcaactgcaagtccagccagagtgttttanacagcctaccaacaataagtaacttcttagtcttggtaccagcaagaaaccaggacacgcctacctaagctagctactattacngggcagtctagtccgggaactccgggtacctgaccgtattcgaggtcggacgtagggtccgggtcgtgggaactaggttactttccgaaccttccgtacctaacccgtacttaccgaacgtccgaaccgtcccgtacgtaccggtaacggtaccgttaaggaacgttacgttggttacgggtaacccgttaaggttttaacctttaacggttcggtaaccgtaacggtacttaaaggtttaactttaacgttaacgtttacccgtaccccgttacggtaccggttccgtttacgtaccggtttcgggaacccggggtaacggggtaacccgtaaacggggttacggaaacgtacgtaaaccgaaaaccggttaacggg

SEQ ID NO: 271793 - DNA, 554 bp, Homo sapiens
  misc_feature: GYAE6OF01E359V.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactggcatctatccggaagtcccgggtccctgaccgtattcagtcggcgagcgggtctgggacagatttcactctacaccatcagcagcctgcagctagagatggtgctagtttatactgtacagtactaattattatacgttactcccgttaccgaggtcctacgtacgtttaccggggcgggtaacggggaacccgtaaacggggttcggaaagtaataaccgaaaaccggtaaccgtacggg

SEQ ID NO: 271794 - DNA, 556 bp, Homo sapiens
  misc_feature: GYAE6OF01A8JW1.13.39.D06.1.454.CMB.1.raw
  modified_base (321)..(321): a, c, t, g, unknown or other
  misc_feature (321)..(321): n is a, c, g, or t
tcagtcacgtactacacgaccggtgctcgatttagtgacatctcgcagttctttgggggctacaacaggcaggcaggggcagcaatatggtgttgcagacccaggtcttcatttctctgttgctctggatctctggtgcccacggggacatcgtgatgacccagtctccagactccctggctgtgtctctgggcgagagggccaccatcaactgcaagtccagccagtagtgttttatacagctccaaacaataagaacttcttagtcttaggtaccagacaacgaaaccaggacacgcctacctaagctgctcatttacnggcatctacgtccggtaacgtccgggtcctgaccgattcgagtgcaggcgggtgtggacagtacttcactctacaccatacacgccacgcctggcacggctacggaagtagtcggtaggtaccttagtttacgttacgtcgtacgtagtactaattattagtactaccgtccgtaccgagtcgtccgtagttcggcgggacgaccgtaggtcggagaactcgaaacgtacgtagg

SEQ ID NO: 271795 - DNA, 753 bp, Homo sapiens
  misc_feature: GYAE6OF01CIGC1.13.39.D06.1.454.CMB.1.raw
  modified_base (245)..(245): a, c, t, g, unknown or other
  misc_feature (245)..(245): n is a, c, g, or t
tcagtcacgtactacacgaccggtgctcgatttagtgacatctcgcagttctttgggggctacaacaggcaggcagggcagcaagatggtgttgcagacccaggtcttcatttctctgttgctctggatctctggtcgcccacggggacatcgtgatcgacccagtcctccagcctcccgtggctgtgtctcgtgggccgaggacgggccaccatcaactgacaagtccagccagagttgtttanacagcctacaacaataagtacttacttagtcttaggtaccagaccgaagaaaaccacggaacacgtaccctacctaaagtccttcgacctttactaacttttacgtcgggactacgttacgttaacggttacccgggggtaaccgttccccggggttaccctacgggtaaacccgttacgtttaccgaacgggttcggaccggaacgggtccggggtttacgtacgggggtaacctaacggtttaccttttaccgaaccgttacccgtttcccaaaccccgtagttacccgacgaccgtaacgcccgttgaccgtacgggtactaggaaagttcgttacggtagtaccttaaggttttacctacgttggtacctaagtaccttaaataagtttactaaccggttactcccgtaccggtagtacccgttaccgtaccggtttccgggacccgggaaacgggtaccgtaaaggggtcgaacgttacgtaaacgaaaccggtaggtaccgg

SEQ ID NO: 271796 - DNA, 639 bp, Homo sapiens
  misc_feature: GYAE6OF01BHDQO.13.39.D06.1.454.CMB.1.raw
  modified_base (325)..(325): a, c, t, g, unknown or other
  misc_feature (325)..(325): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatcaactgcaagtccagccagagttgttttatacagctaccaaacaataagaacttcttagcttggtaccagacaacgaaaccaggacacgcctactaagctgctactagtttacgnggactatcgtacgtacccgggtaactcccgggtacctaggacccgtattcgaggttcggaccgtacgggtccgggttacgtacgggaactacggttactttccgacttccgtaccactagtaccgacgccgacgtcctaggacgaggtacgtagaagtagtcggtacgtacgttagtttactacgtagtactaagtacttaacttagttacgtaccgttccgtccgtacggtacgtcgtaccgttacggttacgggacgggtaacggtaaccggtaagggtacgtaacgtaacgtaacgtaaacggtgtacggg

SEQ ID NO: 271797 - DNA, 708 bp, Homo sapiens
  misc_feature: GYAE6OF01DSMJN.13.39.D06.1.454.CMB.1.raw
  modified_base (179)..(179): a, c, t, g, unknown or other
  misc_feature (179)..(179): n is a, c, g, or t
  modified_base (322)..(322): a, c, t, g, unknown or other
  misc_feature (322)..(322): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggactccgtggcctctatgagctgactcacgcccacctnagtcgtccgtcgtccccgaggacagacagccagcatcacctgctacgtaggaaataagtggacaagtaataaatataccttcgtaggtactcagacagacgtcaggtccacgtccgtgtcgcgtcgtacattctatacgaagngtacgaccgtaacggccggtaccagacggtacctcccgaggacgtcgtacttcgtcgtacggcctaaccgtacgtaccggtacggtacctaccgacgtcccgacttacgtaccgtacgtacaccggaccgggtaacccggaaccgacggtaccgtagggtacggacggtacggtaggaccgttagtaacgtttaacgtaccggtagggttacggaacgggttcgggtaacgggtacgaccggtaccgacggttacccggacgtaccccggtacccggttacggttaacggtttccgggttacccggttaacccgggtaaccgggtaaccggggtaaaccccgtaccgggttaacccgggtccccgggttaaccggttaacccgggg

SEQ ID NO: 271798 - DNA, 549 bp, Homo sapiens
  misc_feature: GYAE6OF01AREFH.13.39.D06.1.454.CMB.1.raw
  modified_base (237)..(237): a, c, t, g, unknown or other
  misc_feature (237)..(237): n is a, c, g, or t
  modified_base (414)..(414): a, c, t, g, unknown or other
  misc_feature (414)..(414): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatcccgggtcctgaccgattcagtggcaggcgggtcgtgggacagtatttcactctccaccatcagcacgcctgcgaggctgaagngtgtggctagtttacttactgtacagactaatattatacgttactcctccgaggtccttcgtaaccgtttcgggaccgggtacgggaacccgtaagggttcggaacgtaataacccgtaaaacgtaccgtacggg

SEQ ID NO: 271799 - DNA, 571 bp, Homo sapiens
  misc_feature: GYAE6OF01BJSYL.13.39.D06.1.454.CMB.1.raw
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
  modified_base (416)..(416): a, c, t, g, unknown or other
  misc_feature (416)..(416): n is a, c, g, or t
  modified_base (438)..(438): a, c, t, g, unknown or other
  misc_feature (438)..(438): n is a, c, g, or t
  modified_base (563)..(563): a, c, t, g, unknown or other
  misc_feature (563)..(563): n is a, c, g, or t
tcagtcacgtactacacgaccggtgctcgatttagtgacatctcgcagttcgtttgggggctacaacaggcaggcaggggcagcaagatggtgttgcagacccaggtcttcatttctctgttgctctggatctctggtgcccacggggacatcgtgatgacccagtctccagactccctggctgtgtctctgggcagagggcccacatcaactgcaagtccagccagtgttgttttanacagctcaacaataagaacttcttagcttggtaccagcaanaaaccgaggacagcctcctaagctgctctatttacgtggcaactctagtacccggggtaatcccggggtcccctaggacccgtattcgagttcggcaggcggtcgtggacaggtatttccactctacacgtactcancacgcctgaccgagctgaaagngttggtcggtactagttttacttacgtaggtacagtaactaattaagttataacgttcctccgtacgacgttcgtactacgttacgggtcggacggaaccgagggttcgacgtagaccgaaacgngttacggg

SEQ ID NO: 271800 - DNA, 786 bp, Homo sapiens
  misc_feature: GYAE6OF01DC6X7.13.39.D06.1.454.CMB.1.raw
  modified_base (356)..(356): a, c, t, g, unknown or other
  misc_feature (356)..(356): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctccctggctgtgtctcgtgggcgagacggccaccatcaactgacaagtccagccagtagttgtttacacagcctaccaaacaaataacgtaactttcttacgtcttcggtaacccaagacaaggaaaaccagggaaccacgtcccctaccgtaaagccgtacgacttacctaattttaacgnggggactaacttaccgtaacgttacccgggaacgttccccggggtacccctacgggtaacccgtacttttccgaaggttcgggaccgtaacggggtcccggggttaccgttagggggaaccctaaggttacttttacccgtaaccttccttaccaaaccctagtaccgacgaccgtaacggtcccgttacggccgaagggtaccttaaggaaacgtggtacggtcggtacgtttaacgtttttaagtaacccgttggtaccgtagtaaccttaaagtttacgtttaacgttaacggttaacccttccccgtaccggtagggtaccccttaccgtttaaccggttttaccgggaccggggttaaacggggaacccgttaaagggggtacgggtaaacgtaactaaccggtaaaaaccggtcggtttacggg

SEQ ID NO: 271801 - DNA, 578 bp, Homo sapiens
  misc_feature: GYAE6OF01DQSIJ.13.39.D06.1.454.CMB.1.raw
  modified_base (241)..(241): a, c, t, g, unknown or other
  misc_feature (241)..(241): n is a, c, g, or t
  modified_base (324)..(324): a, c, t, g, unknown or other
  misc_feature (324)..(324): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (411)..(411): a, c, t, g, unknown or other
  misc_feature (411)..(411): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatcgacccagtcctccagactccctggctgtcgtctcgtgggcgaggacggccacatcaactgcagtccagccagtagttgtttanacagcctaccaaacaataaacgtaacttcttagtcttgtaccagcaagaaaccaggacacgcctacaagctgctcatttacgnggctatctacgtcggaacgtcccgggtccngaccgtnttcgaggtcggcgaggtccggtcgtggactagtacttcactctcgacctntacagccacgcctagcgacggtctagaacgtagtcgtagtacttaagtttacttacgtcgtacagtactaagttattactacgttccctacgtccgagtcctacgttaccgttacgggaccggagggtaaccgtagggtggtaacaacgtaccgaaagtcgtacggg

SEQ ID NO: 271802 - DNA, 540 bp, Homo sapiens
  misc_feature: GYAE6OF01AT20W.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctccaacaataagaacttcttagcttggtaccagcagaaaccaggacagcctcctaagctgctcatttactgggcatctatccgggaatccgggtcctgaccgattcagtggcaggcgggtctgggacagatttcactctcaccatcagcacgcctgcaggctgaagatgtggactagtttatactgtacgagtactaattattagtacgtactccgtaccgaggtccgtcgtaccgtttcgggccgggtagggaacccgtaaggggtacggaagtactacgaaacgtacgttacggg

SEQ ID NO: 271803 - DNA, 547 bp, Homo sapiens
  misc_feature: GYAE6OF01BDS4D.13.39.D06.1.454.CMB.1.raw
  modified_base (338)..(338): a, c, t, g, unknown or other
  misc_feature (338)..(338): n is a, c, g, or t
  modified_base (418)..(418): a, c, t, g, unknown or other
  misc_feature (418)..(418): n is a, c, g, or t
  modified_base (474)..(474): a, c, t, g, unknown or other
  misc_feature (474)..(474): n is a, c, g, or t
  modified_base (493)..(493): a, c, t, g, unknown or other
  misc_feature (493)..(493): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctagaaataattggacagataaatatacttccaggtatcagcagaagtcaggccagtcccctgtcgctggtcatctaatcaagatcgaccaagccgcctacgaggactcccgagacncgtattccgcgtcgctccaaacgttctacgggaacctcgacgtaccaccgtctacgacctactacgacggccggaacccnggtactagtaggatggacgtctagaacttacgttactcgtcgagggtcgtaggacncgacagccactcgcccgtntacgtcgtaccgttacggacgtacgggaacctaggtacctaccggtccgtaacg

SEQ ID NO: 271804 - DNA, 635 bp, Homo sapiens
  misc_feature: GYAE6OF01DXQ12.13.39.D06.1.454.CMB.1.raw
  modified_base (291)..(291): a, c, t, g, unknown or other
  misc_feature (291)..(291): n is a, c, g, or t
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatcctcctgcactggaaccagcagtgatgttggtgttatactatgtctctgtaccaacacaccaggacaacgaccccaaancatagtatttatagatgtcaagtaacgccgaccctcgacgggtccctgactcgtccttctctcgcctaccaagtcgtaggaccaaccgaccggtccctcccgtacgaaccctacttccgttccggtcgggtccctcccggtacggccgttagggacggtacttacggtacggttattacgttaattttaacgtttacgtcgtaccgttcgtacttaccgtatagttcgaccgaagccgtacgtacctacgtacgttagttaacccgttaggttcccgggaacgggtaccgggaaacccgtaagggttacccgtaccgggtacccgttacccggtaagtacccgg

SEQ ID NO: 271805 - DNA, 749 bp, Homo sapiens
  misc_feature: GYAE6OF01CP3OG.13.39.D06.1.454.CMB.1.raw
  modified_base (329)..(329): a, c, t, g, unknown or other
  misc_feature (329)..(329): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatgacccagtctccagacctccctggctgtgtctcgtgggcgaggaggccaccatcaactgacaagtccagccagtagttgtttatacagctccaacaataagaactttactagtcttaggtaccagacaagaaaccaggaacagcctcctaaaggcctgctctatttaccngggctagtctaacgtccgggaacgtacccggggttcccctaggtacccgtatttaccgaaggttcggacgacgggtccggggttaccgtggggtaacctaagggtacttttaccgaaccttcccgtacctaacccgtactacgacgtaccgaacggtacccgtttggacccgtaacgggtaccgttaaccggaaaggtacgttcgggtttacggtaaccgtttaacgggtttttaactttaacccggtttgttaaccgtaagtaaccgttaaatttaacgtttaagttaacgggttaacccttacccggtacccggtaacgggttaccctcccggttaaccggttttaccggggccgggtaaccggggtaaccgtaacggggtcgtaacggtagtaaccgtaaaacgtacggttaccggg

SEQ ID NO: 271806 - DNA, 571 bp, Homo sapiens
  misc_feature: GYAE6OF01CIA7O.13.39.D06.1.454.CMB.1.raw
  modified_base (511)..(511): a, c, t, g, unknown or other
  misc_feature (511)..(511): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcactgctctaggaaataatggacagataaatatacttcctaggtatcagcagaagtcaggccagtcccctgtcgcgtggtcatctatacaagatacgaccaaaggccggaccctcgacgggactcccgtgacgtcgtacttctacgtcggacctacctaacgtcgtacgggaacctcgaacgcccactcgacgacccagtcgacggaccgggaacccaggtacctagtggtactggacgtcgtacgaacttagttaccgtgtcgaggtcggtaggactagcgagcgacgtcggcccgtnttagtcggttaccgttacggaaccgtcgggaacctagggtcccaccgttcccgtaaacgg

SEQ ID NO: 271807 - DNA, 593 bp, Homo sapiens
  misc_feature: GYAE6OF01BRM4P.13.39.D06.1.454.CMB.1.raw
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagataatatacttctgtatcagcagaagtcaggccacgtcccctgtgctggtcatctatcaagatgaccaacgccggccctacgacgggactcccgtgacgcgtacttcgtctcggcctacctaacgtcgtacgggtaacctcgacgtccctactccgtacgaccctacgtccaacgggcccgggaacccgacgggctaggtcggagtcggacggcgtacgtaactttacttacgtggtacggtagggtcgggtagggactacggcgacggcgaccgtccgcccggtattacgttcggtacgttaccgggaaccgtacgggaaccgtaacggtacccgtaccgtacccgttaaaccgg

SEQ ID NO: 271808 - DNA, 690 bp, Homo sapiens
  misc_feature: GYAE6OF01EPYNH.13.39.D06.1.454.CMB.1.raw
  modified_base (239)..(239): a, c, t, g, unknown or other
  misc_feature (239)..(239): n is a, c, g, or t
  modified_base (325)..(325): a, c, t, g, unknown or other
  misc_feature (325)..(325): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccacggggacatcgtgatgacccagtctcagactccctggctgtgtctcgtgggcgagagggccacatcaactgacaaggtccagccagagtgttttanacagctaccaaacaataacgaacttcttagcttggtaccagcaacgaaacctaggacagccttactaagctgacctcattttacgnggtacatctacgtccgggaactccggggtcctagaccgtacttcgaacgtcggcgacggaccgggtcgtacgggactaggtacttttacgacttccgttaccgaccgtactacgaacggcgaacgtccgttacggaccgacggtaccgtaaggtaacggtacgttaggtacggtaccttaagggtttaaccttacggttacggtaccgtaagtaccttaaattaacgttaacttaacggttacccttcccgttacccggtacggttacccttacggttacccggtttacggggacccgggtaacgggtaacccggtaaacgggttcgggaacggttaacaacccggtaaacgtaacggttacggg

SEQ ID NO: 271809 - DNA, 768 bp, Homo sapiens
  misc_feature: GYAE6OF01D0YLZ.13.39.D06.1.454.CMB.1.raw
  modified_base (384)..(384): a, c, t, g, unknown or other
  misc_feature (384)..(384): n is a, c, g, or t
tcagtcacgtactacacgaccggtgctcgatttagtgacatctcgcagttctttgggggctacaacaggcaggcaggggcagcaagatggtgttgcagaccccaggtcttcattttctcttgtgctctggatctctggtcgcccgacgggacatcgtgatcgacccagtctccagactcccgtgctgtgtctcgtgggcgaggacgggccaccatacaacgtcgacaacgtccagacctaggtagtttagtttaatacgtacgtacctaccaaactaaacgtaaacgtaacctttcgttacgtacgttacggtaaccacgaccaaacggaaaccgaggtaaccacgtacccttaccgtaagcctacgccttactacgtttacgnggacctagttaccgtacgtaccggtaccggtcccgggtcctacgaacccgtgtcgtagtcggcgtacggtcgggtaccgtagggaactacggttaacttccgtacctccgttaccaacgtcgacgacgtcctacgggtccctggaccgtacggtacgtacgaaagttggtacgggttacggtaacttttacgggtttttaactaccggttacgtaacgaaaccgttattaaaagtttaccgtttaagtaacccgttaccgttaccccgttaggtacccggtttaccgtaccggtttacccggtacgggggtaaacccgggacgtaaaacccgggtaggggtactaaacggaaccggttaaaaccggtaaaccgtacgggttcgg

SEQ ID NO: 271810 - DNA, 573 bp, Homo sapiens
  misc_feature: GYAE6OF01DB9KF.13.39.D06.1.454.CMB.1.raw
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatcgacccagtctccagactcctggctgtgtctcgtgggcgagacgggccacatcaactgacaagtccagccagagttgtttanacngctaccaacaataacgaacttctagtcttaggtaccagacaacgaaaccaggacacgcctaccgtaagctagtcctatatttacgtgggactatctacgtccgggtaactcccgggtcctagaccgtattcgagtggcaggcgggtnggacngtactttcactctcactatcagcacgcctgcaggctgagtgtgcgactagtttactacgtgtacagactaattacttattacgtacctacctacggtaggtacctcgttaccgtttcgggacggtaacgggaaccgtaagggtacggtaacgacgtaaacgtaaaccgtagtacggg

SEQ ID NO: 271811 - DNA, 618 bp, Homo sapiens
  misc_feature: GYAE6OF01BQKSI.13.39.D06.1.454.CMB.1.raw
  modified_base (550)..(550): a, c, t, g, unknown or other
  misc_feature (550)..(550): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataaatggcagataaatatacttcctggtatcagcagaagtcaggccagtcccctgtgctggtcatctatcaagatgaccaagccggacctcgagggactcccgtagacgcgtatttctcgtcggtcctccctaaaccgtcgtacgggtaacctccaacggtcccaacgttcctacggaacccaacgttccgaacgggcccggggaaccccgagggtacctaagtacgggactcgggaacgggtcctaggtaaccttaactttacgtgtaccgagggtccggttagggacgtaacggccgaagcccgaccgtcggaccccgtnttaacgtgttacccgttacggtaaaccggtcgggaacccaagggttcccaacccggttccgtaaacgg

SEQ ID NO: 271812 - DNA, 516 bp, Homo sapiens
  misc_feature: GYAE6OF01EBSUY.13.39.D06.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttacnggcatctatccggaatccgggtcctgacgattcagtggcagcgggtctgggacagtactttcactctaccaccatcagcagcctgcaggctagaagatgtggctagtttattacgtgtcagtactaattattatagtacctcctccgagtctcgtactttcgggcggacggaccgaagggtggaagatacgaaagtacgtacgg

SEQ ID NO: 271813 - DNA, 696 bp, Homo sapiens
  misc_feature: GYAE6OF01BOOI7.13.39.D06.1.454.CMB.1.raw
tcagtcacgtactacacgaccggtgctcgatttagtgacatctcgcagttcgtttggggggggtctcaggaggcagcactctcgggacgtctccaccatggcctgggctctgctcctcctcagcctcctcactcagggcacgaggatccgtgggctcagtctcgccctgactcagcctcgctcagtcgtccggtctcgtggacagtcagtcacctatctcctgcactggaaccagcagtgtatgtggtagttataactatgtctacgtagtaccaactaaccaccaggaccaaaccgaccccaaaatccatcgtaatttatacgtatcgtactaggtaacggccgtcccgtacgtaccggggtccctaggacttccgcctttcgtcgttacgtccctacgtaacgttccgtacggaaccctaccgtacccggtaccctacccgttcgaacccgttacgttcccgtaacgttcggacccgttacggacggttacgttacgggacggtacttacgggtacgtttcgtaacgttacgttttaacctttacggtcgttaaccgtttcgaccgtttacctaaggttaccttacggaccgtaccgggttcaacggttcccttaaacgtccgtaggtttacccgtaggtcccgggtacggaacggtaccaacggttcgtaccgtaccgtacgttcggaacccg

SEQ ID NO: 271814 - DNA, 509 bp, Homo sapiens
  misc_feature: GYAE6OF01CE5FR.13.39.D06.1.454.CMB.1.raw
  modified_base (238)..(238): a, c, t, g, unknown or other
  misc_feature (238)..(238): n is a, c, g, or t
  modified_base (477)..(477): a, c, t, g, unknown or other
  misc_feature (477)..(477): n is a, c, g, or t
  modified_base (494)..(494): a, c, t, g, unknown or other
  misc_feature (494)..(494): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagtagtgtttanacagctccaacaataagaacttcttagcttggtaccagcagaaaccaggacagcctactaagctgctcatttactgggcatctatccgggaatccgggtcctgaccgattcgagtcggcaggcgggtctgggacagtatttcactctcaccatcagcacgcctgcagctagacgagtgtggactagttattactgtcagtactaatattatagtacctcctcgagtcctctgttacggnggacggtacgaggtganacacgaaagtgtcgg

SEQ ID NO: 271815 - DNA, 707 bp, Homo sapiens
  misc_feature: GYAE6OF01CTW2R.13.39.D06.1.454.CMB.1.raw
  modified_base (138)..(138): a, c, t, g, unknown or other
  misc_feature (138)..(138): n is a, c, g, or t
  modified_base (242)..(242): a, c, t, g, unknown or other
  misc_feature (242)..(242): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtncccaggggacatcgtgatgacccagtctccagactccctggctgtgtctctgggcgagagggcccaccatcaactgacaagtccagtccaggtagttgttttanacagcttccaaacaataaacgaacttcttagtacttggtaccagtacagaaaccaggtaccacgtcctacctaagctgcctactagtttactgggactacgttcctaagtcccgggaagttcccggggtaccttacggacccgtaattccgaagtcgggctacggcgggttactggggacctagtatttcgactccgtacacctatccgacgcgacgtcctagcgacggtctacggtaagtagtcggttaggtacgtttacggttttaacttaccgttacgttacgtaaggttacttaaaacgtttaacgtttacgttaaccggttaaccttccccgttaacccgggttaaggttacccgtttttaaccgggttccggggtaaccgggtaacggggttaacccgaaagggggttccgtaaagggtaaccgttaaacgaaacccgggtaacgttggttaacccggg

SEQ ID NO: 271816 - DNA, 558 bp, Homo sapiens
  misc_feature: GYAE6OF01A85YO.13.39.D06.1.454.CMB.1.raw
  modified_base (315)..(315): a, c, t, g, unknown or other
  misc_feature (315)..(315): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctaccaaacaataagaacttcttagcttggtaccagcagaaaccaggacagcctactaagctgctcatttacgnggcatctagtccgggaactccgggtcctgaccgtattcagtcggcaggcgggtctgggacagtactttcactctacacctatcagcagcctgcaggctagaagtatggtagtctagtttatacgtgtacgaagtctaaattattataacgttacctcccgtaccgacgtcctacgtaccgtttcgggcgggtaacgggtaaccgtaagggtacggacgtaataacgtaaacggtacgtacggg

SEQ ID NO: 271817 - DNA, 700 bp, Homo sapiens
  misc_feature: GYAE6OF01DU6SN.13.39.D06.1.454.CMB.1.raw
  modified_base (358)..(358): a, c, t, g, unknown or other
  misc_feature (358)..(358): n is a, c, g, or t
  modified_base (411)..(411): a, c, t, g, unknown or other
  misc_feature (411)..(411): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatgacccagtctccagactccctggctgtgtctcgtgggcgaggacggccaccatacaactgacaacgtccagccagtacgttagttttatacacgtcctaccaaactaataaacgtaactttcttaagtcttaggtaaccagtacaaacgaaaccgaggaacacggcccttacctaagctagaccttactaacgtttacgngggactactacgtacgtaccgggtaacgttcccgggtacctacggtacccgtntttaccggagtcgggcgtacggggtcggtcgtagggactagtactttcgaccgttccacacctatccacgtaccgtacgtccgtacggcgtacgggtactaggaacggtgtcgggtacggttactttaaggtttttactaccgttaggtactaacgtactaaatttactttaagtaccgtttaccctccggttaccggtacgttccgtttacgtaccggtttcggggaacgggtaccgggtaaacggttagggtcggaaacgtaagtaaaccggtaaagtcgttacggg

SEQ ID NO: 271818 - DNA, 546 bp, Homo sapiens
  misc_feature: GYAE6OF01C7YMQ.13.39.D06.1.454.CMB.1.raw
  modified_base (239)..(239): a, c, t, g, unknown or other
  misc_feature (239)..(239): n is a, c, g, or t
  modified_base (344)..(344): a, c, t, g, unknown or other
  misc_feature (344)..(344): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagtagtgttttaancagctaccaacaataagaacttcttagcttgtacagcagaaaccaggacagcctcctaagctgctcatttactggcatctatccgggaatccgggtcctgaccgnttcagtggcagcgggtctgggacaggactttcgaacttctcaccatcagcagcctggcaggctagaagagtgtggatacgttttattactgtacagtactaattaattatacgttacctaccgtccgaggtcctcgtacgtttccgggcgggtaacggaacccgaagggtcggtaagaacgtaacgaaacgtaagttacggg

SEQ ID NO: 271819 - DNA, 566 bp, Homo sapiens
  misc_feature: GYAE6OF01DMIUO.13.39.D06.1.454.CMB.1.raw
  modified_base (388)..(388): a, c, t, g, unknown or other
  misc_feature (388)..(388): n is a, c, g, or t
  modified_base (434)..(434): a, c, t, g, unknown or other
  misc_feature (434)..(434): n is a, c, g, or t
tcagtcacgtactacacgaccggtgctcgatttagtgacatctcgcagttctttggggggctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacgggccaccatcaactgcaagtccagccagtagttgtttatacagactaccaaacaaataagaactttcttagcttaggtaccagcaagaaaccaggacagcctacctaagctgctctatttacgtgggctactctacgtccgggtaattccgggtcctcgaccgtattcgagtggcgaggcgggtntgggacagtatttcactctcaccatcagcacgctgcaggctagagnttggagcttagtttattacgtgtactagtactaattattagtaacgttacctccgtaccggagtccgttacgtacggtttcgggacgggtacgggaccgtaagggtcggaagataacgaaagtacgtacggg

SEQ ID NO: 271820 - DNA, 562 bp, Homo sapiens
  misc_feature: GYAE6OF01DSQ23.13.39.D06.1.454.CMB.1.raw
  modified_base (321)..(321): a, c, t, g, unknown or other
  misc_feature (321)..(321): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctccctggctgtgtctcgtgggcgagagggccaccatcaactgcaagtccagccagagttgttttatacagcctaccaacaaataaagaacttcttagcttggtaccagcaagaaaccaggacagcctcctaagctgctacatttacngggctatcgtactccgggaatccggggtcctgaccgattcagtggcaggcgggtcgtgggacagtatttcacttcgcaccatcagcacnccgtgcaggctaggaagngttggtcggtactaaggttttacttactgtacgtaagactaattattataagttacctcctaccgtaggtccttacgtacggttcggcgggaacggtaccgaaagggtcggaagagtaaccgaaagtcgtaggg

SEQ ID NO: 271821 - DNA, 720 bp, Homo sapiens
  misc_feature: GYAE6OF01CMHFO.13.39.D06.1.454.CMB.1.raw
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtgcctcctatgagctgactcacgccaccctcagtcgtccgtcgtccccaggacagacagccagcatcactgctctaggaaataagttggacaagaataaatatacttcgtagtatacagacaagaacgtcgacgcccgtacgtcccgtgtcgacttggtcctaatctatacgaagacgtacgaaccgaacgcccggtacccaacggacgggtacctaccgacggtagtcgtacttccgtacgtacgtacccgttaccgtaacgtcgtacgggtaacctcccgacgacccgtaccgtacgtaaccgaaccttaacgaccggaaccgggtacccggaacccgtacgggtactaggtaacggtacgtacggaacgtaccgtaacgttaacttaacgtttcgaagggtacccggaggtaccgggtacggaacacggacctacggaccgtcccggttacgacccccggtttaaggttacccgttaccgggtttacgggttaacccgggtaaccggtttcccggggaaaacccgttaccgggttaccccttaacccgggtttaaacccctaacccgggg

SEQ ID NO: 271822 - DNA, 623 bp, Homo sapiens
  misc_feature: GYAE6OF01A4JCO.13.39.D06.1.454.CMB.1.raw
  modified_base (238)..(238): a, c, t, g, unknown or other
  misc_feature (238)..(238): n is a, c, g, or t
  modified_base (318)..(318): a, c, t, g, unknown or other
  misc_feature (318)..(318): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagtagtgttttanacagcctaccaaacaataagaacttcttagcttggtacagcagaaaccaggacagcctacctaagctgctctatttacgnggactatctaagtcccgggtaacgtcccgggtcctagaccgtattcgagtggacacggcgggtcgtgggactaggtactttcactcctacaccatcagcacgccgtgcgaggtcgtagaagtagttggtacggtacgtttaagtttaacgttacgtcgtaccgtaagtacttaaagttagtttaacgttacgttacccttaccgtaccggtaccggtcttaccgttaccggtttacggggaccgggtaacggaacccggtaagggtaggtaacgtaacgtaaccggaaaaccggtacgttacggg

SEQ ID NO: 271823 - DNA, 598 bp, Homo sapiens
  misc_feature: GYAE6OF01BTRS3.13.39.D06.1.454.CMB.1.raw
  modified_base (239)..(239): a, c, t, g, unknown or other
  misc_feature (239)..(239): n is a, c, g, or t
  modified_base (328)..(328): a, c, t, g, unknown or other
  misc_feature (328)..(328): n is a, c, g, or t
  modified_base (378)..(378): a, c, t, g, unknown or other
  misc_feature (378)..(378): n is a, c, g, or t
  modified_base (447)..(447): a, c, t, g, unknown or other
  misc_feature (447)..(447): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctccctggctgtgtctctgggcgaggagggccaccatcaactgcaagtccagccagagtgttttanacagctccaacaaataagtaacttacttagtcttgggtaccagacaagaaaccaggaacacgccctacctaagctagctactatttacngggactatctagtccgggtaacgtcccggggtcctaggaccgtattacgngtcggctagggtccgggtcgtagggactagtacttcactctacaccatcagcagcctgcgagctagaangtgtgtacgtagtttatacgtgtactagactaagttaattacttacggtaccttccggtaccgtacggtcctcgtaccggtttcggggaaccgggtaaccggggacctaaagggggtcggaacgtaagtacgaaaaccggtacgttacggg

SEQ ID NO: 271824 - DNA, 598 bp, Homo sapiens
  misc_feature: GYAE6OF01CA1F5.13.39.D06.1.454.CMB.1.raw
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (315)..(315): a, c, t, g, unknown or other
  misc_feature (315)..(315): n is a, c, g, or t
  modified_base (360)..(360): a, c, t, g, unknown or other
  misc_feature (360)..(360): n is a, c, g, or t
tcagtcacgtactacacgaccggtgctcgatttagtgacatctcgcagttctttgggggctacaacaggcaggcaggggcagcaagatggtgttgcagacccaggtcttcattttctctgttgctctggatctctggtgcccacggggacatcgtgatgacccagtctccagactccctggctgtgtctctgggcgagagggccaccatcaactgcaagtccagccagagttgtttanacagctaccaaanaataagaacttcttagcttggtaccagcagaaaccaggacagcctctaagctgctcatttacgnggcatctagtccgggaactccgggtcctgaccgattcgagtgcgnggcggtcgtggactagtactttcgactcgtccacgtatcacgcgacgtcctgacgacggacgtagaagtaggtcgtacggtactttagtttacgttacgttcgtacgaagtaacttaaatttaattaacgttaccgtaccttccggtaccgtacggcgtttaccgtaccggtttacgggacgggaacgggtaacggaagggtacggaagtaacctaaccggtaaaacgtggttacggg

SEQ ID NO: 271825 - DNA, 689 bp, Homo sapiens
  misc_feature: GYAE6OF01CT1ZB.13.39.D06.1.454.CMB.1.raw
tcagtcacgtactacacgaccggtgctcgatttagtgacatctcgcagttctttgggggctgggcctcaggaagcagcatcggaggtgcctcagccatggcatggatccctctcttcctcggcgtccttgcttactgcacgaggatccgtggccctcctatgagctgactcacgcccaccctgagtcgtccgtcgtccccaggacagacacgcagcaatccacctgctacgtaggtaaaattaagttggaactaaggaattaaaattaccttacgttacgttggtaactcgaagacaaaggtaacgtccgaacgggaccctaccggtccccttaggtcgtcgttacggtactaactacttaatacgaaagtactaccggaccaaccgggtccgaccctagacgggtacctcccgtaggacgtacgtacttccgtcgtaccggtaccttacctaacgtccgtacgggaacctaccgaccgtccgtactcgaccgtacgtacgacgtaaccgggaccggacccgaggtcgtacgtaggactcggtacggtacgtacgtaacttacgttacggtacgtcggacgggtacggtaggacgacgacggtacgtaccgccgacgtacccgtagttaccgtcgttaccggtacggtacgtacccgggaactaccggtacctaccggtacgtaaccgg

SEQ ID NO: 271826 - DNA, 566 bp, Homo sapiens
  misc_feature: GYAE6OF01DRZVQ.13.39.D06.1.454.CMB.1.raw
  modified_base (258)..(258): a, c, t, g, unknown or other
  misc_feature (258)..(258): n is a, c, g, or t
  modified_base (324)..(324): a, c, t, g, unknown or other
  misc_feature (324)..(324): n is a, c, g, or t
  modified_base (419)..(419): a, c, t, g, unknown or other
  misc_feature (419)..(419): n is a, c, g, or t
  modified_base (455)..(455): a, c, t, g, unknown or other
  misc_feature (455)..(455): n is a, c, g, or t
  modified_base (500)..(500): a, c, t, g, unknown or other
  misc_feature (500)..(500): n is a, c, g, or t
tcagtcacgtactacacgaccggtgctcgatttagtgacatctcgcagttctttggggctgggcctcaggaagcagcatcggaggtgcctcagccatggcatggatcccctctcttcctcggcgtccttgcttactgcacaggatccgtggcctcctatgagctgactcagcccaccctcagtcgtccgtcgtccccaggacagacagccagcatcactgctctagaataagtgacagataatatacttctgtatcancagaagtcacgccactccctggtgcgtaggtcatacgtatacaagtatcgaccgaagcccgtaccncgaggacctccgtgacgcgtacttcgtcgtcgcctaccgtatccgtacgaactcacgtcctactccgtacgacctagaccgacggcccgggaccnggtctagtcgatcggacgtctagtaacttacttcgngttacgagggtcgtaggacaacggtacgccacgtccgtaccggtntacgttcggttacgtacccgtaaggaccgggtacgtacgtaccgtaacccgttacgtcgtaaccgg

SEQ ID NO: 271827 - DNA, 641 bp, Homo sapiens
  misc_feature: GYAE6OF01BRSUN.13.39.D06.1.454.CMB.1.raw
  modified_base (314)..(314): a, c, t, g, unknown or other
  misc_feature (314)..(314): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagtagtgttttatacagcctaccaacaataagaacttcttagcttggtaccagcagaaaccaggacagcctctaagctgctcatttacngggcatctagtccggaattcccgggcctgacccgattcaggtcggcaggcgggtctgggacagtatttcactctcaccatcagcacgcctgcgacggtctacgaagtatggttacggcttaaggttttaacttaacgtggttaccgtaaggtactaaagttattaattaaccggttaacccttcccgttaccggacgggttacccttaccgttaacccggtttttccggggacccggggttaaaccgggggtaaacccggtaaaacggggttacggggtaaacggtaaccggttaacccgtaaaaaccgggtaacggtttaacgggg

SEQ ID NO: 271828 - DNA, 577 bp, Homo sapiens
  misc_feature: GYAE6OF01BQ4SO.13.39.D06.1.454.CMB.1.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagacgggccaccatcaactgcaagtccagccagagttgttttanacagctccaacaataagaacttctagcttggtaccagcagaaaccaggacagcctacaagctgctcatttacnggcatctacgtccgggaactccgggtccctgacccgtattcgagtcggcgacggcgggtctgggacagatttcactcctcaccactcacgacacgtcctagccaggcctagaagtatggtcggtcgtagtttacttactcggtacgacgtactaattattagttacgtaccgttcccgtaccgaggtccttacgtaccgtttcggggaccgggagggaaccccgtaagggtacgggaagtaacgaccggtaaaaagtcgttcggg

SEQ ID NO: 271829 - DNA, 677 bp, Homo sapiens
  misc_feature: GYAE6OF01EJ7XG.13.39.D06.1.454.CMB.1.raw
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctggctcagtctgccctgactcagcctcgctcagtgtccgggtctcctggacagtcagtcaccatctcctgcactggaaccagcagtgatgtgtgtataactatgtctctgtaccaacaacaccagacaacgccccaaaatcaatgatttatgatgtacaagtaacgccggccctacgacggggtccctgtactccgtcttcgtctcgtccctaccaagtcctacggaccaaccgtaccggtccctacccgtcgtaccctacgtccgttaccgtcgggtccctaccgaaggtcctagggtaacgggtatacggtacgttccttaggttaacttttacgttaacgtgtaccgttacggtaccttacgtaagttcgtacggaccgttaacgggccgtaacggtaccctaacgtaacccgtttagttaacccgtttacgggttacccggggaaccggggtaaaccggggtaaacccgtaacggttacccgttaacccgggttaaccccggttaccgtaccgggttaaaccccgg

SEQ ID NO: 271830 - DNA, 631 bp, Homo sapiens
  misc_feature: GYAE6OF01DO89W.13.39.D06.1.454.CMB.1.raw
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
tcagtcacgtactacacgaccggtgctcgatttagtgacatctcgcagttctttgggggcttacaacaggcaggcaggggcagcaagtactggtgttgcagacccaggtcttcatttctctgttgctctggatctctggtgcccaggggtacgatcgtgatcgacccagtctccgaggactcccgtggctgtgttctcgttgggcgaggacggccacatcaactgacaagtccagccagtattgtttanacngctacctaanaaataaggtaacttcttacgcttacggtacgacgacgaagaaccaggacgacgaccgtactaagctgcctctatttacgnggctatctacgtcggaacgtccggtaccngtacgtnttcgngtgctagcgggtctaggactagtactttcgtacttcctctaaccgtacgtacgacgtccaacgtaccgtcggacgaacggtaccgtaaggaagttacggtcggtaggtaccttagttttaaacttcgtacggttactagtaacctaatttacgttacttacggtaccctcgtaccggtacgtcttaccgttaggttcgggacgggtaacggaccgtagggtagacgtagtaaaccgtaagtagtacgg

SEQ ID NO: 271831 - DNA, 576 bp, Homo sapiens
  misc_feature: GYAE6OF01BNVSV.13.39.D06.1.454.CMB.1.raw
  modified_base (179)..(179): a, c, t, g, unknown or other
  misc_feature (179)..(179): n is a, c, g, or t
  modified_base (258)..(258): a, c, t, g, unknown or other
  misc_feature (258)..(258): n is a, c, g, or t
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagcccaccctnagtgtccgtgtccccaggacagacagccagcatccacctgctctaggaaataattggacagataatatacttctggtancagcagaatcacggccacgtcccctgtcgcgtggtcatctatacaagntacgaccaaggccgcctcgaggactcccgngagctatctcgtacgttaccacgtcgtagggactacgacgtccacgtcgtacgactacgtaacgaccggtactacgacggtctagtggacgtgacggtctagtacttacgtacgtagtccggtagggtcggtaggacgtacgaccgaactaccgtaggttggttacggtcggttagggacccgggtaacggacgtacggtcgtaccggaacccgttgtaccggtagacccggtaacccgg

SEQ ID NO: 271832 - DNA, 688 bp, Homo sapiens
  misc_feature: GYAE6OF01BB2H9.13.39.D06.1.454.CMB.1.raw
  modified_base (244)..(244): a, c, t, g, unknown or other
  misc_feature (244)..(244): n is a, c, g, or t
  modified_base (338)..(338): a, c, t, g, unknown or other
  misc_feature (338)..(338): n is a, c, g, or t
tcagtcacgtactacacgaccggtgctcgatttagtgacatctcgcagttctttgggggctacaacaggcaggcaggggcagcaagatggtgttgcaggacccaggtcttcatttctctgttgctctggatctctggtcgcccgacggggacatcgtgatcgacccagtctccagacctccctggctgtgtctcgtgggcgagacgggccacatcaactgacaagtccagccagagttgtttanacagctaccaaacaataagtaaccttcgttagtcgttacggtaccagtcaagaaaccgaggacacgtccctacgtaagctgctactatttacgnggactatcgtacgtaccgggtaacgttcccgggtcctaggacccgtacttcgacggtcggacgtacggcgggtcgtagggactaggtactttacactcctacctacctactacaacggtaccgacgtacccgtcgaccgtaggtaccgttaagaaacgtacgttggtacgggtacctttaaggttttaacctttaccggtgtaccgtaaggtaacttaagttaacgtttaagtaaccggttaccttacccggtacggtacggttaccgtaccgtttacgggttaccgggacggggtaacgaacccggtaagggtacggtaacaacggtaaccgtaaaggtcgttacgggg

SEQ ID NO: 271833 - DNA, 866 bp, Homo sapiens
  misc_feature: GYAE6OF01B46S2.13.39.D06.1.454.CMB.1.raw
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggactccgtggcctctatgagctgactcacgcccacctcagtcgtccgtcgcccgaggacagacagccagcatcactgctacgtagaaataagtggacaagtaataaatactacttcgtaggtactacgagacaaggaacgtccgaacggaccctacggttccccttggtcgtccgtggtacctaagttcctaatacgaaagtactaccggaaccgaacggccggtacctacggaacgggtacctcccggagtacgaccgtattccgtggttcgacccttaacgacgttacggaacggtacctaccgacgtaccctaccgtactaaccgaaccgtcgtaccggacccgggtaccgggaaccccgtagggtaaccttacggtaacgggtacgtacggggaacgggtcctttaagggttaacccgttaacggttaccggttaacggggtaaccccgggtaagggggtaaccggggttaacccgggaaccgtaaccggggtaacccgaacccgggtaccccggttaaacccgggttccccgggtaacccccggtttaagggttttaacccgggtttccccgggttttaaacccccgggggtttaaaccgggggtttaaaaacccccgggggtacccgggggttaaaaccccccgggtttaaaccccggggtttaaccccgggtttaaacccccccccgggggttaaaacgttttaaaacccccgggggg

SEQ ID NO: 271834 - DNA, 628 bp, Homo sapiens
  misc_feature: GYAE6OF01BNIO1.13.39.D06.1.454.CMB.1.raw
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcactgctctggaaataatggcagataaatatacttcctggtatcagcagaagtcaggccagtcccctgtgctggtcatctatcaagatgccaagccggccctacgacgggtactcccgtgagtcggtatttcgtcgtcggcctacctaacgtccgtacgggaacctcgacgccctacgtacctcgacccacgtccgacgggtacccgggaccccgtaagggtccttaagtcgggatacgggacggtacgttacgtaaccttaacgttacgttcggtaccgtaggggtccggtaacgggtaccacggacgacggaccgtaccgtaccgggccccgttacgtaacggttcggttaccgttaccgggaaccggttcgggaacccgtaagggttcccgaacccggttaccgtaaacccgg

SEQ ID NO: 271835 - DNA, 620 bp, Homo sapiens
  misc_feature: GYAE6OF01A8GOW.13.39.D06.1.454.CMB.1.raw
  modified_base (246)..(246): a, c, t, g, unknown or other
  misc_feature (246)..(246): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (375)..(375): a, c, t, g, unknown or other
  misc_feature (375)..(375): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacgggcccaccatccaactgacaacgtccagccagtagttgttttanacagcctaccaaacaataagaacttcttaagcttggaccagacagaaaccaggacacgcctactaagctgctntatttacgnggacatctagtccggaagtcccgggtcctgaccgtattcagtcggcnggtcgggtcgtgggacagtactttcactctaccgacatccagcgacgtaccgtgaccgaggtacgtagtaacgtagttcgtaggtacgttaagtttacgtttaacgtcgtacgtaggtactaaattaacgttacttaacggttacccttaccgttccggtaacggttccgtacgttaccgttaccgggaccgggacgggtaaacgtacgggtacggtacgtaagtacgaaaacggtcgtaacggg

SEQ ID NO: 271836 - DNA, 577 bp, Homo sapiens
  misc_feature: GYAE6OF01DIK5E.13.39.D06.1.454.CMB.1.raw
  modified_base (231)..(231): a, c, t, g, unknown or other
  misc_feature (231)..(231): n is a, c, g, or t
  modified_base (378)..(378): a, c, t, g, unknown or other
  misc_feature (378)..(378): n is a, c, g, or t
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgccactggaaccngcagtgatgttggtgttatactatgtctctgtaccaacaacaccaggacaaacgaccccaaatcatgtatttatgatgtacaagtacgccgcctcgacgggtcctgactcgcttctctcgcctcgagtctgacacgaccgtcctccncgacctactcgtcgtcggtcctccgaggtcctagggacggtacgtacggtacgtttacgtagtttaactttaacgtttacgtcgtaccgttacgtaccttatacgttagtcgtaccgaggtccacgtacctactacgttaccgtagttacggttcggacggtacggacgacgtacgtacggacccgtcgtacggtaccg

SEQ ID NO: 271837 - DNA, 634 bp, Homo sapiens
  misc_feature: GYAE6OF01EY801.13.39.D06.1.454.CMB.1.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
  modified_base (445)..(445): a, c, t, g, unknown or other
  misc_feature (445)..(445): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatcgacccagtctccagactccctggctgtgtctctgggcgaggngggccacatcaactgcaagtccagccagagttgttttatacgagcctaccaaacaataagaacttctagcttcggtaccaggcaagaaaccnggacagcctacctaagctgctctatttacgngggcatcgtacgtccgggaacttcccgggcctgaccgtntcgaggtcggctagggtcggtctcgggactagtactttcactctacactatcacgacacgtccgtgcgtaggctaggaacgtntcgggtagtcgtttaagttttacgttacgtacgtcgtaacggtacttaaattaacttaacgttacgttacccgttacccgtaccggtaccggttccgttacccggttacggtttaccggggacgggtaaaccgggaaccggtaagggttacgggaacttaacgtaaccgtaaaacgggtacgttacggg

SEQ ID NO: 271838 - DNA, 739 bp, Homo sapiens
  misc_feature: GYAE6OF01CPUJY.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtagatcgacccagtcctccagtcctcccgtggctgtcgtcgtcgtgggacgaggacggccacatacaactgacgaacgtccacgactagtagtttagtttacacgacgacctaaccaaactaaataacgtactttacgtacgtcttacggtaacagacaacgaaaccgagaccacgtacctacaagtccgtctacctactagtttacggcggtactacgtacgtaccggtacgggtacgtcccgggtaccaggtacctagtcgaggtcgcgtaggtccgggtacgacggtactaacggtctttcgaccttacctccgaacctagtaccgtaacgctaacgtccgtacggacgtacggtactaaggaacgtacgttacgggacgttaacgtttacggtttaactacgttacgtaacgtaacgtaacttaaagtttaccgttacgttacgttaaccccgtacggttaccggtaccggttccgttaaccgggttaccggtttaccgggggaaaccgggtaacgggtaaccggtaaacgggggtagtaaaacccgtacggtttaaaaccaaacgggttcggtaaacgg

SEQ ID NO: 271839 - DNA, 657 bp, Homo sapiens
  misc_feature: GYAE6OF01CU3XV.13.39.D06.1.454.CMB.1.raw
  modified_base (257)..(257): a, c, t, g, unknown or other
  misc_feature (257)..(257): n is a, c, g, or t
  modified_base (482)..(482): a, c, t, g, unknown or other
  misc_feature (482)..(482): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatcgacccagtctccagacctcccgtgctgtcgtctcgtgggacgaggacggccactatacaacgtgacgaacgtccagaccaggtagtttacgtttaanacgacgacctaacaaaactaaactaacgtactttacttagtccgtacgtaccagacaacgaaaccgaggaaccacgtaccctacgacgcctcgaccttatacgtttacgcggactacttcgaacggtcggaacggtccggtcctacggactatcgacgcggacgcgggtcggtcgaggactaacgttcttactactctacactacacagcctacgtccgagacgngacgtagaagtgtcgtgtaacgttagttactacgttgaactataacttaattaagttactaccgtaccgttaccgacggacgtacgttaccgtacgggttacggggaaccgggttaacgggaacggtacgggaacgggtaactaaccgggtaacgaaaacggttccggttacggg

SEQ ID NO: 271840 - DNA, 909 bp, Homo sapiens
  misc_feature: GYAE6OF01E5XH4.13.39.D06.1.454.CMB.1.raw
tcagtcacgtactacacgaccggtgctcgatttagtgacatctcgcagttctttgggggctacaacaggcaggcaggggcagcaagatggtgttgcagacccaggttcttctatttctctgttgctctggtactctcgtggtcgcccgacgggacagtcgtagacgtcgaccctagtcctaccgacgtccttccgtggtcgttggttcgtccgttcggcgggacggacggtaccggaccaaccgtataacgaacgtcgtacacgtccgtacgaccgtagttagtttacgtttaacacgaccgtacctaaaccaaaagttaaacgttaacgttaccgtttacgttacggtacgttaaccggaaaccgacgaaccgaaaaccggaaaccgtacggtaaccgtaccgttaccttaacgtaacgtcttaccggttacttacggtttaaccgtttacggcggacttacgtacgtaccgggtaccgtaccgggtcccgtacgacgtaacggtcgtacggtacggtacggacggttaggggttacccgttacggtaaccgggtacttaaaccgggtttactttaaccccgtaccgtaacccttaaccggaaccgttaccggaacccgttaaagggtaacccggtaaaccgggtttaaccggtaaaccggtttaaccgttaacggttttaacccgttttacgtttacccggttttaacccttttaacgtttttcccggttaccgttaacgttaacccgttaacgggttaacgtttcggggttaacccgttaaccgttacccgtttaaccggtaccgtttaaccgggtacggaacccgggtaaacggaccgtacggttacgacggtaacctacggacgtacggtaacgtcggttacggacgttcaccgtccgttacgg

SEQ ID NO: 271841 - DNA, 611 bp, Homo sapiens
  misc_feature: GYAE6OF01BCFGD.13.39.D06.1.454.CMB.1.raw
  modified_base (238)..(238): a, c, t, g, unknown or other
  misc_feature (238)..(238): n is a, c, g, or t
  modified_base (318)..(318): a, c, t, g, unknown or other
  misc_feature (318)..(318): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctccaaacaataagtaacttcttagcttggtaccagacagaaaccaggacagcctactaagctgctctatttacgnggactatactagtccgggaacgtcccggggtccctacggaccgtattcgaggtcggcgaggtcgggtcgtgggactaggtactttcacgtcctaccgaactactacaacgccagccctgacgtaggcgtagaagtcgtaggtacgtcgttaagtttacttacgtgtaccaagtactaaattattaataccgtaccttaccgtccggaacggttccgttaccgtaccggtttccgggacgggaacgggtaacccgaagggtacggacgtaagtaaccgaaacggtacgtacggg

SEQ ID NO: 271842 - DNA, 567 bp, Homo sapiens
  misc_feature: GYAE6OF01BQT3J.13.39.D06.1.454.CMB.1.raw
  modified_base (523)..(523): a, c, t, g, unknown or other
  misc_feature (523)..(523): n is a, c, g, or t
tcagtcacgtactacacgaccggtgctcgatttagtgacatctcgcagttctttgggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcacctgctctggaaataatggcagataaatatacttctgtatcagcagagtcaggccagtccctgtcgctggtcatctatacaagactcgaccgaacggccggaccctcgacgggtactcccgtagacgtcgtacttcgtcgtacggtcctaccgaacttcgtacgggaaccttcgacgtccctactccgtacgaccctacgtaccgaacggtcccgggaacccagggtacctagtcggacgtcggacggtctacgtacttacgttacgtcgtacgagggtcggtaggacacgcacgcacgtcgcccgtntacgtcgtacgtacggacgtcggacaaggtccaccgtcgtaacg

SEQ ID NO: 271843 - DNA, 631 bp, Homo sapiens
  misc_feature: GYAE6OF01CUJHQ.13.39.D06.1.454.CMB.1.raw
  modified_base (242)..(242): a, c, t, g, unknown or other
  misc_feature (242)..(242): n is a, c, g, or t
  modified_base (331)..(331): a, c, t, g, unknown or other
  misc_feature (331)..(331): n is a, c, g, or t
  modified_base (372)..(372): a, c, t, g, unknown or other
  misc_feature (372)..(372): n is a, c, g, or t
tcagtcacgtactacacgaccggtgctcgatttagtgacatctcgcagttctttgggggctacaacaggcaggcaggggcagcaagatggtgttgcagacccaggtcttcattttctctgttgctctggatctctggtgcccacggggacatcgtgatgacccagtctccagactccctggctgtgtctctgggcgagacgggccaccatccaactgcaagtccagccagtagttgttttanacagctaccaaacaataacgtaacttcttagtcttaggtaccagacagaaaccaggacacgcctacctaagctgcctactatttaccgngggctatctagtaccgggaacgtcccgggtccctcgaccgnttaccgagttcggcctaggtccgggttactagggacctaggtactttcaccgtcctacaccactcaacgcacgtcctgcgacggtcgtacggaagtacgtggtacggtacttaagtttacttacgtagtacgtagtactaaatttacttattaacgtaccttccctacggtacgtccgtaccgttcggtttaccgggacgggtacgggaacccggtaaagggttacggaacgtaagtaaccgaaacggtacgttacggg

SEQ ID NO: 271844 - DNA, 759 bp, Homo sapiens
  misc_feature: GYAE6OF01DMVO2.13.39.D06.1.454.CMB.1.raw
  modified_base (247)..(247): a, c, t, g, unknown or other
  misc_feature (247)..(247): n is a, c, g, or t
tcagtcacgtactacacgaccggtgctcgatttagtgacatctcgcagttctttgggggcgtacaacaggcaggcgaggggcaggcaagatggtgttgcagacccaggtcttcatttctctgttgctctggatctctggtgcccgacggggacatcgtgatgacccagtctccagctccctggctgtgtctctgggcgagagggcctaccatcgaactgacaagtccagccagtagttgtttatacngctccaacaataagaacttcttagcttggtaccagcaagaaaccgtaggacacgcctcctaagctgctctatttactgggactatcgtacgtccggggtaacgttcccggggtacccctgggtaacccgtagtttaccgaggttacgggacgtacgggtccggggttcgttcgggggaactaggtaacgttttcgaaccctttccgttaccaacccgtagtccgaagtccgaacgtccgttacgaccgtaggtaccgttaggaaacggtgttaaccgggtgggtaacctttaaggtttttaacgtttaccgtgggtttaaccctaggttaacctaaacttttaagtttacgttaacgggtttacccctttaccccggtaccgggttaccggtacccgtttacccggttaacccgggtttttacggggaacccgggggtaaaccgggtaaccgtaaacgggggttacggaacgggttacgtttaaacccgaaaaccgggttacggttacgggg

SEQ ID NO: 271845 - DNA, 722 bp, Homo sapiens
  misc_feature: GYAE6OF01DLHKG.13.39.D06.1.454.CMB.1.raw
tcagtcacgtactacacgaccggtgctcgatttagtgacatctcgcagttctttgggggctacaacaggcaggcaggggcagcaagagtggtgttgcagacccaggtcttcatttctctgttgctctggatctcgtggtcgccccgacggggacatcgtgatcgacccagtctccagacctcctggctgtgtctcgtggcgagacggccaccatcaacgtgacaagtccagcctagagttgtttataccagctaccaactaataagaactttcttaacgcttggtaccacgacaacgaaacctaggaccacgcctacctaaagctacgaccttctaacgtttacgtgggacctacgtcctacggttacccgggtaacttcccggggttaccctagggtaacccgtacttcgaacgggtcggacggtaggtccggggtacttaggggaacctagtactttccgaccttactccaaccgtactacgacgcgtacgccgttacgacgtacggacctttaaggaaggttaccgtggttaccgggtacttaacggtttttaactaccgttacggtactacggtaacttaaacgtttacgtttaagtaaccgttacccgttacccgtaccgggtacggtcccttacggttacccggtttccgggaacggggtaaccggtaccgtaaggggtaccggaataacggtaaccgaaacgggttcgtaacggg

SEQ ID NO: 271846 - DNA, 635 bp, Homo sapiens
  misc_feature: GYAE6OF01B1ZIJ.13.39.D06.1.454.CMB.1.raw
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (291)..(291): a, c, t, g, unknown or other
  misc_feature (291)..(291): n is a, c, g, or t
  modified_base (322)..(322): a, c, t, g, unknown or other
  misc_feature (322)..(322): n is a, c, g, or t
  modified_base (362)..(362): a, c, t, g, unknown or other
  misc_feature (362)..(362): n is a, c, g, or t
  modified_base (439)..(439): a, c, t, g, unknown or other
  misc_feature (439)..(439): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatgacccagtctccagactccctggctgtgtctcgtgggcgaggacgggccacatacaactgacaagtccagccagtagttgtttanacagctaccaaanaataacgtaacttntagcttgaccagcaagaaccnggatacgcctacctaagctgctactattcgnggctatctagtccgggtaagtcccgggtcctcgtaccgtntcgagtggcaggtcggtcgtggactagtacttcgactctacgacatcacgtcacgtctaggacgaggtcaggaacgngttcggtaggtactttaggtttaacgtacgttcgtaagtacgtaacttaagtttaagttaccttaacgtacccgttcccggttaccggtaacggtccgttacgttacccgggtttccggggtaacccgggtaaaggggaacccttaagggggtccgtaacggtaaacctaacggttaaaacccggtaggttacggg

SEQ ID NO: 271847 - DNA, 782 bp, Homo sapiens
  misc_feature: GYAE6OF01BT92C.13.39.D06.1.454.CMB.1.raw
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagaccagccagcactccacctggccttacgtaggaaaacttaagttcggactaagtaattaaaactactttaacctttccgtaggttaactacgaacggacctaaaggtaacgtccgaaccgggacccttaccggttcccccgttgggttcggtccgttacgggttaccaacgtttcttaaacgttaacgaaacggtacttcccggaacccgaacgggtccccggtaccccgtaaggacggggtacccttaccccggaggtacggtaccggttaactttcccgtaccgtcgggtaccccttaaccgtaacgttcggtaacgggtaaccctacgacgtccctacgttcgacgaccctacggtccgacgggtacccgggaacccgtaggtactacggtacgggacggttacgtacgggtctaacggttaaccttacgtttaccggtcgggtaccgggaagggtccgggtacgggaaccgtacggccgaacggtcccgaaccggtcccgtaccgttactcgggttacgtacgggttaccggacggttaccgggactaacggtacccgtaccgtacgtaaccgg

SEQ ID NO: 271848 - DNA, 799 bp, Homo sapiens
  misc_feature: GYAE6OF01DND0C.13.39.D06.1.454.CMB.1.raw
  modified_base (609)..(609): a, c, t, g, unknown or other
  misc_feature (609)..(609): n is a, c, g, or t
tcagtcacgtactacacgaccggtgctcgatttagtgacatctcgcagttctttggggggctacaacaggcaggcaggggcagcaagatggtgttgcagacccaggtcttcatttctctgttgctctggactcctcgtgccgccggacggactacgtcgtagtacgtaccgacctacgtcctacgactcccgttccgtcgtcgttggttcgttccgtcggggacgggacgggacggggacccggacccaactactaaccgtaacgtcgaaccgtaccgaccgaccgacgtaggttacggttttatttaacgacgtaccgtacctaaaaccgaaaacttaagttaaaccgttaccttttacgtacggttacccggttaacggtaacaacggaacgaaaacccgaaaccggacgaaccgtacccgtaccctttaaacgcgtcgtaccttcttacttttaacgtagggccgtacttaccgtaacgtacccggggtaacggtaccccggggttccccggtacgacggtaacccgttgttacgggacggtccgggacggtaccggggttccgggtagacggaactttagtttcctactccctacaccgtatacncgtacgacctcgtcgactcggagtacgtaggtatgggttcgaagtttcgtttattacgtccgatacgtaataattaactttaagtcgtaacccttcccggtacgtcggtaccttaccgtacggtttaccgggacggggacggaccggtaagtacgggtaacgtaaccaacggtaaactacggtggtaccg

SEQ ID NO: 271849 - DNA, 727 bp, Homo sapiens
  misc_feature: GYAE6OF01DDF0U.13.39.D06.1.454.CMB.1.raw
  modified_base (378)..(378): a, c, t, g, unknown or other
  misc_feature (378)..(378): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgaggggacatcgtgatcgaccctagtctccaagcctccctggctgtgtctcgtggcgaggacggccaaccatccaactgaccaagtccaagccgagtagtttagttttaacaacgacgtacctaaccaaaactaaaataaagtaacctttcttaagtcttacggtaaccagaccgaaacgaaaaccgaggactacgcccttacgtaaacgccttagaccttactaacgttttacgngggacctagttccgtaacgtaccggggtaaccgttcccgggtaccctaggtaacccgtattaccggaaggtccgggacgtacggggtccgggtagtacgggaactaggttaactttccacgttccacaccgtaactcgacgctacgcncgacgnggtactaggaacgtagtcggtagtacttaaggtttactacgtcgtacgaataacgtaaattagtttaacgtaccgttaacttccccgacggtaaccgtccgttaaccggttaacgggttccgggaaacgggtaaacgggtaacccgttaaagggcgggtaaactaccgttaaacggaaaacccgtaggttccggg

SEQ ID NO: 271850 - DNA, 555 bp, Homo sapiens
  misc_feature: GYAE6OF01CYAAK.13.39.D06.1.454.CMB.1.raw
  modified_base (230)..(230): a, c, t, g, unknown or other
  misc_feature (230)..(230): n is a, c, g, or t
  modified_base (271)..(271): a, c, t, g, unknown or other
  misc_feature (271)..(271): n is a, c, g, or t
  modified_base (309)..(309): a, c, t, g, unknown or other
  misc_feature (309)..(309): n is a, c, g, or t
  modified_base (368)..(368): a, c, t, g, unknown or other
  misc_feature (368)..(368): n is a, c, g, or t
  modified_base (468)..(468): a, c, t, g, unknown or other
  misc_feature (468)..(468): n is a, c, g, or t
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgcactggaaccngcagtgatgttggtgttataactatgtctcctagtaccaanaaccaccagaccaaacgaccccaaaatcatgtatttangatgtcagtaacgccggcctgacggtcctgacgtcgtcttctctcgcctacctacgtcncggacaacgccgtccctccctacgacctactctccgtcggtcctaccgacggtctcggaggatagacgtctagtatttacttactgctcgtctactattntcgcgtaggctagcctatactcggtacttacggttaccgggacgggaacggacgtaacgtccgtacgtacccgtcgtacggtaccgg

SEQ ID NO: 271851 - DNA, 754 bp, Homo sapiens
  misc_feature: GYAE6OF01DU9IU.13.39.D06.1.454.CMB.1.raw
  modified_base (505)..(505): a, c, t, g, unknown or other
  misc_feature (505)..(505): n is a, c, g, or t
tcagtcacgtactacacgaccggtgctcgatttagtgacatctcgcagtttcgtttgggggggggggtctcaggaggcagcactctcgggacgtctccaccatggcctgggctctgctcctcctcacgccctcctcactcgagggccaacgaggatccgtgggctcagtctcgccctgactcacgcctcgctcgaggtcgtccgggtctccgtaggactagtcacgtaccacctacttccgtccgtacgtacgtaaccgtaacgggaaccctaggtaccgtaaggtgtaacgtttgggtttacgggttaacggtttaactaaacgtttagtcggttacccttccggtaaccggtaacccaaaaccgtaaaccgacccggaacggtaaacccaaaacccgaacccctaaaagtctaagttacggttaactttagtaagtacttaaggtacgtaacggtaaccggccggccgttacgggaccgggttctaggtactccgtacgttcncgtacgtacctacggtatccggacgtaccaaccggaccgtccctacgtacgaccgtacgttcgtaccggtacggtcccgtacggacggtctaaggtacgacgtcgtacgtcgttaagtacgtttactcgccgtactacgtacttaacgtattacgtacgacggtacgactcggacttaaccgtagtacggttaactacgggtccggacgggtaacgacctaggtcccacggtacgtacgttcgaaccgg

SEQ ID NO: 271852 - DNA, 740 bp, Homo sapiens
  misc_feature: GYAE6OF01B8PL4.13.39.D06.1.454.CMB.1.raw
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (328)..(328): a, c, t, g, unknown or other
  misc_feature (328)..(328): n is a, c, g, or t
tcagtcacgtactacacgaccggtgctcgatttagtgacatctcgcagttctttggggagcttcagctgtggtagagaagacaggattcaggacaatctccagcatggccggcttccctctcctcctcacccctcctcactcactgtgcagggtcctgggcccagtctgtgctgactcacgcccaccctcgagccgtcgtcggggacccccgggnaggacggtccaccatcgtcttgtctaggacncagcctaccaacagtacggtaaagttaattagtgtaattagttggtatcgagcagcctacccgaggaacccgacccctaaancgcctacgacttacaagtaagaataactcgacggcccgtcccgtacgggacggttcccacgtacccggtactttccgtcgtccggtaccctaaccgtaacgttccgtccggtaccctacccgttacgcccgtaccccgttcccggacggtaccgtaacttccgggtaacgggttccgggtaaccccgttcccggggttaccgaacgggtaggtaccgtaacgggtcttaaggttaactttacggttaccgtcgtacgactaacggtacttaacgtaccttagtaccgtacccgtaccgttaggttacgtacggggtttcgttacgggggtcgtaccggggacgggttaaaccgaccggaagttccggtacccgggttacccgttacgaccgggtcgaaccccgggtacccgg

SEQ ID NO: 271853 - DNA, 517 bp, Homo sapiens
  misc_feature: GYAE6OF01BTV52.13.39.D06.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcaagaaaccaggacagccctcctaagctgctcatttacngggcatctatccggaatccgggtccctgaccgattcagtggcaggcgggtcgtgggacagtacttcactctcaccatcacgcagccctgcgnggctagaagngtgtggctagtttattacgtgtananactaagtattatactacttcctaccgagctactcgttcggcggtaggaccgtaggtagagatacgaacgtaacg

SEQ ID NO: 271854 - DNA, 704 bp, Homo sapiens
  misc_feature: GYAE6OF01CVAKL.13.39.D06.1.454.CMB.1.raw
  modified_base (262)..(262): a, c, t, g, unknown or other
  misc_feature (262)..(262): n is a, c, g, or t
  modified_base (682)..(682): a, c, t, g, unknown or other
  misc_feature (682)..(682): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctcgtggtcgcccgacggggacatcgtgatcgacccagtcctccagtacctcccgtggcttgtcgtctcgtgggacgaggacgggcccaaccatccaacgtcgactaacgtccagccagtagttacgtttanacacgcctaccaaactaaagttaacgtaactttacgtagtccttacggtaccagacaacgaaaccaggacgacgtaccctacctaacgctcgaccttactaacttttacggcggtactacgtaccgtaaccggtaccgggtaaccgttcccggggtacccctacggtaccgtacttcgtaaggtcggaccggtacgggccgggtttacgacgggtactacgttactttaccctaccgttccaccgtacctaagtccgaacgtccaacggtcccgtgtaccgacggtccgtaagaacggtgtacggtagttacgttaatttacgtacgtcgtacagtacgtaattactagttaaccgttcctaccgtcgtacggaccgttcgtacggttacgggacggacggtaacggtagggtacgtaanaacgtaacgaacggtcgtacgg

SEQ ID NO: 271855 - DNA, 628 bp, Homo sapiens
  misc_feature: GYAE6OF01BI8AI.13.39.D06.1.454.CMB.1.raw
  modified_base (232)..(232): a, c, t, g, unknown or other
  misc_feature (232)..(232): n is a, c, g, or t
  modified_base (405)..(405): a, c, t, g, unknown or other
  misc_feature (405)..(405): n is a, c, g, or t
tcagtcacgtactacacgaccggtgctcgatttagtgacatctcgcagttctttgggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcagtcaccatctcctgcactcggaaccngcagtgagttgtggtgttataactatgtctcctagtaccaacaacacccagaccaaacgaccccaaaatcatagtatttatgatgtacagtaagccggaccctcgacggggtccctgactcgtccttctctcgtccctacctaagtcctggaccaacgaccggcccttcccgngaacctactccgtcgtcggcctaccgacggtcgtgaggtatgtagtccgtagttactttaacttcggtctcgtcgtaccttacctaagttacgtggaccgacgggtacctaacgaccgttaacaccccggtttaggttaacgtaccgggttccggggaccggggaaaccgtaacccggtaaggtccccgtacggtaaccccggtaccggtccggtaaccccgg

SEQ ID NO: 271856 - DNA, 789 bp, Homo sapiens
  misc_feature: GYAE6OF01DGV0D.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatcgacccagtctccagcctcccgtggctgtgtctcgtgggcgaggacggccacatccaactgacaacgtccagccgaggtagtttagttttaacacacgtacctaaccaaactaaagttaacgttaaaccttttcgttaacgttaccgtttacggtaacccaaggtaaccgaaacgaaaacccgagggaaccaccggtaccccttaaccgtaaagccttacgaccttactaacgttttacgcgggacctaacgttccgtaccggtaccgggtaaccggttccccggggtaccctacggacccgttatttaccgagggttcggacgtacggggtccggggttacgtcggggaaacttagttaccgtttcctaaccttcccgtaaccctaacccgtaacttccgaacggtaccctacggtacccgttacggaccggaacggtcgtaacggaaggtacgttcggacgttagttaacgttttatacgttacgtactaacgttattaagttacttaacgttaccgtacccgttaccgtacgggtacgttccgttacgtacccgggtttacgggacccgggtaaacgggtaccggaagggttacggaacgtacgtaaacgtaaaccggtcgttacggg

SEQ ID NO: 271857 - DNA, 682 bp, Homo sapiens
  misc_feature: GYAE6OF01BCWBR.13.39.D06.1.454.CMB.1.raw
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccacggggacatcgtgatgacccagtctccagactccctggctgtgtctctgggcgagacgggccaccatcaacgtcgacaagtccagcccagagttgttttanacagctccaacaataagaacttctagcttggaccagcagaaaccaggacacgccctctaagctgctctagttacngggcatctagtccgggaatcccgggtcctcgaccgagtacaggtggacgaggtcgggtctcgggacgacgtactttaccgtacgtacctaccgacctactaccgacgtcgtaacgccctagggaccgagggtcctacggtaaacggtagttcgggtacgggtacgtttaacggttttaacgttaccgttacggtcgtaacgtaccgttaagtttaacgtttacgtaacggtttacccttcccggtaccgtacgggtaccctttccgtaaccgggtttccggggacccggggttaacgggtaacccgggtaacggttacgggaacgtaaaccgtaaccggtaaaaccggttaccgttaacgggg

SEQ ID NO: 271858 - DNA, 846 bp, Homo sapiens
  misc_feature: GYAE6OF01EN224.13.39.D06.1.454.CMB.1.raw
  modified_base (181)..(181): a, c, t, g, unknown or other
  misc_feature (181)..(181): n is a, c, g, or t
tcagtcacgtactacacgaccggtgctcgatttagtgacatctcgcagttctttgggggctgggcctcaggaagcagcatcggaggtgcctcagccatggcatggatccctctcttcctcggcgtccttgcttactgcacaggatccgtggcctcctatgagctgactcacgcccaccctnagtcgtccgtcgtccccaggaccagacagccagcactccacctgctacgtaggtaaaattaagtggacaagtaattaaaagttacttaccgtttcctaggttaactacgaacgtacgaaaggtaacgtaccgaacgggtcccaacgtttcccccgttaggttcggccgttcgggttaccacgttaccgttaataaccgaagtacgttaccggacccgtaaggccccgggtacccctaggaacggggtacccttcccggtaggacgttaccgtactttcccgtcggtacggtacccctaaccccgtaaccgttaccggtaacgggtaccctaccggacccgtacccgtaccgttaccgtaccggtaaccctacgtaccgtaccgggaccccgggtacccgaccgggtacgtacgtacggtacggtacggacggtaccgtaaggttaacctttaacggtttaccggttacgggttaccggtaacggggtaccgggtacggggtacccacgggtaccgaaccggtacccgtaccggtacccggttaccccggtacggttaaccggtttccgggttaaccccggttaccgggtaaaacccggttaccggggtaaaccccggttaaaacccgggttccccggtaaccccggttaaccgttaaaccccggg

SEQ ID NO: 271859 - DNA, 787 bp, Homo sapiens
  misc_feature: GYAE6OF01DKM60.13.39.D06.1.454.CMB.1.raw
tcagtcacgtactacacgaccggtgctcgatttagtgacatctcgcagttctttgggggctacaacaggcagacaggggcagcaagatggtgttgcagacccaggtcttcatttctctgttgctctggatctcgtggtcgcccgacggggacagtcgtgatcgacccagtcctccagacctccgtgctgtgtcgtcgtgggcgaggacggaccaccataccaacgtcgactaacgtccgaacgccgaaggttacggtttagttttaacgtacgacgtacctaaccaaaactaaagttaaacgtaacctttacgttaacgttaccgttacggtaaccacgaacgaaaccggtaaaaccggaacggaacctaaccggtacccgttaaccgtaacggtccgtacgtaccttaacgttaacgtttaccgtcggacttacgttaccgttaaccggttaccgggtaaccggttccccggggttacctacggtaccgtacgttacggcggtaccggcgtaacgggtccgggttacgacggggtaacctaggttaccttacgtacccgttacctaaccgtaccgtacgtcgaacgccgtaacgtccgtacgacgtacggtacgtaaggacgtcgttaggtacgttacgttacgtttctaacgtcgtactaagtaactaagtttacgttaacgttacgttaccgtaccgtaccgtcgttaccggtacgttacgggtacgggtacgggaaccggtaacggtaggtacggacgtaaccgaaccggtagacggttacgg

SEQ ID NO: 271860 - DNA, 706 bp, Homo sapiens
  misc_feature: GYAE6OF01ASCQW.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatcgacccagtctccagactccctggctgtgtctcgtgggcgaggacgggcccaccatccaactgcaacgtccagccagtagttgttttatacagcctaccaaacaaataagaacttcttagtcttggtaaccagcaagaaaccaggacagccctacctaagcctgctctatttacgtgggctatctacgtccgggtaaccgtcccgggtcctcgaccgtatcgagtcggcaggtcgggtcgtgggactacggtaactttctactcctaccaccactaccgacgtcgacggtccttacggaccgtacgggtcgtagaaacggtagttacggtcgggttacttaacggtttttaaccgttacgtttcgtaaccgtaaggtaacctaaagttttaacttaacttaaccggtttaccccttaacccggttcccggtaaggttaccccgtttacccgtacgggttttacccgggggacggggttaacccgggaaacccggttaaggggttcggaaacggtaaccgtaacccgtaaaaacggtacgggttaccggg

SEQ ID NO: 271861 - DNA, 859 bp, Homo sapiens
  misc_feature: GYAE6OF01BFUOP.13.39.D06.1.454.CMB.1.raw
  modified_base (617)..(617): a, c, t, g, unknown or other
  misc_feature (617)..(617): n is a, c, g, or t
tcagtcacgtactacacgaccggtgctcgatttagtgacatctcgcagttcgtttgggggctacaacaggcaggcaggggcagcaagatggtgttgcagacccaggtcttctatttctcttgttgctcgtggatcttctcggtcgcccgacggggacagttcgtgactcgaccagtcctaccacgtacctcccgtggcttggtcgtcgttcgtacggggcgaacggacgggaccctaaccagttaccaacgtgacgtaacgtccgaagtcctaggtacggtttacttttaacgacgtagtaccctaactaaactaaaacgtttaacgttaaacctttccgtaaggtacctttacgggtaaccgaggtaccaaaacggtaaaccgacggaccgtaaccggtacccttaaccgaaacggtcgttacgtacctttaacgttacgtttaacgggttaccggattaaacgtaccgggttaaaaaccgggttccggggtaaaccgggttccccgggtaccgttaggtaaacccgggttaacttcgggtaaggttccggaacggtgggggttaaccggttcgggaacgggtaacttacggttacctttacgaccttccgtaacncttaacggtcgaagccgtaacgtaccgtagtacgtacggacgttaagacgtagttaacggttcggtaaacctttaggttaacctggtacgacgttaacggaacttaaaggttacttaaccgttaccgttaacggtccccggttaagtacgggttccctaacggtttaccgggttaacgggacgggtaaccgggtaacgaagggttacggtaacgtaacggaacgtttaaacggcgttacggg

SEQ ID NO: 271862 - DNA, 661 bp, Homo sapiens
  misc_feature: GYAE6OF01CJIG5.13.39.D06.1.454.CMB.1.raw
  modified_base (245)..(245): a, c, t, g, unknown or other
  misc_feature (245)..(245): n is a, c, g, or t
  modified_base (340)..(340): a, c, t, g, unknown or other
  misc_feature (340)..(340): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggacgggccaccatccaactgacaagtccagccagtagtgttttanacagctaccaaacaataagaactttcttagccttaggtaaccagacaacgaaaccgaggaccacgccctaccgtaaagctcacttctatttacgngggctatccgtaacgtccgggaacgttcccgggtacctaggaacccgtattccgaggttcggcgagggtcgggtcgtagggacctaggttacctttcgacttcctacacctataccacgtcacgcctagcgacggtctaggaatagtggtgtaaccttagttttaacgtacgttgtacgtaacgtacctaaagtttacttaagttaccgttaccttcccgtaccggtacgttcccttaccgttacggtttccggggaccgggttaagggaaacccgttaggggccgggtaaactaacgttaacgaaaaccggtgttacggg

SEQ ID NO: 271863 - DNA, 755 bp, Homo sapiens
  misc_feature: GYAE6OF01C4OIR.13.39.D06.1.454.CMB.1.raw
  modified_base (118)..(118): a, c, t, g, unknown or other
  misc_feature (118)..(118): n is a, c, g, or t
tcagtcacgtactacacgaccggtgctcgatttagtgacatctcgcagtttctttggggctgggcctcaggaagcagcatcggaggtgcctcagccatggcatggatccctctctccncggctctgcttactgcacaggactccgtggcctcctatgagctgactcacgcccacctgagtcgtccgtcgtaccccgaggacagacacgccagacactaccacctcgactacgtaaggtaaaattaagtggactaaataaataaatacttacttaccgtagtaactcgaagacgaagtaacgtccgacggtccctaccgttcccgtgtccggtacgtacggtactacttactaagtaacgtaacgtacgtaccggaaccgtaacgggccgtacccgtaggtaacgggtcccttaccgaggtacgtacgttacttcgtcgtaccgtacctacccgtaacgtcgtaacgggtacctacgaccgtacctaccgtacgtaccgtaccgtacgaccggtttttttaccgggacccggaacccggtacggtacgtacggtacggtaggtacggtacggtacgtacgttaacgttaacgttacgttacggtacggtacgggtacgggtacgggtacgtacgaccgaccgtaccgtaccgtccggtccgtacgttacggttccggttaccggttaaccgggttaaccgggtaaccggtaaccggtaaccggtaacccggtaacccgttaacccggtaaacccgg

SEQ ID NO: 271864 - DNA, 747 bp, Homo sapiens
  misc_feature: GYAE6OF01E52RE.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatcgacccagtctccacgacctccctggctgtgtcctcgtcgggcgacggacgggacccaccataccaaactcgacaacgtccgagccaaggtagttagttttacacacgcctaaccaaactaaattaacgtaacctttcgttacgcgttacggtaaccagaccgaacgaaaccgaggacctacgaccctaccgtaacgctcgtaccttcgtaacgtttaccgtcgggactacgttccgttaacggtacccgggtaaccggttcccgggtccccgtacgtaccgtacgtacgtacggtcggacgtacgggtccgggtacggtaggacgtagtactttaccacgtcctaccactacgtacgacgacgtacgtccgtgaccgacggtacgtacgaaggtacgtggttacgtacgttaacgtttcgttacgtacgtactaacgtaacttaacttaacgtttaacgtaccgtttacccgtaccgtaccggtaacgttccgttacccggtaacggtttaccggggaaccgggtaaccggggtaacggaacgggtaacgggtactaaaccggttaccggaaacgttacggtacggg

SEQ ID NO: 271865 - DNA, 610 bp, Homo sapiens
  misc_feature: GYAE6OF01CGQ05.13.39.D06.1.454.CMB.1.raw
  modified_base (242)..(242): a, c, t, g, unknown or other
  misc_feature (242)..(242): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (385)..(385): a, c, t, g, unknown or other
  misc_feature (385)..(385): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccagtcaactgcaagtccagccagtagttgttttanacagctaccaacaataagaacttctagtcttggaccagacaagaaccgaggacncgcctacctaagctgctnatttacgnggactagtctacgtccggtaacgtccgggtacctgacccgtatcgagtggcgagcgggtacgnggactagtacttcactctacacctatacacgcacgcctgaccgaggtacagaagtgtgttcggtacgttacgtttacgtacgtgtactagtaccttaattactttacgtacgttacctccgtaccggtacgtccgttaccgtaccggtttaccgggccgggttaaccgggtaccggtaacggggtacggaacgtaacggtaaccgtaaaaccggtacggttacgg

SEQ ID NO: 271866 - DNA, 696 bp, Homo sapiens
  misc_feature: GYAE6OF01DEPVL.13.39.D06.1.454.CMB.1.raw
  modified_base (247)..(247): a, c, t, g, unknown or other
  misc_feature (247)..(247): n is a, c, g, or t
  modified_base (343)..(343): a, c, t, g, unknown or other
  misc_feature (343)..(343): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatgacccagtctccagacctccctggctgtgtctcgtgggcgaggacgggcccaccatcaactgacaacgtccagccagtagttgtttanacagctaccaaacaataagaactttcttacgtcttacggtaccagacaacgaaaccgaggacacgcctaccgtaagctcgccttactattttacgnggactactcgtacgtccgggtaacgttcccgggtacctacggaaccgtattcgaggtcggctacgggtccgggttagtacgggaactacgttactttccgacttccgtacccaacctataccgacgacgacgtcctcggaccgaggtaccgtaggacgtagttcggtaggttactttagtttaacttacgtacgttacgaagtacttaagttactttactacgttaccccgttccgaccggtacgtaccgttacgttacccgggtttaccggggaaccggggtaaccgggtacggtaaacggggttacggaaacggttaaccgttaaacccggaaacggttagggttaccggg

SEQ ID NO: 271867 - DNA, 676 bp, Homo sapiens
  misc_feature: GYAE6OF01D0NP1.13.39.D06.1.454.CMB.1.raw
  modified_base (379)..(379): a, c, t, g, unknown or other
  misc_feature (379)..(379): n is a, c, g, or t
tcagtcacgtactacacgaccggtgctcgatttagtgacatctcgcagttctttggggagcttcagctgtggtagagaagacaggattcaggacaatctccagcatggccggcttccctctcctcctcacccctcctcactcactgtgcagggtcctgggcccagtctgtgctgactcagcccaccctcagcgtcgtcggggacccccgggcaggagggtccaccatctcgttgttctagaaagcagctaccaacaccggaactggtagataataaacgtcggtaccagcacgcctcccgaacgggaacccggacccccaaactcctcatctaatactaataactccacccgcctcgacggtactcccgtacgaccgtnttcctctcgtccctaccgtaacgtccgtcggcctaccctcgaccgtccccttacccgtcgggaccctacgtccgtacggttcccggtacccttacccgtacggttccgtagggacggtacgtaggacggtacttaggttaactttacgtttactcggtagtacctagtactaagttacctagtacgaccctaccgtagtagtttcggttcggtttgggtcggttcgggacgggtacgggaccctaggtccgtaccgggtacccgttacggtaggtcccgaccggacccggtacccgg

SEQ ID NO: 271868 - DNA, 749 bp, Homo sapiens
  misc_feature: GYAE6OF01E1Q4M.13.39.D06.1.454.CMB.1.raw
  modified_base (252)..(252): a, c, t, g, unknown or other
  misc_feature (252)..(252): n is a, c, g, or t
  modified_base (370)..(370): a, c, t, g, unknown or other
  misc_feature (370)..(370): n is a, c, g, or t
tcagtcacgtactacacgaccggtgctcgatttagtgacatctcgcagttctttgggggctacaacaggcaggcaggggcagcaagatggtgttgcagacccaggtcttcatttctcttgttgctctggatctctggtgcccgacggggacagtcgtgatcgacccagtctccagtcctcccgtggctgtgtctcgtggcgaggcggccacatcaactgacaacgtccacgcctagagttgtttaacacgancctaccaaataaagtaacgttaaccttacgttacgtacgtttacgaaccgagaccaacgaaaccgaggaccacggtacccctaacgtaacggtctcggtactaccgttacgtttacgnggtactacgttcgtacggtacccgggaacgttccccgggtaccgtacgaccgttacgtcgtacgggtcgaccgacgggttaccgggtcgggttaacggattaacgttacttaccgacccgtacgtaacccacctaacgtaccgacttaccgaccggcgtccggaacgtaccggtagtaggtaaacgtggttacgtacgggttattaacggtttaacctaggttccgtaagtaacgtaattaagtttaacgtaacgttaaccggttacctacccggtaccggaccgtttacccgtcgttacccgggttaacccgggaggtaacccggggtaacgacgggtacggtaaagttacccgaaaggttaaacccggtgtaccggg

SEQ ID NO: 271869 - DNA, 937 bp, Homo sapiens
  misc_feature: GYAE6OF01ASE6U.13.39.D06.1.454.CMB.1.raw
  modified_base (419)..(419): a, c, t, g, unknown or other
  misc_feature (419)..(419): n is a, c, g, or t
tcagtcacgtactacacgaccggtgctcgatttagtgacatctcgcaggttcgtttggggagctacaacaggcaggcaggggcagcaagatggtgttgcagacccaggtcttcatttctctgttgctctggatctctggtcgcccgacggggacatcgtgatcgacccagtctccacgacctccctggctgtgtctcgtgggcgaggcgggcccaccataccaacgtgacctaacgtcccgaggacccgaggtacggtttagttttaacaccgacggccgtaaccgaaactaaataaaacggtaacctttacgtttaagggtacctttggttaacccagtaccaaaggaaacccgtagggaaccgtacgtcccttaaccgtaacggtccttaggccctttaccgtaacgttttaccggnggggtaccctacgtttacctacggttaccccgggggtaaaccgttccccggggggttcccctacgggaaaccccgttacgttaccggaaacggttcggacccggtacggggttcccggggttacggttacggggaaccttaaggttaccttttccgtaacccgttacccgtttaccccgaaccctacgtttaacccgaaccggtacccggttaaccgttacccgttccgggaccggtaagggtaccccgttaaggaaacgggttacggtttacggggttagggttaacggttttaacggttttttaacgttttaacggttcggtttaaccggtaacgttaccgttaaaacgtttacgttaaacgttaccgtttacccgggttaccccgtaaccgggttacccggtccgttaacccgggttacgggttcccggggaacggggtaacccgggtaaccggttaaaccggggttacggtaaaccggtttaaccgtaacccggaaaacccggtttaaccgggg

SEQ ID NO: 271870 - DNA, 670 bp, Homo sapiens
  misc_feature: GYAE6OF01BJC0K.13.39.D06.1.454.CMB.1.raw
  modified_base (244)..(244): a, c, t, g, unknown or other
  misc_feature (244)..(244): n is a, c, g, or t
  modified_base (335)..(335): a, c, t, g, unknown or other
  misc_feature (335)..(335): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctcccgtggctgtgtctcgtgggcgagacgggccaccatcaactgacaagtccagccagtagttgttttanacagctaccaaacaaataacgtaacttcttaagcttaggtacccagaccaagaaaaccaggacacgccctacctaagcctgctctatttcnggcagtctagtaccggaacgtcccgggtcctcgaccgtattcgacggtggacgaggtcgggtctagggactaggtactttcacctctacacctatacgacaccgacgccgtcgacgtacggtacgtacgaagtacgtggtcggtacttaagtttacttacgttcgtacgtaagtacgtaaattacgttaacgttaacgtacccttcccgtaccgggtacgttaccgttcccgttaccggtttaccgggggaccggggtaaccgggtaaaccggttaaacggggttacgggaaacggtaaaccgttaaaccgaaaaacccggttcggttaacgggg

SEQ ID NO: 271871 - DNA, 789 bp, Homo sapiens
  misc_feature: GYAE6OF01DAEIT.13.39.D06.1.454.CMB.1.raw
  modified_base (384)..(384): a, c, t, g, unknown or other
  misc_feature (384)..(384): n is a, c, g, or t
tcagtcacgtactacacgaccggtgctcgatttagtgacatctcgcagttctttgggggctacaacaggcaggcaggggcagcaagatggtgttgcagacccaggtcttcatttctcttgttgctctggatctcgtggtcgcccgacggggacagttcgtgatcggacccagtctccagacctcctggctgtgtctcgtgggcgagacgggccacatcaactgacaagtccagccagtagttagttttacacacgacctacccaaacaaattaaagtaaccttttaccgttaacggtcgtttacggtaacccagtacgaaacggtaaaacccgagggaacctacgtacccttaccgtaaagcctagtacctactaatttaccgngggtactactaccgttacggtaccgggtaacgttccccggggttaccctacggtaacccggtaagtttccggaacggttcgggccgtaacggggtcccggggtttacgtacggggaacttacggtacctttttaccgaccgtttacccacccgttaactacgtaccgaacggtaccaacggtcccgtcggacgacgggtacctagtaaacgtgttaggtacgtacttacggtttacttagtacgtactaagacctttaaagttaccttagttaaccgttaccttaccggtaccggtaccgtaccgttaaccggttaccggttcccggggtaaacgggaaccggggttaaacggtaacggggttacgaaacgtaaggtaaaccccggaaaaggttaccggtacggg

SEQ ID NO: 271872 - DNA, 625 bp, Homo sapiens
  misc_feature: GYAE6OF01CIVJH.13.39.D06.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
  modified_base (578)..(578): a, c, t, g, unknown or other
  misc_feature (578)..(578): n is a, c, g, or t
tcagtcacgtactacacgaccggtgctcgatttagtgacatctcgcagttctttgggggggtctcaggaggcagcactctcgggacgtctccaccatggcctgggctctgctcctcctcagcctcctcactcagggcacaggatcctgggctcagtctgccctgactcagcctcgctcagtgtccggtctctggacngtcagtcacatctcctgcacgtgaaccngcagtgatgttggtgtataactntgtctcctaggtaccaacacaccgagacaaacgaccccaaatcatcgatttatgatcgtacagtacgccgcctcgacgggttccctagcgtacggtccttcctcgtcgccgtactaacgtcgcggtaccaacgaccggtcccctaccgtacggaccctcgttccgttccggtacggtcctacccggtaggtcccgttacgggtaggtaacgtacgggtacgttacgtcgtaacgttttaaccgttaacgtgtaccgttacggttctacgtaacttcgtacgcgtacggcgtaacgtaccacgttacgtccgttaacgtacggttccgggnggtaaccggaccgtacgtcgttacggtacccgtccgtaacggtaccg

SEQ ID NO: 271873 - DNA, 847 bp, Homo sapiens
  misc_feature: GYAE6OF01CSL37.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatcgacccagtctccagactcctggctgtgtctcgtgggcgagacggccacatcaactgacaacgtccagccaagtagtttagttttacacgacgtcctaccaaacgtaaagtaaacgtaacctttcgttaacgtcgtttacggtaacccaagtaccgaacggtaaaacccagggtaaccgaacgtaccccttaaccgtaaacgccgttacggtaccttaccgttaacgtttttaccgcggggaccttaacgttacccgttaacgggttaacccggggtaaccgtttccccgggggttacccctacgggtacccgtaacgttccggtaagggttcggaccgtaacggggcccggggtttacgtacggggaactaacggttacttttacccgaaccgttccgtaccgaacctaacgtaccgaaccgtaccacggttccctacggaccgtaacggtacgttaacggaaggttacggttacgggttcggttaaccgtttaaacgttttttaacgtacgttacggtttacaacgttacttaattaacgtttacgttaaccgtttacccgtaccgttacccgggtacgttacccgtacccggtttacgggttccggggaacccgggtacgggtaaacccggtaacggggtaacggtaacggtaaccgttaaaccgaaaccgggttacgttaccggg

SEQ ID NO: 271874 - DNA, 706 bp, Homo sapiens
  misc_feature: GYAE6OF01EAZSB.13.39.D06.1.454.CMB.1.raw
  modified_base (357)..(357): a, c, t, g, unknown or other
  misc_feature (357)..(357): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacgggacagtcgtgatcgacctagtctcagcctccgtgctgtgtctcgtgggcgaggacggccactactacaactgacacgtccacgacctagtagttagtttacacacgtcctaaccaaataaataacgtactttacgttacgtcgttacgtaaccagacaacgtaacgacgacacgtcctacgtaacgtctacgtcttacgtacgtttacgnggtactacgtacgtaccggtaccgggtaccggtcccggtacctagaccgttactcggagtcggacgtcgggtcgggttcgacgggtaactacgtactttaccgaccgttacctaccgaccgtacgtaccgtacgaccgtacgtaccgtacggccgtaacggtctaacgggatacggtagtaccggttactttacgtttacgttacgtcgtaacttaagtaacttaactttaagttacgtaccgttacccgtcgtaccggtacgttccgttaccggttaccgggtagggaccgggtaacggtacggtaagggtacggacgttaaaccgtaaccggtaagttcggtaacgg

SEQ ID NO: 271875 - DNA, 628 bp, Homo sapiens
  misc_feature: GYAE6OF01BNXEO.13.39.D06.1.454.CMB.1.raw
  modified_base (247)..(247): a, c, t, g, unknown or other
  misc_feature (247)..(247): n is a, c, g, or t
tcagtcacgtactacacgaccggtgctcgatttagtgacatctcgcagttctttgggggagctacaacaggcaggcaggggcagcaaagatggtgttgcagaccccaggtcttcatttctctgttgctctggatctctggtgcccacggggacatcgtgatgacccagtctccagactccctggctggtgtctctgggacgagacgggccaccatacaactgacaagtccagccagtagttgtttanacagtctaccaaacaaataacgtaacttacttagcttacggtaaccacgtacgaagtaaaccaggaacacgcctaccgtaagctacgctactagtttactgggactacgtactacgtacgggtacgtccgggtcctagaccgtattcgagtggactggcgggtcgtggaactagtacttcactcctacacctatcacgacacgtcctgaccaggtctaggaacgtagtcggtacgtacgtagtttaactacgtgtacacgtactaattaacttaagtaacgttacctacccgtacggtacgtccgttacgttacggttcgggaccgggaaacggtaacccgtaaggggtacggtaaagtacgtaaaccgtaaacgtaacgg

SEQ ID NO: 271876 - DNA, 721 bp, Homo sapiens
  misc_feature: GYAE6OF01A5O2A.13.39.D06.1.454.CMB.1.raw
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccgacgggacatcgtgatgacccagtctccagactccctggctgtgtctcgtgggcgaggacgggccaccatacactgacaaggtccacgccgagtacgttagttttataacgtagccgtaccaaactaaagtaaacgtaacttacttacgtcttacggtaccagacaacgtaaccagacacgccctacgtagactcgtctcttacttacgtggtactacgttacgtaacgtaccggggtaaccgttccccggggtcctacggtacccgtagtttacgcggttcggacgtacgggtcggttacggtacgggactacggttacttccgtacctactacgtacctaggtaccaggtcctaacggtcctcgggaccgtagtcgtaagaacggttgtaggtacggtagtttaacgttttaaccgttcggtacaaggttaacgtaccgttaaaagtttctttaaacgtcgttaaccctacccgtaccgggtacgtccgttaccggttaccggtttacccgggaaggggtaaccgggtaccgtaaaggggtacgaaacggttccgaaaacgtaaccggttaaacggg

SEQ ID NO: 271877 - DNA, 668 bp, Homo sapiens
  misc_feature: GYAE6OF01ERCAM.13.39.D06.1.454.CMB.1.raw
  modified_base (240)..(240): a, c, t, g, unknown or other
  misc_feature (240)..(240): n is a, c, g, or t
  modified_base (323)..(323): a, c, t, g, unknown or other
  misc_feature (323)..(323): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagttgttttanacagctccaaacaataagaacttcttagcttggtaccagcaagaaacccaggacacgcctacctaagctgctactatttacgnggctatctacgtccgggaacgttcccggggtccctggacccgtagtttccgacggaccggcgaggttggggtccgtagggacacgtaccttccaccttaccgtccaaccgtactcgaacgccgacgtcccgtagccgtacgttccgtagtaacgttcgttttacggcttacgttacctttaagtttaccgttcggttacgtaagtaccgtaagttaacgttacgtttaacgtagggtaaaccgttaacccgtttcgggaaacccgtaacggggtaacctaaccgggtaaccgttagggaacggttaaacgttaaaacgggaacgtttacgggtggtaccgtacgg

SEQ ID NO: 271878 - DNA, 615 bp, Homo sapiens
  misc_feature: GYAE6OF01BJ5H7.13.39.D06.1.454.CMB.1.raw
  modified_base (240)..(240): a, c, t, g, unknown or other
  misc_feature (240)..(240): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgacaagtccacgccagtagtgttttanacagctacaacaataagtaacttcttagcttggtaccagacaacgaaaccaggacacgtaccctacctaacggtctgcctactactttacgtcgggtactacttcgtacgtaccgggtaacgttcccggggtccctacgtaacccgtagttcgtaggtcgggacgtacgggtccggggtacgttacgggacgtagttactttccgaccgttctacctaaccgtataccacgacgacgtccgtcgacgacggtctagaagtatggtaggtacttacgtttaattacgtgtactatactaattatatacgtactcctcgagtccgtctacgtacggacggacgacgaagggtacgagtacaacgtaaccgtgtacgg

SEQ ID NO: 271879 - DNA, 681 bp, Homo sapiens
  misc_feature: GYAE6OF01ELFZ5.13.39.D06.1.454.CMB.1.raw
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (325)..(325): a, c, t, g, unknown or other
  misc_feature (325)..(325): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacgggccaccatccaacgtgacaagtccagccagtagttgttttanacagcctaccaanaataagaacttctagcttaggacagacagaaaccgagacacgcctactaagctgctactatttacgnggacatacgtagtaccgggaacgtcccgggtcctacggaccgtacgttacgaggtcggacgtacggtcgggtcgtaggtacagtactttccacgtcctaccgactacgtacacgtacacgtccgtagaccgacggtactacggtaagtcgttagggtacggtaccgttaaggttttaaccttacgttaggtaccgtaagtaaccttaaagtttaacttaacgttaaccgttaccgttacccgttaccggtaacggttccgttaaccgttaccgggtttaccggggaccggggtaaccgggtacggtaaacgggtcggtaacgtaacgtaaccggtaaaccggtcggttaaccgggg

SEQ ID NO: 271880 - DNA, 729 bp, Homo sapiens
  misc_feature: GYAE6OF01EZMGI.13.39.D06.1.454.CMB.1.raw
  modified_base (130)..(130): a, c, t, g, unknown or other
  misc_feature (130)..(130): n is a, c, g, or t
  modified_base (312)..(312): a, c, t, g, unknown or other
  misc_feature (312)..(312): n is a, c, g, or t
tcagtcacgtactacacgaccggtgctcgatttagtgacatctcgcagttctttgggggctacaacaggcaggcaggggcagcaagatggtgttgcagacccaggtcttcattttctctgttgctctggntctccgtggccacggacgatcgtgatgacccacgtctccacgactccctcggcgtcgtgtctcgtggcggagagggccgaccatcgaactgcaagtccagaccgacgtagttagttttactacacgacctaccaaacaaagttaaacgtaaccgttcctttagcgttaccggttaaccgacncgaacgtaaaacccgaacggaacgaccgtacctaccgacgtacgtacgtacgtacgtacgttacgttacgtacgtacgtacgtacgtacggtaccggtaccggtaccggtaccgtaccgtacgtacgtacgtacgtacggtacggtacggtacggtcggtacggtacgtacgtacgttacgtacctacctacctacacacgacgacgacgtaccgtacgacgacgacgtacgtacgtacgtacgtacgtacgttacgttacgttacgtacgtacgtaacgtaacgtaacttaacgttaacgttaccgttaccgtaccgtaccgtaccgtaccgttaccggtaccggttaccgggtaccgggtaacgggtaacgggtaacggtaacggtaacggtaaccgtaacggtaacggtaacgg

SEQ ID NO: 271881 - DNA, 522 bp, Homo sapiens
  misc_feature: GYAE6OF01BASUK.13.39.D06.1.454.CMB.1.raw
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagcctccaacaataagaacttcttagcttggtaccagcagaaaccaggacagcctcctaagctgctctatttactgggnactctagtacccgggaagtcccggggtcctcgaccgattcagtcggcagcgggtctggacagtatttcactcgtacacatcagcagcctgcgagntagagntggtgcctagtttattatgtctagtacaattatatacgtctcctacgagctctacgttcggacggacggaccgaggttaggaagtatacaaacgtacggtcgg

SEQ ID NO: 271882 - DNA, 849 bp, Homo sapiens
  misc_feature: GYAE6OF01BUV9Q.13.39.D06.1.454.CMB.1.raw
  modified_base (462)..(462): a, c, t, g, unknown or other
  misc_feature (462)..(462): n is a, c, g, or t
tcagtcacgtactacacgaccggtgctcgatttagtgacatctcgcagttctttgggggctacaacaggcaggcaggggcagcaagatggtgttgcagaccccaggtcttcatttctctgttgctctggatctctggtgcccacggggacatcgtgatgacccagtctccagacctccctggctgtgtctcgtgggcgaggacgggcccaccatcaacctgacaagtccagccagtagttgttttatacagcctaccaaacaataacgtaactttacgttagtacctttcggtaaccctagaccgaaacgtaaaacccgaagggaaccaacggcccgttaaccctaaaacggtccgttcggccttaacctagtttttaaccgcggggtacctaacgttaccgtaacggtcccggggtaaacgttcccccgggggttcccctaggaccccgttagtttaccgnggttacggcgtaagggtcccggggttcgtacgggggaactacggttaactttcgaaccttccgtaccctaacctacgttaccaacggtacccgtacggtacccgttaggaccgggtaacgggtaccgttaagggaaaccgttagtacgggttacgggtaaccttaaggttttttaccgtttaacggtttcggtaacgtaacgttaacttaaaccgtttaagtttaacgttaacccgttacccgttaccccggttaccggtacccggttaccgtttacccggtacccgggttttacccggggtaccgggaacccgggggtaaacggttaacggggtacggggtaaacgtaagttaaacccccgggaaaagggttaccgttaaccgggg

SEQ ID NO: 271883 - DNA, 706 bp, Homo sapiens
  misc_feature: GYAE6OF01DKFAF.13.39.D06.1.454.CMB.1.raw
  modified_base (240)..(240): a, c, t, g, unknown or other
  misc_feature (240)..(240): n is a, c, g, or t
  modified_base (325)..(325): a, c, t, g, unknown or other
  misc_feature (325)..(325): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctccctggctgtgtctcgtgggcgaggacggccaccatcaactgcaagtccagccagagttgtttanacagctaccaaacaataagaacttcttagacttaggtaccagtacaacgaaccaggacacgcctcctaagctgctctatttacgnggactatctagtccggaactcccgggtcctgaccgtattcgagtcggcaggcgggtctgggacaggtactttcactcctccaacctatacgagtcgaacgtccgtacgcgacggtcctaggaagtacgttggtacgggtacttaacggttttaacttacgttaggtaccgtaggtacctaaaagtttacgtttacgttaacgttaacccgttacccgtacccgggtaaggttacccgttaaccggttaaaccgggttttttcccgggggaaaccgggggtaaaccgggggttaaacccgggtaaaacgggggtttacggggtaaaaccggttaacggttaaaacccgggtaaaaaccgggttaacccggtttaacgggggg

SEQ ID NO: 271884 - DNA, 820 bp, Homo sapiens
  misc_feature: GYAE6OF01DSM7A.13.39.D06.1.454.CMB.1.raw
  modified_base (509)..(509): a, c, t, g, unknown or other
  misc_feature (509)..(509): n is a, c, g, or t
  modified_base (662)..(662): a, c, t, g, unknown or other
  misc_feature (662)..(662): n is a, c, g, or t
tcagtcacgtactacacgaccggtgctcgatttagtgacatctcgcagttctttggggagcttcagctgtggtagagaagacaggattcaggacaatctccagcagtcggccggcttccctctcctcctcaccctctcactcactgtgcgagggtccgtcgggccctagtctgtgtctgactcacgccctacctcgacggtccggttccggacccggggacccccgggagaacgggtaccgggtaccctaaccgtacgtttcccgttacgttttcggtttaccggtaggaacgccgtacggtacctaccgaaacgtaaggttaccggtaaaagtttaattagtagtttaattagtttggtactacggacgtacgtaccgtcccgtaacccggaaacggggaaccccgtaacccctaaagacgtcctactaactacgttaaacgtaagtaaactaacgtccggaccggtcccggtaccgtaccgggtaccggttacctacgtaaccgttnttccgtcgtacggtaccctacggtacgttccggtacgtaccctaaccgtcgtacccgtcccgtccgtacgaccgtagtaccgggcggttaccggtccgtaccggggacgtaggtacggtacgtacggttactttagttacgtttacggtacgnggtacgacgacgtcggtacgtacgggactaacggacgtaacgtcgggtaacggttcgggtaccgggttcgggttccggggtaggaccggggttaacaaccgtgggttacccgtaacgggttcccttaacgggtcgtaccggtaccccggtaacccggg

SEQ ID NO: 271885 - DNA, 796 bp, Homo sapiens
  misc_feature: GYAE6OF01E3QTI.13.39.D06.1.454.CMB.1.raw
  modified_base (654)..(654): a, c, t, g, unknown or other
  misc_feature (654)..(654): n is a, c, g, or t
tcagtcacgtactacacgaccggtgctcgatttagtgacatctcgcagttctttggggagcttcagctgtggtagagaagacaggattcaggacaatctccagcatggccggcttccctctcctcctcaccctcctcactcactgtgcaggtcctgggcccagtctgtgctgactcacgccaccctcagcgtcgtcggggacccccgggcaggacgggtccaccatcctctttgttctagaaacgtcagcctaccaacgaccggaactggtagaacttaactaaacgtcggtaaccagaccacgacccgtacccgaaaccggaaccccgggaccccctaaaacgttccctactaacttacctaacttaaaccttaaactaacgttaccccgacccggtacccctaacggaacgggtaccttaccccgtacgtaacccggttactttccgtaccgtccggtacccttaaccgtaacgttccgtaccggtacccctaaccctccggaccgttcccccgttacccgtaccgggtaccccaagttcccgttaaccggggtcccggtacccttacccggtaaaggtttcccggtaacgggtaacggtacgttacggacgggtacctttaaggtttaactttaacgtttccgttggaacnccgtaacgtactaacttacctacgtacgtaacccgtaccgttaaggtacgttcggtttcgggttgggtacggtcgggaacgggaacggtaccacgttacccggtacgtacccgttacgacggacccgacgcccggttaccgg

SEQ ID NO: 271886 - DNA, 727 bp, Homo sapiens
  misc_feature: GYAE6OF01C80GS.13.39.D06.1.454.CMB.1.raw
  modified_base (547)..(547): a, c, t, g, unknown or other
  misc_feature (547)..(547): n is a, c, g, or t
  modified_base (564)..(564): a, c, t, g, unknown or other
  misc_feature (564)..(564): n is a, c, g, or t
tcagtcacgtactacacgaccggtgctcgatttagtgacatctcgcagttctttgggggctgggcctcaggaagcagcatcggaggtgcctcagccatggcatggactccctctcttcctcggcgtccttgcttactgcacaggatccggtggcctcctatgagctgactcagcccacctcgagttcgtccgtcgtccccgaaggacagacacgccagcaactccaccgtgcctacgtaaggaaaattaagtcggacaagtaaattaaatacttaccttaccgttaggtatacgaagtacaacggtaacgtcgaacggcccgtaaccgttccccgttaggtcgtacgttcggtacctatactaactaacgaacgtacgacgaaccgaacggccgtaccgtacgacgggtacctacccgtaggaacgtcgttacttccgtaccgtcggtacctaaccgtaacgttcggtaacgggtacctacgaccgtcctaacgttaccgacgtaacctcgtaccggaacggacccgggaacctaggtcgtaacggnggtaactaggaccggtntacggtaactttaacttcggtacggtacgagggggtcgtaacgggactacggacgtacgaccgtaccggtaccgccggttattacgggttaccgtacgggtttaccgggaaacgttccgggggaaaccctacgggttaacccaacccggttcggtaaaccggg

SEQ ID NO: 271887 - DNA, 780 bp, Homo sapiens
  misc_feature: GYAE6OF01DG0BO.13.39.D06.1.454.CMB.1.raw
  modified_base (406)..(406): a, c, t, g, unknown or other
  misc_feature (406)..(406): n is a, c, g, or t
  modified_base (646)..(646): a, c, t, g, unknown or other
  misc_feature (646)..(646): n is a, c, g, or t
tcagtcacgtactacacgaccggtgctcgatttagtgacatctcgcagttctttggggctgggcctcaggaagcagcatcggaggtgcctcagccatggcatggatccctctctcctcggcgtccttgcttactgcacaggatccgtggcctcctatgagctgactcacgcccacctcgagtcgtccggtcgtcccgaggacacgacgacgcccagctactcctacctcggtcctacgtaaaggtaaataacgtgacagtaaataatactactacgtagtactacgagacgtaagtaagtccgacggcctaccggtcccgttgcgtcgtacggtacctacgttacactaacgaactacggtaccgaaccgacggcccggtaccgtacggaacgggtaccttaccgnggtaacggtccgtacgttcctaccggtcgtacccttaaccggtaaccgtttcgggaaccgtaccgtacgtacccggtccaaccgttccgtaaccaaaccgtcggtaaccggtaaccgggaccccggggtacgtaacggtccgggttaaacgtacgggtacgttccgggaacggttcgtaaccggttaacctttaacggttaccgtaggtaccgggtacgggtaccgggtaccgggtaacncggtaacccgagttaacccggacgttccccggggtaccttaccgggttagttacccgggtacccggttaaaggtaacccgggtaccgggaaacccgttaccggttacccggtaccggttaacgtaaaccccggg
